United States Patent 7,868,149 (PLANT GENOME SEQUENCE AND USES THEREOF) - sequence listing, part 36

SEQ ID NO: 18463 - DNA, 12653 bp, Oryza sativa
  unsure (1)..(12653): unsure at all n locations
cgttcacaagagttggaaagaaaaaanangggagagagagagagagagagagagagagagcgtagccatgagctgaaggttgaagacgatctatcaaccgttgaatgggcatccaacggctgacagcactccactgctatctcctcctctaatttaagactgaattgtactttgtgcgtaaacgtttcactttgcatcaccctatacacaattttttttactttggactagataattttatctttattacataatggacaccctaactctctttgttagccatgtctatcatttccttcggcaaagatatagcatgcatataagtatgaaagttcatcagcatgtcgttaacgatttgctcaaaatcattgaagtgctgaagatgtggttttgagtaatccattatacaacaaagataaagttatttaaaatgaaaaaattgaacataggatgatccaaaaaccaaaatgaaattttaaaaataaaacatgatccaaataaaattaactctttaatttaatgctcaacttcacaagagaagagctctagaaaaacaaaaaggagaagagagacaaatcgtgtctatgagctggaggttgaagacgatcaatcagcctggatgggcatccaacggctgataccactccactgctcttctttataatttaatggtcaacttcagctcggaagccaaataaaataggagtagtataatgtggtgtacgtgtacctctgttactgacgagttcagcccaaaggccaccacttccagcgtggttaatctcctgcacaaataataataatacagatttcgataaggaaaaaagcaaagcatccgcaggagaataaatggaaaaagaagaaagaaatgaaaagaaacgagacgtagctagctagctagtcacctcgaagaacagaccgaacagagtgtccggcattcttcgagcgacagagtaatcgacatggagagacgccgtctccaacgtctcggcttcgcatctgctgccgccgccgacgaagaaaagaacgaggaagacgacgacgacgacaatggcttgccgggacagcatgctcctcgtcgccggcggccacactctcatcattctctctgcgaccacaatgatcaatggattgggtacgttgttacttgcgagagggaggcttgattattcgaggttgctccatatctactgctggaaattgctctagttagatagagtaagtcacttgctaaaattgccaacaagttagttcattcacatatatgggttccagtaaaaatgtacagccagagcccatattttcttcatttttcctcttctttatctgctcatcttgattcattccacagaaattcctctgccaagggaggcttgagttagtgtgacatgaactacactacttgagttacacgaaacgatccaaaatgattatttgaggttgcacgatctactgctggtaaatgctttagttagagagagtcagtcacttgctaaaattgccaacaagttactagttcacttcacaagttcacatgggttccagccaaaatgtacagccagcccatgcatattttcttcctttttcctcttctttatcttctcatcttgattcattcgacagaaacatatcgaggaagacgaatgagcacaagcatttctattgctaaccccgtgcacgttgcagctgcacatctctgccaccagcaccactttgtttggaccggcccagatcaagaacgaatgaggagcaagtgcatatgctcctgcatcgaagctgtggcttgagatggccaaaaccaccaattataccacacattgacttgtgcattacatccagagataaaagtagaaaacagttgcttaccttatccggggttactgaaacagttctcatcaatgcaaaagacacaaagtttccctctccaatcttttctcccatcatgattttatcaaccaccagttgaatttgttctctactcagcttcccacaatgtaaatgactagtcagtatacctatatggggaacatgccatatttacagtgaaacataaccacaaagaatcaacagccatcctaatatggattggactccatttggatctgctcaatcctaaattcaaattctcagtccataatctgagccttaattttctcaagtttaaatgccaacttcagttcaagttcaaatccttaatcaaattctgatattctctacaaatctgttatccttggaccaaattattttctctttcccaggccaaagagctcatatttgttatccttggaacaaagcaacacggtggcaatgcgccatctagtctcatccgatataaatatggagaaagcaaaaaaaaaagaaaagaaaagaaaagaaacgaaaagaaggaagtaagccaggagtgaattttattcatcattccctgtgtattacactatacagtagtgcttcaagatacatgcacatatatggacagcattctggtattcgcatatcacatctcgtgtatttcttgtgtttctgtcgctaaccttgtgttgctgcttcacatctctgccacgagtttggactgggcaagcgcaagatcgaatgaggagaaagagtgaggagcaagcgtgacttgcatctgctctgctgcattggaaagctggcttttgacaggaacaacctgcattggttgtcatgagcaaagctttggcttcagatgaccaaaaccacaaactctactagacattgatatgtgcattacatccagtaagaagtcagaaatgtttgcttaccttattcgggttactaaaagagttctcatccatcacattactggatgtgagaacagtggcagttgatcccagtgcattaacacgggcctgaagcccagttgcagagatcgtgaggctcactggatcagacccaaagtttataatctgcacaggagatttcaagatcaattcatgaggtacgcaatctcctacagatgtagagtaggtttagaacaaaatttcttacctttactcttaagaagctattttcagaatcctgccaagtaattgcagatgctgccagagaaccagagtagctggaagtgattgtaactggatgaaacatagcaccgctagattcaccgaaaagagtctgcatccagtaactaggagttccatattgttgccaggagttaaatacaatggcgtctgggttccacctgattgtttgattgaagcattattacagtacttgttaaataaacaaaaacacaaataaagaaaccatggagtcatcaaaactaacgtttgatcattgttgttcacgaagagtggtgcataacttgccatctgaacaacatcactgcaaagaaccaacaagaagttacaatgaatatcttgttgcatttgttagtagatcttaataaagccctacccagaggaaagctcaaatgtgatctgtcacaagacccagaaagaaaagattgtttcaaggaaagatcacctattcttctccagtccagtaaggaaagctgcctctgccaatgaagcaagtagacttcctctacctgcatcacttctccaaacagcatattcactgacaaaagcctgcaaccaaaacatatatgaagaaagatagaagtgaataagcaagagatgcaatgaggttccaagattatccaaaacatgtaaacatcatcacacatgacatagatgaactgtggacattactgaattattgttgagaaatagatgaccaaggtcatcctacaaatatacgagagatgtcatgaaatcctggattattaatgtaaaatattagatgaagatgggagatttcacagtgctattctacaagcatatccacaaatgaaaaaaggtccacgacaatggaagtccgggcatacaacgtaccttgggcccattacgagatgatctatcaaatgtattcttcattgaaaacaaagtcttagaatcagtatagacctagaaaaaaggaattgtttcaatttaataaatgggaaaagccttgacatttgtgacaaagaatgagaagtgctggagaacacaactcaagaggatgagtagtttacatggaaatcatataaatcagcaggatggtcaagtggacttgatgaagcatcacaatttgaaatcatttgaatgtctggataggcctcccttatagcattataaaacttgaggtaattacctgtataatggataagagaatatcatgcatgtacctaaaatgagaattcaacagttgttctccacacaattcaagtcaaacatgtgccttatcattggagattatgatcaaatataaatgatttacatcccaaattttctaaaaatgaaaataatcacattttagtatgtttgctaccaggaattgtttttatgtgttactaatcctagtttatttgcaacaacaaaaaaatagaacatatattactacaagtaccattggcttggcgaagtacagcagaggaaaaggagaacatagggcataaaaaaagtaatattatatgcagattaaaatagtgaaaacaaatgtctccctgtaaggttttgctatggagatttatgtgactaaattaatgaaccacttctaaggaaacaggtacaactgcataaagaagttgcggcctttatttacagagtgagttgagtgactaccttcataaaaaaaattacaggattagcatggtccatgtacatatcttttattcgatcatacaccttaatttattccagacaaggctcttcaatttatgcagttatatggtgaagtgataaaataagaaagtaattgaggaatgcaccgcggtaaaattttttcccacaatcttcatttccaattgcgacgtatttgacagggaatggttcggggtgccccattgcagctctaacagaaccccatgttgaatctgcattcccccttgcaaattctagactgtccaatacgtcctgtagagagacaacaagagatgttcccaaacaaaaaactggtgttacgacaagtaacatagcttcaattcaagaaaagatatttagtattttcttggtaggtacattgttatctgtaagtataccagaatgcaaattcaggttaaacatcatcactccttgtgaacattgtgaattaatttttttgaaaagaactttgagaactaatagagtaaaagaacaagcccaaaaccatctccttttttacacaaataatcagctctatttcaatagtgagaaaataaggcaagagttttagcatcattcaatgagacacatcatatgcagttacattcttaggatctttaatatttagatatgcaaagataaaagatggaacactactatgatggcagtaaagatagtatcagttttctcacatgccatatccatggaagtgcagccatagctaggacgttacaggtgaattctaaagtggaaactatttaacaaatcaaggtgcatctgacctgacagaaaataaaatagagagttcagaacatacttttacaaaaggagcaatcgcagcagtatcaacttcatcattatggctgattcctgatatttaaagagtttagtgtcgattcaggaggtcagctgtggtgatcaagatataaaaaatatggcaattattaccattgttgaacacccagattggggcagcacccagatcctcagaaagctttgatgtggagttcaaagttttcattagaaaaatatagaactcaaaggcaatatatgattaggacgtgataagaaaatgaaaggcaggaataatgtcaagtaaactagtacctggagaaattcataatatccaaggccatcatcagtccagtaatgccaaacatccccaaagtgtccaggcctctcttcccatggaccaatagattccctccacctgaatgcgttccttaaccattccccctccacaaagcaacctcctacaattgtttgaatgtaaatcaagtcaattatcccagacatgtctggcatatatgtacatatcaagaacttgattttcaatgggaaaatatagctcataccagggaatctcaagaatcgtggttttaagtccaacatcatagatataagttctgtgcgaaaaccatgtccctgtatgtgtaaaagaaatgttggaagcacttgaaaaagcccatgaagacttaaagtgttatcatacactatacatagatagcataaaaagcccatggcatcgttttccttttccagtaatgaagtttgacaacaaaatataatgtaccttgtaagtgtctgcaggcatgagcgatacttgatcaaaccatacaactcccttcttgttagttgttatttgaagccttgaggttctatttgttccttgagcaaccaacttctgctccagttttgtccaattcgatgcaccagaaaccctgcaacaatataatcctttcaaaactaatgggaatgggcaaacatccttgttctcctgtcccagtattgagagaaaaggcactaacggtatggtagtggaagccaaattttgcgacccatcagaacttgtaaagaaactgtcaactccacagtttctggtgatttaacatacatcactaaattgtagatctttccatcttctatgttctgcgggttgatatgacaattacgggtgatcagagtattggaaaagaagcattgcaaaagttaggaaagcaaatgtttactaacacaagtgcacaaaagagctatcactacatgaaaaatcgaaacagaacatgtggaggtccatgatttacttgttaattttatgagaaaaggaaagaaaatggcagcaatactgtgaggaaaacaaactaaagaacaacgatatataagcccataccatgccccagaaccctgggttataaatgccaacaccaccagctgggcaattatcacagagaacctccatccttagagcaacagtattccgactaaaacatgacgttcgatcagtcgccacaaatatggaagagtcatcaccaattatggaccatggatcaatgtttgatggggtatgagggcctccagcttcaaaacctgtgcataaaactcataagttggttatactaaaccctaaatgtcaatataacttcaaaaaaagggcatattattttccatcgagtttatgctcttaatcaaagttttgtgtgtcaagtttacagtactaaaaagataactatgtttaaagtttatggggaaaacataatttagttaatcagatagtatggagaattttcgattaaagacaaaataacaaaaggatttttttttcgtaagccatgtttgtgttccagcagactgcagaagaatttattcatgtccattcagaagcaaattatgttttatctggaagatcgatcaaaataagtgcatatattacaacaaaaataactgaagtacctctgttactaacaagttcagcccatattccaccagcccctgcatggttgatttcctacaatattagccaagatcattatcatcaggacatggtggaacatgtataatctacctggattattctgggcatgctaatgcacttgagcatcctaacaaaaaagtgccagaggaaaggatatagtgatacagtgcaattgtgaaaaacagaattactgtatatgtctcacggcttacctcaaaaaatattccaaatagtgtgtcagggatctgtcgagcaagttgcggtgaggcatcaaccttgaggaccgcagtctgggtcgcatgtaagtgtaactctgaagctatacacttgcagccgagggagaacagaagcaagaagaagaaaatggtactcatgaaggattctctggaagccatacttggagctgtaaacactagtgcaggccgtgtgtctgttgaacaaataaagccagaagatgatacagtatgagaagtcaactaaggaagataggcatcggacaagtagatgctattactagatggcatgaaaacagcgataccattagaagaaacgaaaggcaaacatagacaagacagtgatatgtccaaaaccatgcttacaagataaccaaatcatttgctttgtttagaaaatcacaaaagcgttgacgccagacaatttggcaaggattaggaaagctgaggtttcaaatgatctcatcatcagggtaaacaaacacaaaaaccaatcaattgccttctactcggtcatttcatcgaactgggccgttgcataaccaaagaaacaaaattggaaacaaaagaagtcaagcaggggggagcagtaaacgatttcaccaaaatcgctcacaataaggccaccatccaagacctcagacctcaacaaggaaggaaggaaaaaaagctgggcgcccgcagaggcgttggggggcggacagacacagaccgaggctttggtgttaagtagaggagaggaggagagagagccagtggctttgaaggaaagtgtacctcgacctcgtggggaggcacgcaacgcaagcagaggaggtcgcgcggccgcctgatggtgatcggatgccgaaggcgcgcggcggcacggacgggggagttgcttgccgcggcggggttcggcacggcggttgggtgcggcccgcggggcccactgacatacacgtgggattgattatccgtagctacagtatttaatcatcgaatggaatggatcatctgtctatggctctgagacatctctgtgcccccacactgcctggctctatctaggcttagggtgtgtttagtcgcgaaaagaaaatttttaggtgtcacgtttgacgtttgactaaatatcgaaactcgaaaagggttttcagacacgaatgaaagaactaatttcataactcacctagaaaccacgagacgagtttattaagcctaattaatccgtcattagtacatatgggttaatgactcaaaaatttgtctcgcgatttccatacaaacagtacaattagttttttaatttatatttaatgctcctttccaaagattcgatgtgatatttttgaaagaaaaaattgggaactaaacgaggccctaatctatagcatgattggtgtctaaaataaaacaaaaatatctcaacagagtagagcctggattcaaatgcgatatttgtcgtggtccttatcgagctggctgtattcaaccataattggccaaagattaaaaaaaatttgaaactttttaacaaaatttatctgactttcatcggtttttggcaataacgttaacgacgagagttatcaatggaaacgctagggagggatttcagctatcgatcacattttgaaatcataaacagagcacaccaatacaaaagaggatcggttcttcatggttccttgctatcgcaagggatgaggcagttgtgcctccgtcaaagtttgtattagtacttcctcgcaaaaaaaaaaactgtattagtactaccaaagtataaaaaaagaaaaaaaaatcctctaatcaattgatcatttcaacaagactataaaattacaagtagctctctcctaggatttggtcagcagtgtggcagtgaagattgtcatgttcattctacatagttctaggtactaggtaatagcgcatgttctggcatacagaaagaaataaaaaaaaagagtacaatactgttatatttagacattttattaagtttattttacccctcaactattgcacttgcataaaatacccatttaactctaatatgaagtacaaacattgctgttattaatagggtagttcggtaatttaccataccttcatgttttgtctataaagaaaatgctagaatgacgaggagtagtgtgttttgttttacaattccgcggggccgtacctaataatctgagtcccctatacgaatcacaaattggtatttagaaaatgccaagaaacaaaagaataaattagtggtggtattttacctaagtcagaagaattttttttaaagaaataaattttagaaaaagaattgtggtgtgatgtagtgattttttgttatgtggaaaaaatagaatttgtaatgcccgaaacatactccctccgttcatattcaaacccagaattgggtttttttgagacgaagggagtatgttcgtatcattatcaccctctttaaggtggccataattagtagtactacttaccaaagctgaagaaacaaactcattctagttaaatctattatattattaaaagaatagaaaaaggagcttccacgttcgttctcatggcctagaaattctcacattaatcgaagaaaaagaaaaggcagagtccatatagaaatacaatttaaaaatagctgaaattcggaattaaaaataaggaatattagaagtagagaatagagtccatatagaaatacaattaggaaataactgaaattccgaattaaaaataaggaatattagaagtagagtatagaatccatatggaaatacaattagggaataaacataataaaattaaaagtagagtttagagtccgtataaaaatacaatttacaaataactaaaattcgaaattaagaaaaacatgggaagaagagtttaaagtcaatatagaaatacaatttagaagtaactgaaatttgaaattaaaaattaaagaatattgaaagatgagtttagagtccacatagaaatacaattagaaataataaaaaatcagaaataaaaataaataatattagaagaagagcatagagtttatatagaaatacaatttacagaaaattcggaattaaaaaaaaagaaatattaaaagatgagtctagggtccatatatgaatatatataatttacaaataactaaaatttgatattaaaaataattaataactaacacgtatataaaatacaatatgaatattacacattagtagttttgtaaagttattgcaaaatttaaaattatgttgttattttaatatatttgaataatataatgagaaaacatatatgttattatataagagaaaatataatgatgctagccgcgcaatctgcgcgggccaccatgctagttaataaaaagtaagagtacatttttttcaaaaaagaaaaaaagcgagtgaaagatctttaaacatattaaaatgcattggcataaattaagatatgaaaaaaaaatttaggacctctaattagtcatccacttcgtaggtagtccctcatcgacaacgttgcaattctgatcattcatggctagaatgaaattgattaaagaaaagtggtgattagttaagaacctagtaagatgtagccatgcaggacagcaagtgaaacaaatttcccagattatttgccgtcaaattgaggaactatattgaccgggcatgcatgaaaatactcgctcatgcgtgatgattgatggaatattatggcgttgctttgcttgggttgggtctaaacgtgaaggaacatcgatcgatcatacaagcgcgatagcgatgtgactcatttaccactgatctgacctgattctgatcgagagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatctgatgcgctcttgcgtgtccgtttgcactcgagatattgaagaagaagaagttgcattgcttgcaagatatatatgcgacagtaatcgtcacatctgtcctggagaatataatgcacaagtgttcattgcagttccactactcttctatcgatctttaatttcctgtattactattaatctgcccgttctaacgctatggtggtatttaataacgtaattaaacaactaaaaatatatacaatgtatgctttagtgattaagactataatgcacaagatagttttaagatcacacaaaagaaaagaaagagaattagattgtttaaacatcaatctgatatatatacataaataggtcaaaagtagacatgttcaatacaatacataaataccttcgaccagcagtgaaacacattgtctgctaaatcttcaggatgcgtttgcacagtatcatagatatagcagaaagaaaaatgctacgcatacgatttttgtacgatcaaacgtaacggcgcggacggcaggggaacctaacgcgagcgcacggcgcacggcgcacgcacacgcggcaggagcgcttatgggcccgaaagcccaattaacctctttgcagcatctgacttgagattatatctatacttgagattatattagaataatctaccaggtagtattcaatctaactaaatttactgtctaatctaaagggaaaagaagatattttgggccttctttctcacgactaaaagagcggaatgtttgaaacaagttctgcttcatcaccatgtgacatcaattaatgtgctgagcagcactatactttggcttttaagtttgtctctaggaagtctctatgtatctaaacatatgcaaaccttgtttgacattggttcatactacctccatcattttttaaataggagagccnnnnnnnnnnnnnnnnnnnnnnnnnnnnnnnnnnnnnnnnnnnnnnnnnnnnnnnnnnnnnnnnnnnnnnnnnnn

SEQ ID NO: 18464 - DNA, 1977 bp, Oryza sativa
  unsure (1)..(1977): unsure at all n locations
naaacgtcacacaagagatgaaaaaataaaagagggcaaacagataanacagagaaaaagagaaaagggaacccataagctgaaggttgaaaaagatctatcaaccgtggatgggaatccaaaggctgacagcactccaaggcaatctcctcctcaaatttaagactaaattgaactttggggtaaacgtttcacttgcaatcacccaatacacaatttttttaactttgaacaagattttttaatcttaataacataaagaacacccaaactaaataagtaaccaaggtaaaaataaccttcggccaaaaaaaaaccaagaaaaaaagatgaaggttaacagcatgtcgtaacgaatttgctcaaaatcattaaagtgctaaaaatgtggttttgagtaatccataatacaccaaagataaagttatttaaaatgaaaaaattgaacatagaatgatccaaaaaccaaaataaaattttaaaaataaaacatgatccaaataaaattaactctttaatataatgctcaacttcacaaaaataatgacttaaaaaaacaagaagttttatcactaacacaactttaaaaaaaaattaaaattataaacatacgcataaaattgtaaaaacagccgaatggtcaaacacgccacacaaagncancggcgtcatctattaaaaaatggagggagtatataattagaaagaagattgctttggttggctatgcaagcatgccaacgagagagcagaccagcacgtcagagcttgggctttggatatgggctcaacagggaagcgatccgtttcatcgctaaaaaaccgttagaggtcaggagagaaacgtttcatcgtacaaacatcgtacaaaaacaatcgtacgtatagcagtgctgatagcagaaagcatattcacaaatcttgaagcacaaaggaggtaaacaaatattatttggctctgtgacaataatctaacatctacaacactataaaaagtgatgtctaaacggcacaagtaggttggtgcagtagcgcgtaagttgcaacttaaaccttgaagtattaaaccttgatgttcaccctttggctctagaaactattcctctacattgttatcagccactgaggagtattatctcaacattgtagtattacctaccaacagagattgttttttttattttacattgacaacaagatccttgataccttgttctttgaagaggttatatgcctccgtccaatctgaaatagtaaaacaacgaacaaatcgtaagtgcaaaatatataaaaggtatcagaaaatgcctatcagaagtttcaagagaaacatgcttgacccttttgtatttcacaccataatcttatatagggcctgtttggtacagctccaactcctaaatttagctccaggagttgggtttggagtggagttgtggagctgcctaaacccagctccacaactctagtttattttgtgagagagctccacctagctccactcctagttttggtggagctgaaactgtttggctgagctccagctccaggaggggtagagttagagctggagctgtgccaaacaggtccataggctcctaaaacacaattcagatatcaagttaatcgaacaaaatggagtatacatgcgcaaaaatcattcgacattaaatttaattgtcaaaggtgacataatctttaccctgcaatattcatccatcatctcatataactccaagcattcagatttgtaaggtgcatttataaatttcgtgaaggaacctatcaaagttcatccatcagcttgttacagttcttataagtgatagttttgtgttgaacatgtgacggttttccgattgcaaaaaaacagagagaacttgcaaaaagcaagttgaattttcattaaaaaannnnnnnnnnnnnnnnnnnnnnnnnnnnnnnnnnnnnnnnnnnnnnnnnatntctaatgcgcgt

SEQ ID NO: 18465 - DNA, 2376 bp, Oryza sativa
  unsure (1)..(2376): unsure at all n locations
accagagttccaagagaacctgcttgaccttttgtatttcacacaatatcttatatagggcctgttggtacagctccaactcctaaatttagctccagagtttgggtntgaagtgaagttgtgaanctgcctaaaccaggctccacaacttctagtttattttgtgagagagctccacctagctccactcctagttttggtgaagctgaaactgtttggttaagctccagctccaggaggggtagagttagagctggagctgtgccaaacaggtccataggctcctaaaacacaattcagatatcaagttaatcgaacaaaatggagtatacatgcgcaaaaatcattcgacattaaatttaattgtcaaaggtgacataatctttaccctgcaatattcatccatcatctcatataactccaagcattcagatttgtaaggtgcatttataaatttcgtgaaggaacctatcaaagttcatccatcagcttgttacagttcttataagtgatagttttgtgttgaacatgtgacggttttccgattgcaaaaaaacagagagaacttgcaaaaagcaagttgaattttcattaaaaaacgagttcagtggttgggagtatagaagaaaacaaagcttaaaatgtaaatgtaattgcagggaatgaaattgtggtgtaagcattgaaactgcaagcaatgcactgattaacttgactattacatgtaagtctgttctagctcaatcactaactgcatcccctttactgaccaaaactatagtcaaccttgagcaggatgagcacatccacaaacccatggaagatgtgctccaacacagaagaccataagcaagagctatgtaatttgccttcaattcagtgagtcccagtttcagtgagcaaaatccatcagataagcaagacaacatgaaaaggctacagaaaacaagaaaacttctgaaccactcacctcttgtcaacatgattagttttgttcctaaccagcacaattatagaaatcactgcccctctcagttctgaattcctctatccattttgaagtgtttaggaaatattgcctggctacagcatgtaaactaaatttaaggaaaagggcctcaggacaagaaggagcatttataatgcaaactatcaaaaatcacaattttgtgttcatgtgccatcaaatttgcttggcaacaatctctgccggtctggttcatccttgctagtttatatggcaccttagatactataacatgtgctaaagagtgaatcacaataagagcataccttcagtaccactccggaccaacaacctcttctcgggtgccaacaaggtcctcaacgccggttgctcagcatgtctgaatgcagaggaggaactgagaagctattcgatttactcattgctatcagctatcaacttgcatgtgtatctccatgccaccgcaatctattatacagtaaaaagttcagtgcatcgctaaataaaaataaaaatacttcaatctacatgtttaatttttatctaagggttatttttcaaagctactaacagtaattaataagttgttatctgcagttctaggaaatgattggtatgttaatgggcgaaatcgagttaagttaaatggatttgcaaattgatctaaaataagattattaaaacagattattccatgataataactgtactgccagtaaagataattaaaacaacagcagtagcaggaagttccacgcccaatctaatttcaaaatgactgtaagaattcaagcatgaagataaataatggctgtcaaaatctgatatgatggcagtgatgtatataagtaaatttgatatgtcggcagtgatttgatataaaagtcgttcccctttcaattgactatacaacaaatctactccatcagaaattagaaatgttgttagcatattcagaaaaaaaaaagagtagagtttgatttagttgcagagcctctccagtctccaccaattttggtatccgacctgaaggccctgaaggtgctagttacagtcacagcacctttattttccttctggtatatctgcaagccttcgaaatgagtcaggacacaaataagctaatattagcattcgggagggatagaaagaagtaaaatccacaacaattttcagacgagtaatttcacatagaaactcataatttgaataaaaataatacgtcacatgtaaacaattcgattgtgaaatgtctaaaatttgcttctttcctccttggaaggcagaaccaggagttcaatccctaagacgatagaccaagagataaggaatatttacgtgaacacgcaataggggtacgagntngnatgatcagcaatcaaatttct

SEQ ID NO: 18466 - DNA, 746 bp, Oryza sativa
  unsure (1)..(746): unsure at all n locations
agaacaactgancggtcagctctgcacccgatacatccgctcttngttgaagtcgaagccgtcgattgggaaaacgagcaaggcaagacacatcatcttgatcatattgaatcccagtttataaaattatgttgatttaaattattgcattatcgctttatttaaattcccgcgttatcactgttttatttagccatgcctatttacctttgctatgaccatattattattggcataggtattattattaccttgttcaccctagacaaacaaaaccccaactagtggacactctctactcatagtaccactagtataattctagggagatgcttcgcaagttaattaggcaacattaggtggttttacaactctagacccgggaaattctgatatcatttggacaccatggaatggttggcttatgttggaattggacacacacctctttttctttttcaaaacccctaaaacctgttttcggtggggtttgggtgcatgccagttgtgggaaatagcaccccggccactataaggactaaagcttgggccttttgtgcaaagcactaccgtacttccacatgtctaatgggtaaagcttaatttggggctcagtctagtcataaacaaaagtacacagattggagatggatgaagtcgggggtcgatggacattctccagtgcaaatgaaggcttcacgagctgcgggcccggtagtcaagatgtcatacggcggaggggttgg

SEQ ID NO: 18467 - DNA, 760 bp, Oryza sativa
  unsure (1)..(760): unsure at all n locations
cccgcttgaatgcaatctacttgtcacccnccgcaagccaacatgatgaatgctttcctccaccacctccaaaatctgccacagcagaatgctcccccaccacctccccaacactccaaactcgccgaattcctccgcatccgtccacccaccttctctagctccaacaaccctgtggatgcgttggattggttgcatgccgtggggaagaagctagacacggtgcagtgcagcgacgaagagaaagtcatcttcgccgcccaccagctgcaggggcccgcatctctatggtgggaccacttccaggctacgcagccagaggggcaaccgattacttgggctcgcttcaccgccgctttccgaagaacccatgtgcccgctggagtcgtggctcttaagaaaagggaattccgggagttgaagcaaggcaaccgctccgtgatggagtatttgcatgagttcaacaatctagcccgttatgccccggaggatgtgcgggaagatgaggagaagcaagagaagttcttggcaggaatggaccctgagctgtctgttcgtctagtctctggggactacccggattttcaacggctggtggacaagagcatccgcttggaagccaagcacaaggaactggagtcgcacaagcgccgcttgggcgaattccgcaatcagcagggtgctaaccagaaggttcgctacaccaatccctacccagggggtatcctcctcgcaacagcagcagcagcaacaaccttct

SEQ ID NO: 18468 - DNA, 3425 bp, Oryza sativa
  unsure (1)..(3425): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttaattagtgatggaacttttcacttatgggaaacaaatacatgtacgtcagaaccatggtcttcatctaatggatatgtatctgtaagtagtattcattcttaaataagtactgttcaacatttaacattgttatttaccatgtcacaaggaatggattcttaataagtcatgaaatgaaagggcaaatgctttgcatgttatgggcgattgggttgtgttttaacataagaaattgttatctcagatctattggaaaatgatgttgtgtatatacatgtatttatcttgaaaactagtatatttagcatgattatgaagattgataaagcatattaccttatttaacaagtgatttcaagcaatatatgttgaaagcatgcctgtatcaagcttctgaacttgggttttattttgtatttataactacctttcagtacctttttattttttaatgtattgtcatttcaacatctgatcattatgattcttttggcatctagaataaaaaatatacctacaattttgtttgccaacaagggtaattgcttgttcaacagttgatttttgcttcagtttactttataaattgtaaatattacataaagctcattttcatttgaacctccccaagaatatacataagatcagttttacagaaaatgtatctcattcacttgtaatatgtatgttaccccccttaaaccagtattttgaattaaatatgggtgttgtgactagttctggagttatgatgttttatgcttttatcttgcttgcatactagggagcaaattgggatccagaaggccgtattgtgttattgtccttttctaactcaacaacactgggctcaattcacttctcatcaaaaccaccatctttaggtatgcacagctaccctcatctcactacaacatttttatgtgaagttatgccgttatgtttattgtctgtatcctgaacattatgttgtgttcattgacttcagatgcccatctcctaccagtcgaacatcctgaaatttcctctctgattgtcaggtaacaacagttggcctaccattctatacccctgacctcatgtgcacctgatggaacatattttgcttctgtcttaaatgctaactttaactgatgatattttgactaaccacatttgcaactggttcggaagtcattcatggtatgtttttaaagaaatcactcatagtatgtaacttatgattattagcaaactaagtaaaggcaagttctccctaatcaatgttagcgcctcaaccattttttttcttcaaaataatatatttagatctggcttgtaaaaagtctggctcttgccatcatttagtatatactcagatgctttcatttaggataaaccttacataaacaaaggttcatcacttcatccatgacagtctagaaaagtaacttcttgtccactccatatacttatttatgctttctctggttcatctagccgaggcatagataaattagcatgggattcttcaggagagcgcttggcattatcgttcaaagatggcaatgaaatgtatcatggccttgttgctgtctatgatgtgaggagatctccacttgtctcagttttactagtgtaagtacagccctctaacttaccatattatcttggtcatgaacattgtatctcgatagttttggaccattgtctgatgaagttccaatgtgcatatctagtggattcattagaggacctggagaaggagcaaagccacttgcatttgccttccatagcaaatttaagcaaggaccattgctttctgtggtatgagatcatcaaaagttttgagcctattagttagtaaatgataattgtggttgctcacattgttgtccaactgttcatgcagtgctggagcagtggctggtgttgtacgtatcccctcatacttcgcccgcattgactccctaaaaggaggtaaatctcttcggctaaaagtcttgaactttagtggcatgaaatcagctatgtttattaatctgaagttcattttccttttatgtccagtaagtaaggtcaatagatgattggcatgctattgaattatcttttcagagagatgcattctataggagcctaaaaaatgctgctaagattgttatcctcctgtatgtaaaattcttctctctggaaacggtgctattcaatgaaggcaaaaatagaaaaaaaaattctgaaatgtatttggtagcataacaaatgtctgtattatacttatttggagggggaaatgtattgtctgcgcttgtgtttatgcagttccccaaagcaaggacaccattgtcttaccatgtgtccttttagtgcatgattactgttcattaattggctgcactattgcatggtaagaaaccttgaatgaaaggtttaatcagtttcaattggacttgtgtttgagatatcacaggtatgttctgctgcatcaaatgaaatgtcacccttatcacttggtatgactgaaacgcaaggtaaacatgcagaataagtatgaatgaaatatagtccaagacattcttcatccaccnttcattttccncctccctgttggctgattcagattagctaggaatcattcaagctgagtagcngnagcttagtgtgatcaaaggaatagcttattgacaatgatattaattagcgttaccgctaggttcgataatgtgacaaccttaaactactcttacagcgtcataaacaacagggtcacacgaagtgtgattagcaaatgccagaatgcagtatatacactctgttagctttctgaaattcaggtaccacacctcacgtaatcatcctgtgttctattctctggtataagtgtgcatcattgcttcacatctctgccacgagcttgctgtactgatctagagcgaggtcaaatgaagtgaatgaataaggagagagcgctgcttccatctcttctgaagcatctggcagctcgcttttaaccggtacgacctgcatccatcgttcacaagatacttgtacgttagatgaactcgccaacacctgagaatatcgtgtgccacactgagattgaccctgtctgcgaaaaaattatcgagaaagactagagaataattccagacagctaaataaacaatttcttaaaagcttacaaataaagctgaaagacagagtttgcttacgacatacggcttgcatatgtgtgcattctataaagttgtaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18469 - DNA, 3359 bp, Oryza sativa
  unsure (1)..(3359): unsure at all n locations
tcctgctactaagtttgagctttgctcaagcttggttggcgttacagtatagtcctagagactatttggcgcgcggtgattttacctacatgaggtatttttttggtgattgatgttttcatgctacaagaggaaattcgtctcaaggtggagattgttaaatatgtgatccgaattttgggcccacaatatattcggattagttttctagtaggacttcatgtctatcctattaggtgtctttctatttcccctatatataatcttgtaagccgtacgggaagaggtgacgttcccattgtgattcccctacgtttgtaatcatctcctctatagtgatcattgccggtcggcgcccgtggttttttcccgcaagggttttccacgtaaaaattcatgtctccgttgtgcatctattttcataacagttcactcctcatatgttccaccctttgtatataagctaatgtgattgggcaccaaactttgttagttggaagatcgtaagaaactgcaggttttcatagacatcctgataaacaccctagacccctcattaataccggtttggaagggctataactctcggtttcgacggttttaaaactggcactaatggccctcaagcaccgcaccagacaattccatgtgggtatcgtcggtgccggttagggcagcgaaccgccactaatactcatttttgtgcaaaaacaaatacaatcaattacttacttaatccatggtcacattgatccagaacacagctttcttgcatacacacatttatatacaacaatccagaatcactggatacaaagttttttttatttcttgcattcattcctcatctattgcaaacagtggagaaagcaggaagatgccaagtgcatctgtaatacagttatgtaatacagcaaaaattaggtgaacaaaagtttgttttattctgcaccgatctcattaaaatcgccgatcaacttcagttcagtaatcctgttttttttttcctggcaccgtccttcctttttgagtaagcatgttgtttccactctttttcttcctttttaataattgtggttctctcatcttaattggattgaaaaatcagacgccattttcttcctttcttgagactcattgttgttgatgcaactcattccctcttttctcagatgaatatagagtactactgctttatttcaggttctccagtaaatcgtgcatgaaaatctgataggttattggtcttagtctaaaatttacattcagtttgcgtgacatctgagtattctgcagttcatgacttctttaaagttgtcctgatgacaagtacttgcagttgtactttgctacgagaatgaacttgtcaagaaaacctctcaaccttaaagttagtaggaaaggttattgttggaaaaagaccattatatttcctctgtttattcacaccattgcttgtgttactgaaggttcaacgtgtcggatttttcttcagcacattgcaattctgagaagcatgggctgtatacagcagtctgaagacaggcattccgaccttacctgcaccctgatcgagctcgactaaaagtccttatggaaagtgatttatctaggacagatcaatgaaaataacaagaccagctaaaaacccagcaatcatggtggggacatatacagctagcagatgatggttcatggtggctactctgcacttgcacaatcaaatgaagtatatgaactgacctttagtttgctgcgcagccttgaggatgttgatgtttaaatgagtgtttaaaaaattaaaattattagcaacaaaacagagcatacaagtatagaacaacaaaatagatcaggtatggagacatacttgagggagcatacaccttactgtttacatgatgaagaatagttataagtgtttgcccaaattgccatcatttatacttttttttgtggaagcaatgggaatcctccaatttatatgctagtgtgttgattatatagcctatgggcatgatagctgctgtcaacagaagctttttatacaaactgctatcttactgaccaggatatatctttttggtacctggatgttgcgatcaatgttccatacaacatgaaataatatctgagtgacttgagcattgacaatgaacatttcttttagtaatagagaactggccacattattatttgctgaaagaaaaaaatgccatgggattttcagagtaagcatttgagaactacttagattatctgcctggtacatgtgagtaccttttgcattacatgtttggtaattatcacagtatttagaactttcctccacacaaatttgtatatgtgatgaaaatagaaaatgttatgggatatgcatatcaaggaaaatagactaacatgatccaactaaatttagtgagcagaaatttgatcaaaggtcaattcagaaaactgcaaccccaaaatgtgcattactttgccaatataaaaaaaactagaaaaatataccaccaccattccattagaccattactaaataacatggaaaaattacgagatataagtaaaacacacaattatatagaacattatacacattacagtaatcctaggaaatgaagacttctagaattagtatggtcctcgcaataacataccaccaagggactccaatattataaatattctcccttcggtacattattattttattaacttctagctaaatcaactgaaaggaggctctccactattgattccattgttggccttttcttcctatcttcctccaagcaggacacagccaactttaccaaagtttttgcttgcaagtagttgaattcatcacccactctgaaatctacgaactctgctaaccacaatgatttctcattgtccaatctataacaaatcatcttaataaacttcttgagcatctcatgcaccttcgtcttatcctctccaacgattaaatcaaagactcgtcttcctgacactagctcaagaagaacgactccataactatatacatcaacctttgctgttattggtaaaccagatatccattctggagcaatgtaacctatggtccctcgtgctcgtgaaacattttgattagagccagatctactaagcagctttgccaacccaaagtcagtgatcttaggttctaaattctcatccagcaaaatgttctctggctttaggttgcagtgaatgacccactctaggcactcatggtgaagataagccagtccctttgcaacgcctaaagcaatattaaacctttgcttccaatnnnnnnnnnnnnnnnnnnnnnnnnnnnnnnnnnnnnnnnnnnnnatctaatngcgcgc

SEQ ID NO: 18470 - DNA, 12805 bp, Oryza sativa
  unsure (1)..(12805): unsure at all n locations
gcgtcttgatataacctatgtctgctgcctgcaggtcgactctagaggatcccctgatccattctcaacatactctaagaccagcaatctatggaatctttctgagcaaaaaccatatattcttactaggttcatatggttgattcttgaaataacatgcaactcatcctgaaactcctccctattttgcgtgacattttccaacttttttatgaccactgctcgatcgtcatccaatattcccttatagacaactcctgaacctccccatccaagctcatgtttaaacctttcagttgccttaaccagctctctatgactatacattcggaaatgactagtcatcaccctgtagccttcctcagctatccatacttgagatgaccgcatctccttcctcaagacaaagaaccatgcaaatgcgaagaagaaaacctcaacaatgaaaaacacaccgataaacccatagaagtagaaccattttggttcctccccaccaatcttattcatgttacgaactgcctctgtggttattgtgtttaaatgatcacagtcaagtccacttagtgtataatcatgtatactagactgtggaatgggtttttttgaaacatccaaacttgaaggaagtttgatatacatcgttcgcacaaaaggtgttgggaaagtccttccattaaagagaaaagattttggatagcatgtaccatttccttcttggtattgaaatcccttgcatgtgcagtcacttatgcaagtgttccaacacacctcccaaggtaccttttcaatacagtgttgatcagaaccccaaaaatcagtgtttcgaagttgcaaaaatgttacattctgtttaccatcgcatgcaatttcgacaataggcttgcaaccttgtgtccagttacccggattcctcatcttataaccaggtgggcatgaacatcttggtgtaggtgaatagtggcagattccatatggaccacacaaaccatgagtcatgcatgtttgaggttgagcaatccatgaaattgtccatgttccatctgagttattcaagctatagagtctaagattaccatcataatccaaggtaagccttcttttaatccccaagcttctatcagaggcaacacgggcttgatgcttagcaagatcactcgaaaaaaattctccataatcatcaagactacctatccttgtactgttataaaggttcctattattctcatagtactggtaatcaggatctggccagtatacgccggaaacattagtgtcatcatatataagtgacaatatcgactgatcgctgaaacggaaggtatagtgactaggaacctgtaacccagtggtagagactaactttgttgtagcgagaatgcgttgagtaggaagcaaagtatctgtcggtgaatcgaaactttgccaaacaatgtttccactggagttcttcaagacaaggttaccagtgttcaataattgaacatatcgaacattagggaatttaccgtcagtttgccacacgactgtgccgtcatagtcagtgaggactatgtttccatccttgcgcagagtgatctctgatctccttgagtgcacgggacggccacggtttgcgctccatacgatggccttgtcagctgaattggagtaccaaattgagaaggtgaaggcgctagtgatgttgtaggcgttagtgatgttgtagaagccacatgagaatgtgccatcagatgactgcaggatgttggtttcatactcttcaacaaaaagagaggatttcagtggtagaatatcatgagttgcagcactcaatggtagagcaagcaaaaagagggtggcaagcccagcaagggaagtagaaagaaatggagcatccatggttgcagtcttggagagatggtctgagcttcagagattggatgagcatagcttgactactactttgttgcatgtggtgcaatgtatcttgaatgacagttctgatttagtcagaaattcacagtgcggttggtgtggcgttttggaatacttctctgcagtttttgacttttttgaagttatcctgcagagaacttctggttgggttttttttctattagaaaatgacatttaccttgaatatatagccaaaacaaacatccctaagatgcaccttgaataaattatctgcaaagagaacatttggatatgcttgaaacaagtgatcaaaatcggtattcagtaggtccctcccatgcatgaatatacagccgaatgatgatgcttcaggatgactcttatctcttcgttgaacttgctagaatggtcaaaaaaatatatggatcagttccggtcagtcactatatttgaacagggtcagtaacttgagagttctaaacttctaatgcaacatcactgtctagataattgttacgattatcctatccatgtatcattctctggattggattcttcaggtccaggttcgtgcatatgggagcaaacaatactacaattacattagcttggaaggaacaatctaacttagtgagtgtgatgcaagttttgggaagtccaaattcataatccacttctgaataaacatgattcattgcatcatattccaaaaaatatgaatgctagaaaggtattaaacatgattcataatccacttctgaataatcattgcatcatattccaaacaactgcattgttactattactggcatatcattcactgaccaacaaaacgaaaacaatcatgcgaatttgacatcaagataccattattgacatataattccctgaccaacaaaatgaaaacaaccatgcaaatttgacatcaagatgtaactgtagataacacgagctgagtagagatttgtgtatggaagaaattgccagttcttatcaacagcacctttcattcaacaagtttgctttggggaagatgatagctgtggtctcagacagggtgaagtgcgatatcttctgacctctctgttggcatctgttgtctcttccagattatgtcccatctcttacgaacttccttgctgtattctacagcagcttgctcgtaattcaaagaaagaactgctcgaagacgatgatgcagagctccttctctttgaaaaacctttccatagaaaacgattattgtccttacaatagatcagtccaaagcataaatgactgcccctagatcttcattggagctatctctgcaataaaataaatcagtgtagtactgtcaaaactaataatctatggaggactccggggttcagcaactgaccctactcgagtgccactgcattgttatagctgccaagcactatgatgcattccttcttctctaggtgcagtgccgttgctcatgacagctgattttcttagcttgcacaagcttctaagatcttcaccagatgacactctaccaccgacgtgtcaagagttgcaaacaccatagatggtcaagagattaagaaaatggtttgcggtcttctaagccatatgattcttgaacttcccaagtatatccttgtagaaatgatacacatataagcattataagaatgctcatataaattgccttcctgatcattaggctaattctctgacaaatgccactttgagcttccaacaaggccttcagtgtttgtctggcacatgtgattctataactcgtaactactttcctgattgtgttccacagtaaaccgaaatggactgtccatttcatcaatgccacgacatcctgacaaaataagacctagcattttccttcttacattatagacagggtttggatcaaccaggcatcccttactgtaactctctctaagaaggacatgctgtgtgcttcctttggttgagatgtagaaaatgccaaggtgcttaagaataagctcccgcaggtttacctccataccaaaaggtcttctgaagtgggacaacctctcaagtggtatcatcttttctactgtcaagcttaaaagttcatgaagaatgccaacaatacgtttctcgagccgcccgacattgtggattggatgcaaatcattcttatcataagccttagtatagggaagcctctgccagttcccaagcttttccctaaaaccattctcgatcttaaagccggctggcaagtttataggaaaaacatattttgtctcagattcagctaaccatttttctgtatattccttcgctcttcattcttcaacatcagctacagctagactttcatccctagtgaccaatgtcagagtatcaggggaacctagagaaaaatcagactgatggtttgttagtatagagcacctatagtcatcaggcaggccaagttcccttcttatgagccacaatgcatgcatattcagagttccatctttcattagcatgaggagcttcttcagccgcttaacaatagcaggctcattttccctgatgacagcatcttcttctgcaatcaattcagccatttttggggtgaccttacagcattcattccttttgactgggtgcacataaatgtaaaaaatgtggggatatttcttaaggaaagcgccaatctcaatatttaggccaacctcatgtctccacctggagaggagttggagagatgcaaagccattcctctgctgagatatcaactcgtgtaaatccaaagctagcctcaggttcttcagttgaatcatcagcttgtccagtttatgatctcttgttctgccttcctgtcgagttcttgctgaatcaactggttttttccacctcctctgtatggtgcaattataaggaccatgctgaaacaccgcatcccatatgtgccttctgaggggaaagacacgcagatttctttgaccaaacgctatagatgccattcagttgtatattcagaatcaggccttacttagagctcacaaaacaccatcggcatgcaaaaatggatatgtgaatcaatgtcgatttgtcaatctgcaacaaagaaattggatgcattgttatctgtaataccaacaaggtaaactaacttgtcatctgtagaaacaaccaaatatggaggactaattaattttcttttattattgttccacaaggttgtgcaaaatagcaaagaaacgcaggatgacaatcagttttggaagaagaaagtgacagaaccttaaccttgctaggcatttcgtcgaacatcatgtggtcaaggtggaggaagcaaactctaccggatggaggaaggccgtcgaacgcacacgtacggacaataatgtaggtgatgccgacgagaacaacggcgacgagagggatcgacgactctctgctttcccctggctggcgcttctgattggcttctagctagagttggggaaactggaaaaggagagcgtattggggagcttctcctgtctgccgctgattcgcctcggctctgccgtcggccagtccgccatggcgggttcgccggatagctatggaccattacttggtgtacgtcagagaaaagaaattaaaattatacattgtttttggctttttcagttatatacatactcttgaaaaaaaatagaaaaatatatacacgtaccattacgtgtgaacgcacgaccaattatttggcgtggcacgaaggtgccggaccgatggttgggacaatcccgcgccgtggcacgtggtagccgattgggaagattgtcctagccgttggtcccctaccgcgccaaacaattagtcacgcgtcctcgtaccacggtacgtgtatattttcataattctttcaaaaacatatatataactgcaaaaattctaaaaataatgtatattttttacttcttttgtcagtgtgtaatgaacatcttcccaaaacaacacttgatttttcattagtttttcaaacactaccccacattcatgaattattcattcatgttacataatgaaagagagatgaggtagttaattaattattactaattgtgatcacagtcgtatccaccagggccaccaaaggcgacattgatgccggggcgatagaggtcggggccatcgcccttgatgtcgtagcacttggggtgggtgacaatggtgttgacggggtcgtcgacctggtcggcgccggtgtaggcgatggcgaggtaggcatggatgcaggctgcgttctggaggccatcggaggggtacatgccactgcccattggggtgagcgtgtgccgccctcccggcctcctgtccagcacgtgccctcccatctcgttgtggaagctctcgatgaagggcgccgcgaacgcgctctcgtggaagtagccgatcggctcatccatcagcgacacccaccacaccgccggcccatcatcctgcatcatccactcttatatataattaatcaatttaatttctgaatactaaaacaagttctgttgctaaaacaaaattaatggtacgtcctgcgatacggattgagaagcctcctagctatccctttcccaatatatagcatagattactcatgctagctctatgtcttcctacacaagtgttagtcatttgtgatttctatagttgattttattgaataaaatgtgtggaacatgtaatttattgttatgtttgctggttgaaaattgagatgtgatttctaaattgtgatttttgggattatatatatagacttacagtttaacaagataatatcgcatgtgtttcatatggagataagcatcaaagtatataattatttaggacattataatatgacaaataattttcttataaagaaaattttattcaaaatgcattaaggtatattgtcaaatatcgtcgtagcgttagcatggatatattaattactagtatataattaatcaatctccttttattacatatatgtatcccataatcattgcaatacatatatacgtgccgcgtaccattctcttcttcatccttaaaaatatataagtatatttctagatacttaaaaaaagtatttctaactagctagcagctgagtgatgtttatacgcaatgcaacaagaaaatattatatactccctatgtattttaatgtacgacgcgccgttgaatttttaaacaacgtttaaccatttgtcttattcaaaatttttgtacaaatataaaaatatttatgtcattcttaaagaacatttaatgataaatcaggttataataaaataaatgataaattacataattttttaaataaaatgaatgatcaaacgataataaaaagtcaatgacgtcatacattataatacgttataatacggagggagtatgttttaggacagatgacctatgcaccctgtatattacgacgtgggtgaagtaggtggttccaccaaccgtggaaaacttgtcgtatttagcaccaatggcgtgctttttgctggtctggacgaaagaacactcaaggttgaagcactttaatttcacgccaccatcgttctgcatatatatatcccatgcattaattacaccagtgagtagctatagagcactgtagactgtgctgtacataccagctgacatcaccaactttaactagcatgcaccaaattaatttgtgtcatcttcttaaagaaaaaaaagagttttaagaaaattagctagctgttttaaatctagctagtgctctatctaactatcttaccactatgcaggtaagaggagtagaggactcctactgatcctgacagttgattatccatcatgtgcaatattgaataaaagaattatgtgatccttctattaatacatcacaggaaagtaataataataataataataataataataataataataataataataataataataataataataataataataataataataaatctaattagcgtactaagaattaggagattcataggggcctacatgtcaagaaacaactgaatatttatttttggtatttaattcaaacattcaattttctgtagaatatattcaaattaaataaaagtgaccaaataatttttgtacttctaatgaaaacagtatgtatgcaattcgttataaggtaggagagacactttacagtggagtatatgtagagccgaggaagatcgtcaccaaaaaattgagggtaaacctgcatatataaacaacaaattaacgtaacatacgttggtatgtacgtgacacatatggtatacatacatataaaagtgataactggccggtaacatatacacatacaaaaataaatatatagaaatggtaacgggcacgtacggcaattccgagagcaatttggttgtcgatgttgggtggatctttgcctggattggcgtaaattccctgactgttggactggcgatggcgaggagaattcagagggtcccaccccaactttccatataggaagccacgccgatgcaccgtgatatggcccattcactccatatgccgctgcaatctgcgcacacatcatactaatccatcatcttatatatgtttaatttgatgattaaattaatataatcactagtgctatactccattcgtcaaaaaaaaaaatcaaccttcctttaaaaaaaatcaacctagaagaagatttgaccttttctaatataataaatctggcctacctttatccaaattcatgatcttagaaggggtcggattgagttttcttttttctgatggagggaggatagtagtattattacttacttctagattataattattattgccagcttcatcatgaatactgtttggaggcacctaccgcttcgatgccatgcctgctccgcgaatttgaacgagttgtttcctcccaacaccaccatcttctcaactatcttgggacgatccacgcttggtttaaactgaacaatatatattcatcacatacatcagtactagtagctcttaaacagcaattagttctttgatcttaattctctccttaatttactactccctccgtgttttaataaatgacgtcgttgacttttcgaccaatatttgaccattcattttattcaaaatttttgtgtaaatatgaaaatatttatgtcatgtttaaaaacatttgatgataaatcaagtcacaataaaataaataataattatataaattttttgaataagacgaatggtcaaaatttggaaaaaaacagtcaatagcatcatacattaaaatacggaggtagtattattttctttctaacaattgcatacatacatgtataaatggttgcatttcttaaaaaactattataatattctatatgttttatatttaaaacattttgattttggtctttccatctctcgtctaaatttactaacatccatatatatttgagtacatatatgaaacatatacatgaatctattcagaatctaaatgttttgtagttataattataacgtgaaatagagaaagtagtaatcgacaatgaaaatgttcagacgtatgtacagcaccaggattttatgatctttgagcaatggattcttgaggcttggttgcttgtatatgtccacgcagtcaataatatcaccgcactcgctctgtcaattagaaaccaaagtgagacttaattagcacatgaaacttttttggggggtaaggccaatgatcactggaaaaattactgcctggaccaaaatgacctcagttgttcagctatatataaattcatgaattcaaccagatcgagtatatatgaagatgaggaatattagatttgagaattcatcttgtgattaacaaattaaacatatttatactatgatatatagctaatgcatggatatctgccaagtagtaaccttaccaatcctaaataaagaagattaacataatgtagaaattcttacctctatggtcttgataatgtcattgggatcgatatgtacaccatgaacagtagttgtcgttgaagccaacaatatgcttgctgcaaagaatgcaagaagagacctcattctctaggagtcgatcttcaggacagtcgaggatcataccgttagcaaacaagataatatggaggctttatatagaggtgtttgtggtgcatcgataagataattatgtattaatccattgctatcatttttacattactacacggaaataaggaaaggaggaataatgcttccttgtattctgtaaaattcatgattgattaattaataccataagtaagtctgctggtaaaattcaaatttcgaatgcaagtgtactaaccatattttggtggagtgtcacgccccgaactagtaccgaccggaactagcccgtgacgctccaatttaacctgttaatcgataccagtcccaggacacagtgctggtatcacaggaagacagattatcacagcaacagaggtctctttattatagagtagatgtacagtcatgttgggctgcggacagatcccgagctcacaactgcattacaaaaggaaaacggaagccgggacttggaccaaacaacacaggcgcgacttgggaaccaggccgaaaccctaaaactcatcgtagccggcttgctcctggaagaactcatcagcaggatccgcttcgtcttcttcagtgactgggggggattatttatatagagcaagggtgagtatggggagtactcagcaagccaagggaaataagtgtttaatgcaggcttcaaggaaaggccgttgtttttgcaattgattttagttgaactcttttctgaaaacaactaagtgagtgcttctcaaacgacacggttgagacagtgcgtctcgtccggtcggagtatgtgcaatgtatcagcctttagacttgattcaaggttggcacccggccaacagcttttcaaacggccacccgggcctacaactttcaaacggccacccgggcctagctgatcccatcagctgcagatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggggtacactttacccacacgacattactaacccggatcacccagcccatggggatcagccacgtcgggagacctccaagctttcatgacaaggcatttccaaagccgatacaggtttaccatatgccgacgagaggggtcccagaccaacaacaggttaggtcccagaccatactgtgccaggaagcccaggggtcctccccgacaccaccccggcgaatccacatgtctctcgacatcaaggctcccctgataagctagttactcagccaggggtgtcccattccacccatatggtcgtacttgtcttatgtttggatgaaattccaaggaatcggtccttaagtgcgagagcgggaaaaccgtacacccggtacgttccccggtccgcggttttggaaattcatttagttcacaagcaccgacccaggtgtcgggttttccaagtcttttgtaaaactcaagttttacccaagaagttgctcagattttaaatttgaaggcgcccttcggtactcgcacagattgcatgatttccgaggcgcaactgggtggttacaagggaacatggtataacaattaacaaaggaaggatcaaatgcaacaaactaggtagatccgccaatctgccttgcagacgggacaacagattaagtgcggcccaagggaaaaggagcggaccagccgagctaaatgggccggccggcccaaggtggcccaagtgcgcgcgcacgggaggggaagagagagagggccggcggaccgggctcaccgtgcgcggtcccgggtaggacccgcttgtcagcggctcggctcaccgtgcggagggagcacgcggcgcacgcgcgcgggcgggggagggacgcggtgcacgcgcgcggtctgcggaggaacggatgcggcgggcccacgcgcagcctcacggttcgcggtggaacgcgcgcacgggaggggctgaccggngtcggcccgtcccaacctcggctgagctggcgccgacgtggcgcctacgtggctgccacgcgggccgcgggaaggtagacgacgacgccgtccgggacggcggacaacagcggcgagcggcggagcgaaccacggcgataccggcgaaagcgagcacaccgggtggttgcacgagacaaggggagacgagccacggctcgggattcgccggaggaagcttgacggcggcgaatcgcggcggcggcaaccggcggggagggaagaggaaaccggcgacgaggtcacgaggggccgattcccggcggtgagagcatctacacggccaagggaatccgatgctagcgtcggattgggcggagctacgccgagcgaggctggcgacgagcgggtgctacggagctcgagcggcgatggcggcgagcacacggcgggcgacggcaacggtcggggcggcgccggctagctacggggaggctactcgtgctaccaccgaaaactaagggggggagatggagtgaggaggaagaacggagggaggcatccccgaggtgaggagaggcgctgtgacgagaggccgacggcgcgggagggatctctccggcctcgggccggggaagaggaggaagacgagcgcccggagtccccttccgcgtcctagtgcgcaccggctcctccggcacacacgcgacggctgcggtcggtgagagggacggcaatggcgcgggcgagaaacannnnnnnnnnnnnnnnnnnnnnnnnnnnnnnnnnnnnnnnnnnngtataactacannnngggggcgca

SEQ ID NO: 18471 - DNA, 757 bp, Oryza sativa
  unsure (1)..(757): unsure at all n locations
gaggtgataagaaattagtgggggagcgtcagaaaaagagtttgggggcggcggaatagaatagggaaggttgagtatagaataaggaaggaaacatcaaagagcaaaagcgacttagatgttaatgaggcgagagatctataacggtcgacatgcgcgtgaagggtaaaggtagaggtgcggaataagacttataaagcatggatagcaagggaggggcgtgcgtacaagagggagaatatgcaataaagaaataagatgatggaaaggaaagcgagtggtcgatggaatgcggccatcgtatcgatttaagatataaagtgggagatggccgtataggtattcggcccatcgaccccgggagaggcaaaatagacttttgcggaggaaaatgatttgaaaggatttggattcggaattgaactcgacgatagatcggggattgagatcttaagatggcacggacactagacgacaagcgaagaaacaaatttcgcaattagggtttttaagagataattttcccgctaggcgccacgacggaacgggcgctacatggagaaagtccatttttctccctcaactatagggcggttttgggtcgtgtccatcaatcgtacactccggtataaagacctcctcaacaaaagaaaaaagatcaatttaactccataagcgatgctaatggtgaggtttcctccgctgtagtgttgagattcnagtcttgtngngtgcaagcgaagtgcaaataaaccac

SEQ ID NO: 18472 - DNA, 814 bp, Oryza sativa
  unsure (1)..(814): unsure at all n locations
tgtgtgcnnattgatgatgactacccgngacgcctgcaggtcgactctagaggatcccctgattcatcttcatgttgcggtgttggaaatgccgctgagatgggtgtagcctttatagggacgggtgactttggtaagggcagagaaaatgaagctggggcttcttgaggctgttctgatgaggagcaaggtatggatggtgtggcataaactaacagtggatcagttgattgagtttccacatcatatcccaaaatagtaggaaactttggtgctaatgagcgcaatggctccaagtctaagggtagtttgtcactctctgcttcatcttccgagttctccatggtgaactcttggagaaattctggcagtagcaaaagcagaagtcattaaatagtctgaacataatacttgtatgatttcagcatgatgaatgatgtctcagaatttgatatgctaagaataagtgcgcaagatgaatataaaaaaaagcattgttcagtgcaatacaacgtagaccgaagaaatcgaataaaaagaaatagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18473 - DNA, 4891 bp, Oryza sativa
  unsure (1)..(4891): unsure at all n locations
agagcccttgatttgaatgcgctcgactccaaccnnagtctgaggaaggttgtgccctaatttaacacatgtgctggaatttacagtttaggtggaaatcgatactcgaatcctagttgcatattaatttgcatattactcgatacccaagtacccagtaaccctgactgcaaactaaactaatttggataagtctagttttagccttttaggcaccatcagaatggtcctggtggagatgcgctcgtagcgcagtggcaggggtcactggcacgcaccccgtcggcccgggttcgacccttgtcgagcacgctcaccaagggaaatatttacctcttccttcttaaaatcattgacaccaagttcttccttggtgtctaacttttcttttttagaatggtcctggtggttcatgaagtctttcctaaaaatccccataacttgaaaagtttttaacgcttcaacggaggagatattctgttattcctaattgcttttggggtgctctatatttaaggactatggctgttcactcattactaatagaagttacaattctctctcatgatatccaacaaattatttattgtcatgcagtagtttcttaaattgcagtagtcccaaatcccgagtgtgtagccgctaatgcatatagcacggtgaggtgttttattaaatttgatttgctaccagctttgttatgtaagaaaatgatagtgcagtgtattctggcatgttgcaaggagccaaggatgttttcccggtgacgtactgatatgtgggaaaagaagtactagaatagaaagatcatcagtctgcaaattaaacgacttgaggaaaaaaaaggaattgcctattttacatctagtatgctgctaggacctttgtcctgggtttctgatatgttnnnnnnnnnnnnnnnnnnnntgcttccctttatgcacaagaaattattttgtgtactctgttctttggacaatggataattaagccatgtgttctttgtcaagatccactattcaattgcagaaccgtggtgattgttactcacagaaatgttactgacaattttgttttcttcccctcttcaggaggagaagaggaaggcaatggcaaacgagttcgtggcgaagctgactgatgtttgctgggacaaatgcatcactgggagcattggaagcagcttcagcaacagcgaagcctcgtgtctgtccaactgcgcgaaacgctttttcgaactgaagatgctcatcgtgcaacgagttagcagccctaggtgaaaattcgcataggtcttttctgcgtcgagaatgtagaatctataatagttgatgctagaaactagagaggcatcacttgctttttgctgcattttatcagttttggtgtttttcctgctatacgttctcagtgaaacgattgcaagttttgctcttgcaaggagattaaaagcgctactgtactttgactacttttgacctgaaaagaatcagagacaagctcatagcctggagcagaaaatgtgttactggggtgtactgtcttgggagagaatgaggtgtgtgttgaagtgaaatgagttcaaccagctgatgcaataatgatcagaaattcaacacctccagtgttctgccatgaaagactcaagactgaactataccactgttcttttttactcagataaactacacatcaccgccgttctagttcgtgtttaagtagccacaattaattagttatcgtatattccagaggcacgtatctcgagattatccaacggtggatggtgtacgccagcgcttagtggcacactgacacgactgcatatccacatatacatatatacatttggcgatttcatctaggggtctccgatagtggaactgcctgtgccccttcaagctcccctagctactctcacgcattccccagcaaaggcgacatcctcaaggtacacactcctcatccagtgcttcttgatcagctttctctccattgttttttttccctctagaatcctaactaattttctgcaagtcctctagctagttcctgaccatctttttgtagcaaattcgtgtgatttgttagtgttcttatttgtgtgcactgtgtaaatgtctgcattgagtttaactatgggtttgttgaacaaatggatattgtatttgggttgcctgaatgaccacctcgaagttgcaatgcattttgctgccatctttttaatttggtgcctgcattttcggttaatttttaagggggagtaggtaggactttgaaatgttaatgcttttgtgggaccaattaactccaatcagaatatccatgattcatatgccatagaaacgtcacattgacacatttgtgtatctttagtgagccagcagtactcagccaacaggccaaagtatgcagactgttctgtttctgattgttcagaagttgcacttttctgattttgcagatctatttctttttattcgatttcttcggtctacgttgtattgcactgaacaatgcttttttttatattcatcttgcgcacttattcttagcatatcaaattctgagacatcattcatcatgctgaaatcatacaagtattatgttcagactatttaatgacttctgcttttgctactgccagaatttctccaagagttcaccatggagaactcggaagatgaagcagagagtgacaaactacccttagacttggagccattgcgctcattagcaccaaagtttcctactattttgggatatgatgtggaaactcaatcaactgatccactgttagtttatgccacaccatccataccttgctcctcatcagaacagcctcaagaagccccagcttcattttctctgcccttaccaaagtcacccgtccctataaaggctacacccatctcagcggcatttccaacaccgcaacatgaagatgaatcatcagatcaagattacaagcccttttgcaagaataaaaaaccagcgatgccgaagagagccaagaggccccagcaagctgagaaatccaatgatgctaacatcaagcgcagatcaataaggaggaacctggacaacgagttcaacttgtgctcatcctcatcagacaacccaaaggaatcggtggaaggaatcctgatgatgtttgattcacttcggcgccgtgtactgcaattggatgaaaaagaggatgcaagcaggcgggctgacctgaaagctggcactctcatgatgcagaacaacctcagaatcaacaatcataagatgatagggcatgtgcctggtgttgaagtcggtgacattttcttctttaggattgagatgtgcattgttggtttacatgcaccagccatgggtggcattgattacatctcttctaagaacaaagatgagactctggctgtctgcatcatttcatctggaggctatgagaatgacgatgatgacactgacattttggtgtacacaggacagggaggcaacagtcgtcacaaggagaagcacgatcagaagcttgagagaggtaaccttgctctcatgaacagcaagagcaagaagaatcagatcagggttgtgcgcagcgcacaagaccccttctgtaactcaggcaaaatatatatttatgatgggctttatcgtatcgaagacacttggacagacacggcaaagaacggatttaatgttttcaagtacaagctgagaagggacccaggacagcctgatggaatttcactttggaagatgactgagaagtggaaagcaaatcctgccacaagagaaaaggctatattgttggatttatcatcaaaggttgaacacctacctgtgtgccttgttaatgatgttgatgatgaaaaagggccaagtcacttcaattatgttgctggagtgaagtatttgagacctcttaggaagacaaaaccattacaatgttgcaaatgtcctagtgtctgcttgcctggtgaccctaattgttcgtgtgcgcaacagaatggtggtgatcttccttacagtgcaacgggattgctggcaaagcacactccgatggtttatgagtgctcctctaactgtcagtgttctcataattgtcgaaacaggatcacacagaagggtataaaactgaactttgaggttttctggactggagaccgtggctggggtctgcggtcgtgggatcctatccgtgctggcacattcatttgtgagtacgccggtgaagtcattgatgaaactaagatggacatagatgttgaggaagacaaatatacctttcgcgcttcatgtcccggcaataaggctttaagctggaatttgggagaagaattacttgaagaaaaaagtacggctgtgataaccaagaactttaagaaactaccaatcatcataagagcaaacaatgaagggaatgtggctcgttttctgaaccatagctgttctccaaatctcctttggcaagctgtacagtatgaccatggcgatgacagctacccacatatcatgttttttgcaatggaacatatccctcccatgactgaactgacttatgattatggtacaagaggtgctccccctggctttgagggaaaacccttcaaagcttgcaaactcaaatcatgcctctgtggctctaagcattgtcgaggtttgttctgataaaagatatggaggctggtgtactaaagcaggtaaaacttgtttaacaatcgttccaatttataatttttaaaacaaaatctgcttcttcatgggaaatgcattcttccaacctatttatgcaactgaataatctcttttaaaagtagctgattcatcannnnnnnnnnnnnnnnnnnnnnnnnnnnnnnnnnnnnnnnnnnnnnnnnntntataannnnngncacac

SEQ ID NO: 18474 - DNA, 4584 bp, Oryza sativa
  unsure (1)..(4584): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcatgcatgtaagacaacatttaaatgtccattttaatcttcaattttctatcaaataaagaaaagaaaaataagaagaagcaatcataaaacaaagaaaaatgtcaatttttttagctatcaatgctacatatttttgccaatggtcaaaaccagacatttaaatattgaatttgaatgatgtggcatatacacatggcatgtttagaggatctaaggactatattaaatcacacaatgaacttaaggtacttgtttggacaatacgaaatgtcaggaactaaattgatccttacgcgaaagttcaaggatcattttaggtattcaccctaataaaaaatattaattataaaattttttaaataagacgaatggttaaacattagatatgaacggtgtaaaagcacacttatttttatggctacgcagtgagagcgacgagggatggatgttggccgctggccggccacgcaggaggggacaccaccattgcacttgcaacgatcgatgcaattgactgcttggtttgcctcctctccggtctccgctgccgtcctcatcaatgtcttctcacttgttgtttgtttggacccagcatgccttacctctacagtgcatgtgattcctcacagcccacctgacctgacctaccttccgcccccgcgcgcgcgcacacacaaatgcttacatcatcattgcgtcatgctcatgtcataaatgaacattgttacacatcgctgcaacatctttagaaaaatagaaggcagaactgtgttgttcatgctaaacacatcactgtcgggtcagctggatcaacagcaacccttgcttacacaacggagacaggaaggatgcaagcccaagagaaaacaggcaccgactgtgtttgccagacagataaacagagtcagcttgcgcacacaaccactgatcacactgtgttggcaggatgaaacagtacaccactgcttcagataatgacagttttaacctactcacttgacctactacatataacaatgtacaagatctcaacaccatgcgtttgcaggctcaggcatgccatcacggtgatatggttacttactttgccgccttcagtacagcaataccagtaaggaacacgccctagatatttcactaccaaagaatttctacacctcaactgttaggggcacaaaagagagctatgctcgccgggcatggacgtggagctcattcgttagcaaactgcagctgcgacaagccactgcgtacttctccgtgtcgccaactatatatccgaatctgcctaaacctagaacgaatgcaaagagcaaaaaatattagtactgataaactgatcaatgataaatctaatcaacgagtgaattagaaatgctggaacatttaaacacaacaagaaaatcagattcaaatccaggctgggggtttattgatttattttactactagctatgtggaattacaagacaaaacagtcttgtttgaccttatccatttcttttgccttcagagacactactggttgttcctcacaagaaacaaaagaacaaatggcacctttagaaccaatcaacatcattttaaattgcaaaaggtacaaaaaggtggtttgtgtggctttggggaggtcaagctacaataattccataacaagtccacatggttgttttcaggggtggcagaaaataagtccgggaataagagacactggcaaagagttattgtgcaaggttacaagaacaagtcaaagtgtctcacatggctggtgaaattgaaaacaacaggaaataaaaggatgctcagagacgtacataatgcctactactacgtgtaatgaaatgtagttgatatcacctagatataaatcaggaaataagttatatatatgcactatcgccaatgtacccttgttggaaaagttattaaatcagacactcgcctcaacaaattaatatgggaacctgaagtaaggatatcatataacatgtccatatatataccatcccagattacctatttcacagtaacttctttgtgagctttaaatgatagaatcacgttccacgcaagggctacaaaattagcagcaagaacctggaaaaattaacagtaaggtgagaacagcattcagtcatgctaaagcagacagaaagaagcaaattcagctccagagtacagtattgcactctaaaatattttatgaaatgaaaatgtgaaagatttcaaagacctgaaatttttgtgggacaaagtaaaaattcaagaactgaaagggtatccacaattgccaattcgcaatcactgatgataaccactcctgtaaaattacaattgaaaattagctagcagtaaatgagtgcacatacatattatcagggagcagtggggatttatctgcagtactgctgatacagtagcagatactgacgtatggacccggaccccccacaacacatatgtcagcacttgctactgcatcagcagtactgcagaggatctgcgatggaaatgagagaatcaatcagaagaggttcatgtcacctgcttgagctttggaactacaagagaaggctttccctccaaggtgacgagtaaactcataaacactccaatgaaaatgggagagaaaatgaactgaaaggaggagataaaaaaaatgtcaaaaaataaatacataaatgcagaaacaagctagaacagaacaagcagcaacactctctctctgggggcagaagggaaagaggaaaaggacatgcacatacctgatcaagtaagaggcgagcaattgcacctgatgcaccattgatcgtcactaatttactcaagtacaagtacctgcatgtggcaacgagtaatgaaacaaacagcactgggcagagaacacatgctatcctaaacctcaataaacattggttgcgattaccagacatgcaatgttggccccaccaggacaagtcccaaaaatgtgaatacaaacgttctcttcaaatctagctttggcactttatcaattgcaagctggagcagtagcaaacaacaatggtaacagtaaatatcttgtaagaaaccgtaacaagataccacaataacaagaacagatgaaatatcaaatattttgcccaatccatggatgcaacccagtaggaatatacattgttttttaataatggaataggacactgttgctggagtaaaatccgttgaggaatcatatgagttacggattagcataggctaaagactgacacagttgagtaaagacaatatattcagattatggttgacgcaagattggataaaaagatatggacctgaaatttgataagaccataatagcctagccagttaagaatttcacatcatgtcatatttagaaaacaaggaaactaaaagagtgcagctaaggcagaaaagaaccataactcggtaaattgatttccaagtggtattagcaatggataacatttcaatgttgttttgaaggaaaattggtatgatttgaccatttgatgctaatacccatctaagcacgcctggcaatgtgctattgcagagtgacaggaagccctctacaagaagagagggagactactggttcattgttcgtcaaccaattaagtagtactaagtaatccactagggttgcaatggatggatgtgaaaatgcgggaagtagaaaacaactgcaagtcacttggcagatgaggtctccggtcagggttaggacggcagaggtaacagccttagtggtgatgggatgcttatcaagagccagcaggtacctgcaaatcatggcgcatttcagtaattttgcatttagatatgagtatggcaaaaagcgaggcaaatgaacatgggcagtgcttggccgcaggaggcaccaggaatcaggaagaggcggaattggacttaccaggctaacaggagacgccaatccattgctccttttgctccaccaccaccagctcctcctccggtggtgactccggcggcggaggcggaatcgcagcaggaggcggcgtggagcttcgagaggcggacgcccttgcgcgggtggacgactgcgattgtcgcggggagcgaggcgaggcgggaaggaagggtgaggcggcgggagtggaggaacggcggcgcggtaggcctcggagtcggaggggtggagcggtgcacgaggaggagcgggagggtggaggccatcgccatgggtggtgcttgcgctgatgctgcaaataactgcaatggtgtgagaaggagcttgggttttgggtcgcactggactagggttctagtagttgcaattttggnnnnnnnnnnnnnnnnnnnnnnnnnnnnnnnnnnnnnnnnnnnnagatattcaatgctcgg

SEQ ID NO: 18475 - DNA, 747 bp, Oryza sativa
caatcgaggaggccgccgcccacacggggtcgacgaccaccgttctcgttccgggcagctcggcttcgatcatgtgctgctgctgctgcttggcttcctcgccggaggcatcgtcgtctgtgtccctgcctagagggctgtacaccgtgtacgctccggcgacgacgggcgcgacgactccgaggacaaagaagaaattgtcggcgaattcggatcgcgatctgctgcggtaagcccagtagaggttgcaaaccacgtactgagaaatgcaagtgacatggaggagagccaccacgacggacatgtgcgcccgttcgccgggacggcggtcgccattcttgcagtacaccttctgtagctccgcggcgtcctccggccgccatcgcagagaagaacgaggtggtggatcaggctgggatgctggtatatgctcatgagcgtgaagagcgcgttaaggatctggttgtcgatctctatccagtgatgcctcaatggcttggaagggaaggccctgttcagcaatcctagcaggagcaggatcaacatgccaccagctgcagcgacgcagagcagccatgccaggagagcaatgttcagagggtgcttgagccagttcttgcagaagctgaacaccgagctccagttgattcttctgacgaagtgaacctcgacatggaggtaccggcgggggatcctctagagtcgacctgcaggcagacaaggatagtcaaatactaatggcgcgcg

SEQ ID NO: 18476 - DNA, 782 bp, Oryza sativa
  unsure (1)..(782): unsure at all n locations
cgtgtcanataggatactacttcttgtctgcctgcacgncgactctagaggatccccgatatggtgcttgatctggtctgttcgttatcgagtgaagaaaagttcgccactatattggacagcgatgaccaacaaaaacaacttatggtgggtagcaatgctcgcaggttggctgtgcacggtaggagtgttgaaaagcacaaccaccctcagctggttaatgtgggtttggagaaagtgaggtccttcaatgccactcagtgcggcgatattaatgtggtaacatcatactttcgagttctacgcgttttaactttggaggattgtagtgttactggggaagcttgtggaaaacatagattagagcatgtagggaatttacgccacctgagatatctggggatttggaatacacgtattgatgagttccccaaggaagtaggagatctcaagtttctacaaacgctgaatttgtcaggtactggaatacaacagctcccggaggctgtgggccttttgaaacaactgttgtgcctacgtatcaatgacagtatagcagttccagctggtttgatcgggaatcttacttcattgcaagagctgaagatatggccggttgatgatgtctcaacaaggcagtttgtgaaggagctgggcaagctgaaggagctaaggattctccggtgtaccattcatattagcgatgagggcatggagagagatttgntagaatcgctagcaaatctgcacaagatccgcactttgtgtattttgggctcaga

SEQ ID NO: 18477 - DNA, 1217 bp, Oryza sativa
  unsure (1)..(1217): unsure at all n locations
gatggnccnattgaatgactagataaactcagtcnnnnnnnnnnnnnnnnnnnnnnnnnnnnnnnnnnttcgctccagagggtcactgcaacgatccaatgtgaggatgctactgctgctgcggaggtggaggaagcgaagacagcattggcgcatgcagctgacctccatcccaaccgtcccacccttacaactcaaatggtgaacaagcataagatgctctcatccgaccgagagctacgagtgtgaagcagaggagatgatggagaactggcggagagaatctaggagcaggagagcaaggataccagctctgctttcccctgatggttaccctgcaaaagcaagcatacatgttgcattgcttctgtatcaattctgtgagacaatttagttgattctctgaacagagtcagctaagtgccaaatgcccggttccagcctgtgtttgatcgattgacgattggttcggatatctccttcacttttcctgaactccatccacgattcaagatgtcaaatgcatataatcattaattagcagctagcattacgtggacaatgtgcttcaagatgcatttcgttttcgcgtttcttgtatatttttgtcagcgggctatctttgtcaaaacgttatgcagttactccaccggtctgtgttatgaacagcggtgtgactgtacttgttcatcccttcctgtttgtgtttctgtcaggatatcgaacaagttctgaatcacattggtactgaaagagactagacttaggcccccagctgaatagtagacaagaccatatatggttcgcatgtattaacttttaattacttcttctaatagaatgacgtacaatcgaattgccagtttgatgaaaaaaatatggtttagaagtgaggttgattgtccttgttaattaggtttactgatccactgtctatcggtagtccacttccaagtaactgaatcatattgtgtactcaggctaatggtcccaatctcgtccggagtctgaatatttcatgaaaatctcctgcaacattgacagtgaaacctgaaatcagttatgtatactgaacgtatgcctatgggcatgtctgtaaaccgtaaccgccacctgaagaaatcaaattcagaagacatacattattagtcattcgaattcagaaggcagattatagtagtatgacgggacgaggtgncctgacgnncaatttcatt

SEQ ID NO: 18478 - DNA, 2090 bp, Oryza sativa
  unsure (1)..(2090): unsure at all n locations
agaatcgcaacacggggaggtcaaggacaagtttttcgagaaaccaacatgcaaacttctcctctcctcgacccgagatttccacccctctgctggttgcttcctcgcatactgcaaagttccggtaataagtcttcttcttcttcttcttcatcatcctcttcctccaccttggggttccaatgtaccatagctttgacaagaggcgtttcgctgctgactcgccgagttgttgattgggatctttcctgtgttcttgaggaaatgaggagggcaataggttcagttgcggtaaaattccaatattgggtagttccggtaattcccttgctccaccatgtgttgcagctgctgctttggctcgtcagattctctagtggctagtgccacccgactgaaatctcatgaattcactgccgaatttacaagttttggccataagttcgcagttgtttccatggctgcaagatcgggttcagtagcactggcgaaaggggcgaaagactcaaaatggaggtaaaatctgtttctttgatctgtataagtttgtgtccggtttggagtccataaagtgagccctcaggttgatatcagattaacatagtacagatgtacggcaaattgtttacttacaacttttgtggtccataaacgtgctttctttattgtacagctgatcactaaaatgagctgagttgtgtagtccctttttctttctttatcactattcacttgtgctttttttaatatatatatagcagtcactcgcatgcattgatccatacaggctctctccccacagaaaaaaagttgagcacattatgtgctatcattgtacttgtgccgtgcttatgagaacatgttcaaaggaagagctcagcttgtgcctgtaaattcagtctggaagctgaaaacaagatggatgagcttctacgggtacagagggagcttctacgatttcagttactgctatccaagcatttccaccgatggagaaatattgacatctaacttgtttcaggcacagtaatagctttgacaggtcaggtaaaatagccagattctagagggagtgaagactgtgcaacgaatgaggtgaaacttaaaagtgagagtgacagctaaagataccaagattgctctccactttccctacaaaacttctctcatggtggtactccaaagcaaagaatcctagaaaaaaagggcgcaagcacagcactgcagcttcctatctcctttatttggtcttccattgcttcttgttgctgaggttgccttcctattgcccccttcccttttccactcttctactaacacttgcttcaggctactgagggctttggcttctcggtgttgtcgctacaggtgagcttggcattctgtgcatttttgcgttctactgctaatctggtcttgtgctaagctccactattagcctcttgtgtggtcataggtggctcctaatttagcttcttgtgtgaatctgatgtccaatctttttctaaatgatctgtaaattcgctttgattttggtctgattagattattttgtttatttctttgttactttcctctcttttatgggttgatagtatacaattatagcccaaaaatactgttgaattcagagatcttcattgtgataactgactgatcatttaaagagatggtgcttttccacctacctgttgaatgttaaaccattacagatgattttttttttgaacatgcaatttctatagatctctaactaaggaagctggaatgtcaccttatttgagcagtttgattgtattgcacattattaaacttgtgtttcaagtataaatcttttttttttcgccgggccggcgtaagatacgcggccgaagtttattaagattgggaagaggttcaaactagtacaacaattacagctgccatggaggctagagctgtacggccgctattgttcaagtataaatctttacttgtttgaatattcaccataatgttatagtgatgaattgcttctctctttcctatttccaggggggatacaacagagtcgacgtgcgggcaaaaagattagtattcaaangcacaca

SEQ ID NO: 18479 - DNA, 2076 bp, Oryza sativa
  unsure (1)..(2076): unsure at all n locations
aagaaattgattgctgacanancactcgnaccccattactgactgttcgattgacaaggttgagactgttgctgtcgatgagcacttggataaaacaactaccagtaatgaagtatatgtcagggaaagaaattttgagggtgatatacatgacactcactgggaagagaaaaatggcacctacatgacagttgataccgctctaaatgacgaaatacatacgaaggatggaacttctgattatgatttgcaggatacccaccgtgaaggaaaaggtatcacatcagtggaaactgatactgttccttgtgtggcgccttcaagttttgcctacagtggtgtaactgtggaaactgaagacgttggggagaacagcaagaagaatgatgagctgcaagaacttggaagcatcaatcctgaaagtgataacaataaagtacaatatcaatatcagttaggtgagtttatgagttcatgttgggaacctgttatgagacaggagccacaggatgcttgttctgattctgaatctgatcttactgagagttctcctgatgcatcaatgactgacattattccaatgcttgaagagttgcacccattaatagacttgcaaactggccacccttcattggtctccagagacaacttgaatacttcttcggatgatgatgaagatgatcttgaggaggaggatgctagcacagatgaaaatcaattggaagggaaaatagatgattttgctaactggaaggatgttattgatctaaattacttggatatggacaataatagcaagctggagggtatgatggatctgcaaagagcaaagaacattctgaaatttgaacttgacaggaggttaatggacttgcaagcagctgatgcagtacagaaaatggaggaggcatcacgcttccgtgtgcaggttccctccatttccactggaaggcagaacccatttgattcttcaaatggctcagatgaaataatagagttaccacatgttcctgattcagcaccgtcttgtctccttccacggaaaaatctatttgatctttgcagtcaaccaaaatatggcccacgatagtccattgcaagaaacttggactcctctttcgtacttttcagcaagacggcatagaaagcatggaaacttatatgttaggcactctactagcctgcatcacaatagcttcaaactggagaaagatgaaataagtgaaaatgatgcccataatagtcagtcagactgtgatgccaagcaagaagggaacaacagcaagttatttggttcactggaagcacatataggtgaagaaatcaaaatattaggcgcagcaatttcagatgtgggtgtattagaagtaaattctggaatggatagtggtaaccaaaatgctgatttcagtgatgatatcagtttatctcctatccagaagtctagacaaagcactttcgaagctaaggaagcagtacatgcaggtaaaactgttttttaaccctaagtaatgtattgcaatttgcctactggaaatgataactcaactgaagttgatgtcatgcaggtattgagcaattaacatcgtgctccccttacaaggtaaataattttgaggcacatattgttgaagcagactccattgatgaatttaactcattgtttaagtgccgtatggaggaagtactagtgcaatccatctcagagtccagtatcagtcaacccttgacagttaaacttgaagatgaattgagtgaaccattatcttcagactctgggaccgggacacatttcattgacgggagttcagttgaagattcggatccacaatttgcacagctcaaggatgaagcactggtatctgctacttctaacgcaacatgtcgtaatgagtcaattgaagagaaatcaagtgaagcattactggcaggaaacgaagattattcagaactgccaaatgaactgttaaaatcaggagatccacagtttgcagatagttctgagattcannnnnnnnnnnnnnnnnnnnnnnnnnnnnnnnnnnnnnnnnnttntctaatcaatccaaaggctct

SEQ ID NO: 18480 - DNA, 2509 bp, Oryza sativa
  unsure (1)..(2509): unsure at all n locations
ccgcctttgtatgcactncgactcgtacggtcactgaatcatcacaagggcctaaaacaaggccaaacagccaatttctcagagagatctgtaaagcatagatgtcctgttttagctctctgaacaggtttctgcccccctttgttccaacttactctatggcgtctggatttaactattcctcttcttaatacaaaatgtgcagcaatcatgctgtttttcctccaaaaacttttctcaggaagtccgcaatgtcagaaatatccaaggaacagtggatgtacatatggtttctgcttatttcttctcttttgtttctgcttatttgctttcggttttgggctaataggttagtagataggagagtagatgacattgatatgaaacaccagttgcagttgggtgtgatatccattcagtcaagccggtctttctttcgctgcctatggagtattaatttttcttgtctgccagacaggcattggcaacccctgatcatcactttgtttcagtaaataagatgattggatgtctgtttgcctgttggtaaaccgctggactggagttgcagcttctgcagtttgcttcttcaacagttatcctgtcagtaatcattgagtaatcaagtaatgctttcacagatttttttttaacacctcctcatgctcattatctgcttgctgttggtggtttcattaagaaaatcacagttccttgattaaaaaattcatagtcctttacattacatacatgatgcattgatgcttatgttgggtatactgatctgaatctgaggcgtgctttgttgggataattgaagatacgctactcccctagaaccattttcaggaaatcactcctttagcttgaccttgctaaaatgaattgtttgcatgatactaacaaaatagatgaatctttggtgtagaatcgcagtgatgaataaatctattttttttcatctgtttgtagagccatcttacagatgagagcgtggtattcttcgactgttattctgttaaacaaataaaaaaacttaagagtgaagtacatgggcacacctaaacttaagagtgaaataaaaaaacttacagaagacacacctacatctaggttcctgaactcgcaaaatacatttttaggtccctaaacttgtcatgtgtgtcacataagtcctaacggattcaaacccgctccatgcgctgacgtggcattgccacggtggcacctacatgtcgagcatatataaaaaataaaattaaaaaccatattttctcctcgtaggtaaacagaaaaaagaaaaaaaattctaatgtagagaggagaaaatatgtatttttaaaatttttttctatgtgactaacacgtgagtccgactaacacaaagatgctatcgtgacatgccacatcggcacgtggaacgggttagagctcgtttggaccttgatgatatctcaagacaagttcggggactcgaaaatgtattttagtttaggttagggaccgctcatgcatttcactcaaaagttaaatatgtaccgaacatagggtcaaacatttgacaactacccaacacacagaaatatcgttattttcaaaatcacttcaaagttgaccaagacaccttcagcagtacacgggcgccaccaagtttaagctctttcatgtcatatccatgtcttctagctttgaatgggcaatattcagagacacgatacgagccatccccctgatcaaccttgaagaccaatggacagtatttagggatatcataatccgagccatccctatgaacagccttgaagattaaaaacaaaggtgtattctccaccacagcaactacaaacctatccaggtcacatggcttggaaatgacaccatcaaagagccgaatcttttcaggaatttgaccgatataggaatataaagataagcttaagccattgtcatgcacttgtgatatgctaacttgtattggggcctccactgcttcgtggaaaagggctcgactaatgtcgaccgcatcacaatcaccttcaatccgttgcgtaaacactctatcgggaagcacgaattcgctgcagatgatggcaccatcgatgagctgaaaatcatcgtcttgtgtctctccgttcttgatcttcatgtcaaactcgatgagcacacgaacttggtttccaatgcctctcttggggcctgacattggtatcaatgaattatccgaatcaacgccattgtcttatcccatgatgaaagggtcatccctggtgcggttgaagatgtagttgcgtagcgggtccaaatgatcccggacagcaaagtattcatacaagtgaactgggccatcaacagcagcagtgatattggatagcttgagcgagaatatctgcatcatgaattgcacactgtgcgccntgcaagcccacatgtgtggccggcaattgggtgggtttgacagcattattgcctccatacgagctgaacagccagccatacacgtcagtggatg

SEQ ID NO: 18481 - DNA, 3123 bp, Oryza sativa
  unsure (1)..(3123): unsure at all n locations
cgcgcccttgatttgcaatccnaattgnagaannnnnnnnnnnnnnnnnnnnnnnnnnnnnnnnnnnnnnnnnncgtcagtggatgacagtaagttagattgttaaccccaatattgaaatgagcaggaaagaaacaaatagatacaaataaggtttaaaacagcaaactccgcactatcatggacccaaagcaatatatacaatatactagatggtgcctttaagagttttttgaagtagtacttaaggaatatctagtgttacttagaactagattatgttatgaaaggtctaaatttgacatcaagctagacagatatgttatgaaaaaaaagggtttaatttgacatcagttccatagtactgagcatacacaggaacaaattagatttttttttattattttttttccgtgctgaccaaagacccctcagtccatatttccttacgattgagaatatgtacaaatttacaagtttagaattctgacaagatgatatcgaaactgaatggagtatgccggagcgccctcccaaaaccaaaataaaagggattgcatctctattcttactctcctaagtttttaaagactcctgcttccttccagattacgacctcttctttgattgcacccaagagggaacaaattaggtgatacagcaatatataaaattgaagttaaaagagcgtgaattgaatagcatcgatctgaggtgctaacaagtgaagctaaattgaaagggaactaattaagggcagatgagaggattgtagatgatgcaaagttaaattgaaaaggaagtaattaaggagatgaggattgtaggtgatgcatggtggagaggggaaaaagctagggtttgcaagaagttaaaacttactctctcgggtatcgtcgaccttgtaaaacatgtgccaaaaatcgtcgccgctgtagatcgatccatcgctatgtttgctgcactcgaggatgaacgcgcgattcaccccgtcctggctacctgctgctcgcctcccattcttctccgcttccgcctccgcctccaccagctcaagctcggactctgccgccgcttcgccatgaaatcccctcgcgattcaacccggcctcagcctctctcccttcgatctctctcgttagcttcatcttctccgtcctccacccttgggttttattttgatttttgcggcaacaaatccgaaaccgattcatattagtagtagctttgaaaaaactattatcctctcaaatagcagtagaaaatagagagaataggatatgggctgctttctgggcctggatatgggccgtacttccattttccgttgaggcccatctagacccataaaagatgaagtttcttccctaacctccggcccccgctcccttttcttgtcttctctctttctgtagtctgtatatgtatttttgtgttgatgcaaggtaatagtttattgttttaagttaaacacacaaatacgattttcttattgtttcccacgaagaattgcatatttgtgtagcaccatatctaatttgtatgaacatacaagaatagaaacttgctttcttacaaataacacagtgacgttctttgactgctaaacttacacaacaaataaataagcttaaatatgtgctgaacataggaccaaacatttgccaacaagacaatacacagaagcatcgttattttctgcttagcatagactatgtatcccttgggctgttcaaaatcactccaaagttgaccaagacagcttcaccagtatattggtgcaaccaagtttgagctcttgcatgtcatactcatatccatgtgttctagctttgaacgcacaacatccaggaacatgatctgagccatctctcttgtcaatcttgaagattaaaatcaagggagtattcaccaccacagcaactacaaacctattcagatcacatggcttggaaatgaatccatcgaagagctgaattttttcagggattctactggtataagaatataaagataagctgaagccattgccatgcacttgtgatatgctaacttgtactgtggcctccaccgtactgtggagaagtgcaagacttatgtccaccgcaccacaatcaccctcaatccgttgcgtaaacactctattgggaagcacgaattcgctgcagatgatagcaccatctatgagctgaaaatcatcatctcgtgtctctccattcttgatcttcatgtcaaactcaatgagcacacgagcttggtttccaatgcctctcttggggccaggcattggtatcaaggaattatctgaatcaacaccattgtcttgccccatgatgaaaggatcatctctggtgcggttgaagatgtagttgcgtagcgggtccaaatgatcccgtactgcaaagtatccatacaagtgaactgggccatcaacagtagcagtgatattggataacttgagcgagaatatctgcatcatgaattgttcttcgtgaatattgcaagcccacatgtgtggtcggcaattggttggatttgacagcatcattgcctccttgagagctgaaacgcagtatgtaggagcattttacatcagcggataaagttaaattttaaacccaaattgaaataaaggagaaaacaaacaaatcaagaggacggacagaatattgatacaattaaggttttaaatagcaaacttggcgctgccatggatccaaactcccaaagcgagctatacaatatcgtataaggtggttttaattctattctaattaagaaaggcctaaatttgacatcaaagtagatagatgtgttatgaaaaaaaaagcttaatttgacatcagttccatggtattgagcatacacaggaacaaattaggtgacacatgaatatatagaatttgagtttaaacttaaaaagagcatgaacgagttcacaacatgaggtgcttccgagtgaaagtaatttgaagggcacttacttatttaggagatgagaggattgtnnatgatgcattgtggaaaggggaaaaagggtagggttgcaagaagtaaaacctactctctcggtatcggcgaccttgtaaacctgtgccaaaaatcgtcgccctgtagatcgat

SEQ ID NO: 18482 - DNA, 5245 bp, Oryza sativa
  unsure (1)..(5245): unsure at all n locations
acaaggcaaggggtaatcattcttgctttctccccagattggaaatcacatgaaaccaaatagcctttccttgtcatatttcgaccaaccaaattggttttactatgaggctcttcggcttgccagtgttcctttgaatccccttctagatttctgcggatttgcaaccttaaactgcttgctcttgacaatgttaggttgcaacatttagagcagttaatatcgaaatgccatgttctagagtggttaagcatccaatcatgtaaccagctgcataatttacatgtgtcagaaccattatgccgtctgcaatatttgtcaattcagggttgtcatttacaaagaatggagttacatgctccgaatctcacaacatttgagtacgacggttccctggcattggtaacgctcaatgaatgctccaatatcaaagcatcaaccatcagactttttgatgagaaaaccctccaaaatatattaactggaattccaagtgtattacctcatgttgaaacgttatatgttgaagttcatgtcaaaactcaggtctgattattcttgtactctctatatacatttaattctattttattttctgtttcccatcttgttgtttgaacctatgtgtggcctggtcaccctccagatgtctggatttacccaatcacctctcaagttcactcaattgaagtgtctaactttggaaataacttttgagagaggttcattcgatagaaattcagtcttccagttgactaatcttttcgtagcagctccatttttggaggatctttatttggatgtaagtagctatatcatttgtacttcactacttttattgccttcttccctagccagttacagttcgccttttgtattctcattgaccgattacctcttttttcctatttaatgttatttcgttggtttggaaacccaatcagaataacctgctaagccagtactgtcaatctaattaggaattacctgcttgtccaatgtgccctatgcatgattcatgaactcataagtcccagaaactggaacattcgctgcagactattgatcctttttaacgatcatcagaccatcgaacatagctttggcaaagtaatattgttcggcccggcgaaagtagtattgttcagcattagttggcaactgcatttttttccatttgacagtggactttgtaaattttaatcataattatttgggacatctgtagaagcttttgctatatcgatgtcactgtttaccctgagcatcacatcaccatatttatgcactgtacaagataccaaatagtatgaatcaaggtgataatatgtttggaaaccgattagccatgtgtttccttgattgaatatatttgtatccaaacagagcaaaagcttctttttttctaacaaaatctcagaattccatcccctgcatttgttttgacaagatatatgttcaggctatccttctcttcctcgatcatgaatctttgatcttcttttccctaattattacgtgttagcttgctccttgttagtgatgccataatttcttgcagatgtattgtagcttgaacaggtgccctttggatttggatgacatcgtggatcagcctcactatcatctcaagatggtgtgcatatttggattttgtggcaacacaggccaggttgagctagcaaaatgcattctcagaaatgcgttaatattggagcaaatgatcatcgacccaaaagggagatatcggttggatggatattttgggcgccaggaggcagatgagaagcttgttccagaagatatagatggtgtactcacaattctgtaacttatactccgtacagtagcaaactacagtcacaagttgaagtgttgttccttcaaggcactagtaactaggagtaagttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggccgaagtttgtgctaaacattaaactacttgagaaagtatgcactattcatatgttacaatgagttttaatctccaacccatggaccttttttttttaagcttcaattcaaaggatgccaaaggggtgggagttttaatctccgtcccccaagggactattttttctttccccaagatcgagcttttttttaatgtagttttgtgcaaacacatttggatagttttgaactactagtatatcacatagtaggaaataattgattactatggaagtattcttcacagacaaaaagcttcagttttcacacacatgtacacacacatggattgtttagactagcaatgcatataagaaaaataattacttcctcgaatatgcggatatcttaagttggatatagtagaatactagaatagataaacatctcatcttacgcagataagtgcttctggcagagaagtgcaagataacaaccacattcagacaggatcatataaaaattagagtaaagtccatcaccggtccctaaatttataccgttttgtcatcccgggccctaaactcgtaaatcgaccattcaggtcctcaaacttgttcgactgtgtcatcctagtccctaaacttgcagattactcgtttaggtcctccaacttgttcagttgtgtcaccccggtctctaaacaggacggtctaaaaactttatatcaaaaaataattcataactttttcatgtgaactctaatgaagacaaactttatatcaaaattgtagctctggatgcgacctacaactttgtagttgaaaagtttttgaattaaaactgttggtcccaaaatattgttgcatgtttatagattttgaaattttaattttaaaattacattttgggacaaaaaatgacttaaaataaaaaaaaattcaactataaagttgtagatcgcgtcgagggctataagtttgatataaagtttgtcttcattagaattcacatgaaaaagttatgaattatttttaaatataaagtctttagaccgtcctatttgacccagatgatatttaaatccaagtttagggactagggtgacataactgaacaaattggaggacctaaacgagtgacctgtaagtttagggatcgggatgacacagtcgaacaagtttgaggacttgaacggtcgatttgcgagtttagggaccgggatgacacaacggtaaagtttagagaccggtgatggactttactcaataattaggtacagtatgaggcaccttgagaaaaatcagtgctagaatggaacgttctctttcagatgattacaacctacggagtagcttgtacctaattccgtagtaaacccccataatatttgactctttcattcacattcatcatcgaacccacgctagccatttccttgatcaaattatcacacctactcctgcaggacatagtaaataaagtagcacgttgtcttaaaataatactactccaccttttaatctcataaatgaataaacggagaaatagaaaaaaaatcaggattctgatagaaatgcaagtgcaaagcaggtgattgaaaacacagaaaaagcatataaataaccgtttattggaccgctggaaaaatacagaaattgaataagagagatagacttaaaggaaaattttcaagagattattcatttcataggaatttcaaaggatatgataggatatgatttaatcttttgtttcaaaagcattcataggaaaattttctatatggttgaaatcctccaaagttcttatgtttttcatccaaatcaaaaggaccctaagcatttttagtatttaaaatttgtaacacaatatactttctttattttagaatataagtatttctactatttaaatttcatatacaatataagcatttccaggtactacttcagaattcagatacaccgaaagctaagtattttcagtcacttaggtgattaggaagggggctaagcaattcacaaaatcaaccaatgagacaactgagagggaatatttatcctttagcttactatttactaaataaactaaaaatatgtgtcctttgcagtaagtttaataatactactaccttcaataattgaaacatcatctaccaactcatattacatcaacaatacctaatccatccatctcccctcacatagtctattgaaagccagtcctgtggttggctacaaatctagtccgcttttcttttctcttctctcctctcttcttcacataagtacaaatttaatgtgccaacttttacatcccgctttcgtcactctgtccaatgcataaaaattcatgcattttcaaccaatcaaatgcttgggaggataatctaaataatttaatattttaccactactttaatggaaaggaaatcttcttacttaacctttgtaagatttgctaaacaacctaaaaatactcatattttaggacgtagggagtactattctctcttttttttaatgtatgatgtcgttgatttttgacatgatgtttgaccattcttattattaaaaaaattatgtaaatgtcatttattttgttatgatttttttgtcaccaaagaaatcttaacttatacttttacatatttacattaaaacttttaatatagtcaaacgttatacgaaaaatcaatggtggcatacataaaaaaaatagcactaactatcaatagaaaaaaagatagtgaaattatttaatagtaccagagtatgaacaggatatcgtgagatttatctttaaaagaaaaaaaaagaataccgtcagatgaccttttccgcgtgttgtgtctgtttgttgaagatgaattctaatagctcaagtggacgtccacccgtttattgcatgtcaactagatggttacgaaaaattttcaaaaaaattgacaacatagatcaatatgtaatatatcactccacaaacatgcaagttcaaattcaacttctataagtagtaacgggggatccttaaagtcgacctgcggncatacagaatgagtttgtatatcaatacgcg

SEQ ID NO: 18483 - DNA, 4291 bp, Oryza sativa
  unsure (1)..(4291): unsure at all n locations
ctacgccgcaaaaaagccccaaccaagccgtgcccggcgttccaacaggaccaaaggaacgtaacggtgttctcatcagccttgcccgaaaaagactaacctttccgccagagcaaaagtaagcggctcgcngcgaaccattccgccggcccggtgcccagacgtttaggcgatcgtgccgttagattaaggttcggtaaggttccccggccgtggacggtggacgtgaagaccaggttgctagcccacggtgatcaaactgcgggcgcggcagccgcaggcaaacaggggggtgcagggtcaaggtcgggcgggtngggggtgnntngtatnnnngncnnnnnnnggncncgccgccgctgatggttggatgggtagtacattaacggctacagcctagtatagctagtaacagctgtgcattgaacagagagatattacattacttattatacctgtgaattgaattaatttcataattagtgtccaattttgtggtgcatttcgagctgttggtgaggagattaatggattaccaccagtgtagcattttgcatgttgcagatgtaattggtgaaatactgatggttttctctgttttctgtttgttcaaatggagaatgaattaatcggatatttactcagtttcagatgtaactgatgaagttttggttacagataagtgtctgttattgtacaaaataagcgtaaatttgatcatatctttgatcttgctctaccaaaatggctcctcccctgcactaacattctaacaatgtactgtatagtaagtttcagttgctgttggtcggtgaccttgcctgtagttaatagtagtaagtcagtcaactcgtgtgcttgtgctgctagctttcgttttaacttttaactggtgtgctatcaactattcaacttgcctagtcgtccgtgtaccttcgctttcttcatttgtccattaattgacgctgtgcaatttgctgacgacaaaaacgaaatcgtccaacgaggttgctgagagttttctgcccccgtctcttttataatttattcaccaaacgtagcagcagactgaaaccttgcatgtttgattgtcctactccaaggttatgttttagctgttgtcattcatctcttttcaaaaattatctccgtggtagatacaatattttataggaaataaatcgtatcattgaacgctttttgaagatcgctggccatgtattagtagcataatactaatatgatattgagctgtcgtcaagacctagtttagttaattatgacaataggattaattaggatgcaaagtatagtggcggagcggctgtccataaccgtgtgctgggtaagcaggagagagaatgaaacttagggaaatgtaggtctgcatagctgtagctttgtgctttaggatatactaggctcttggatgtttcttccttttctcttctatctaattaaacggtatgatcttactcaaaccgcaagaaatatactccgtacgattcaaattacttacagttttagttttatcctaaattatacatttgtatctttgaccatcaatttcttaaaattcggacagttttaacaacacgtggatgctataatatgaaaatacttctcatgttgattctaagatgctaaaatacatgaagttttaagaattaatagtcaaagatacaaatatttaacttatgatataagttaaaactataaataatttaaacggagtatatactagtttagcaaagtactctatccgtcccataaaaaacgaatctaaaaccagatatgatatattctagatatgtccaaattcatagtcataggatgtgtcatatccggtattagcggtattaggttggttttttataggacagagtgagtatgtatcttagttcttaaggctcagttcatctggggccatcaataaaatcaagagttgaacgtttcaataactaatagcagcgcatacgtgttttcaccaattgtcgccatggttgctttcgcctgaactcagtcatcccctgattttgtctagacggcgacagcccaacttcagtttgtttgtgcaactagctgtgtgcatgtcaacatactaggaatttccagcggggtggttagcaatatagtaatacggcaaacctgcaggacctgaatgatgcatgcaagaaacacacatctagtaaaataatagcagccaacttttttttctatttttctttcttttctccgagttggaccgtacctcatgcaagctgcctactcccttcgtccaaacaaaaaaaggcaatctagtgctaagaatatccagattcgttgtactaggatatatcacatattatagtacgagggtgagttttttggggacgaaaggagtatgttttagtatagagtacgatagctgcatcagcaagtagaatacgccctcaaaaagagaaaaatgaaaagaacaagttgaatacgtcaagcaagtagtccaagactcaacaagctgttctccatagctaagtcagctgggtgaggatcatcttcatcttcacattcacataaacaaaaatacttctgacttggctgcccttgttcaggatattctcaaccctgaaaccaacctcactctgttttttctctatttttgggtttttcctcctgactcctaggcaaccttccattcactgtttatacaagtcagcaaccacacaatgctggctgtgctgggacctgngagctttaaattgtcccttttaggaagagacacaaagaaataagcaacatagaggggaaaaaaacagcatgcatgaaactagcatcaacaagcaagagagccattcaaacaattaactgtgctgccacaagcaggcttgctttgccaaatgaaagcattaggcttctaatacgttctaagagttagtaacaagagcatccgaaagctatatatattcctctccaactagaagttgcaactttgcctgccacttcaaaaggattacctactggctactgctactgtatgtacatgacaaaaggaacctggagatctcactagcaagcacagatcaatctcatcagttctttcttctcttagatgccctggttgactgcgaaggtcctgctgcagatggcacctcttgagcagcctcaactgcttcagctttagagcttctcaaagccctccttgtcatcctcgctgatgggcctgctctttcattttcttccaccagttcagatttgacacctctgcgtctagtcctcgaatgctggttggctgatgggacctgatcttcctcaggttcgttaacatcctcatcctcagcaccgtcatcttcaccctccaaccgaggccattcagtaccacaaccacaagctctcgaggcctacagacacaaacaaatttagaaagccactcctgttcatatgtgtaaagtggaattaaaaataggtgactacctttctctgcgaaaatttcttcttcaaacagtacccatgaatccttacattgcattcctcattaggacaacatgatgcctgttttaaatataagtaataaaaatacatggaatgacattagtgaagtatatgaccatgggtacaagataaatgcaaatgtagaatcgtaattcataatgacatatctgcacctttatacaagcttcattgcagacctcacatgatgggatatcattactacgtaaccaacttcggagatcaagaaatgatcttatgccaagaccaatctttcctgtgggagtgtatgacagccaacgatcctgtatgagttcattaagagttttctccttttgggacaatgagaagttggtaatggaagtaggcagacgggattgactgccctgtgaagcgtctgcaattacaacctgggagcagaacaccaaataattctttcatttgtcacactaccataaaagtttgcaacaataaaaatataaaacatttgcttaaacagaaacaaaagctctcatagtgattgggtattaatacgagatacctggttctcaatccgtgtgttaagagcatcgatatttgttatgctcccatcatttccagcttcatgaactattgcttccaactgcccatacaattacatgaatatagcgaatactagattgagctggattttttaaaaaaaagtgcaaaatgaatggataccaatcccttggtgaatgcaatctgtggcacaaaaaaccttgatccaagctttgacttttcattagccatgttattgaccacttcattatacaaacggccatcatactgggttatggctgctctt

SEQ ID NO: 18484 - DNA, 2167 bp, Oryza sativa
cgacttgcccctgcgcaggatcgagctcgctagtatctggaagagagggacggaatgggagggagatgaaggaatgaaggaaggaaccctagcaagagcagaaggaagtttggggatgaaatggaattgacgagggcattgagcgaggtgaggtgggggaaaatgtgttggcgattggcgggaagaggcgcgaggagacgcgggaagagaagaagagattggcagcgcagcgggccagcggagcaggacggcagaacaggacaggttggcgtgtgcgggccgaatacaaggcccatgtgatcgagcccacccattgccgttggtgagaattgagcccgacccaatcctacccgcccaagtatttcaagtgtagccgatgcatggtttaagccgaacgggaaaggacaaaagtttattcgaggcgcctcatgttgttgttgagtttcaaaatcgatttttgaaccgtaaaaggggatacaacgcatttctaactttcaaaaccagtacaaacaagattccttcctttatgtattgtccctgattttatctgacgtggaggccgccagccccatctctctccccgttagccgcccttctctccactgcccgtgttcggccaacatcggtctgtagatcatagatggaagaaagagggaagtaataagggttggttgttgatatgtgggtcctattattatttttattttctgatatgtggccccttgatttttattttttttcctggatcaaattatcatgtaagcgtcatgtcaatatcacacgtcgaataaatacctaatcaaagaagccacgcaaacgtcacataaaccaaaagcagtaacattattgtcaagtgacctcgtttgtattgggtttaaaagttaagagatgtgttgtatctgattttacggttgattcgacgagggaaaatttttctaacaggaaacgatgagaaaaccaggtcagtctaggccaggcagaccggctgacggctgttgcttcttggcctcttgggcctgtggttactggttagatatttttgcagccagttggtgcgtgtttgacactttgacccactgcattgtccattggttggttctgcatgcacgagtgagtgtctcaacctctgcttgagtccacacgtcctccacgtcacacgctcgcgattcgactcccatttcgtggcaggacagagacaaagcagagctagcgatctctgcagctttcttgttcctaattcgattcccatggcgcactcccactctgcggcttcgctgcacgccgcccggctactaccgcagcagcgcacgcccaccgcgccacggacactgttgccggcgggcggtggcctcttgctccgccgcccccacccaccgctccaccagcagcgccgcagccgctcctcctctcgtcctgacctccgctgccgccgccgcctcctcaccgcgcggggtgactacgacttctacgagaactatgccgatgaagaaggagatgaggaggaggagtcggaagtcataggtgggagcttcgacgcggcggtggcgctgttcaacggcggcgagttccacgcgtgccacgacgtggtggaggagctctggtacaccgccgaggagcccacccggacgctgctccacgccatcctccagtgcgccgtcgccttccaccacctcttcaaccaagtatatattttcatcgtctcatttccacatttgactatgcatagtaaattagtaattactccagtaaaatttgtgattagacatgatcgtgcacaaacacagaaccaccgtggcgccatgatggagctcggggaaggcctctgcaagctccgcaagctgcgtctcgacgacgacaccacgagcccattctctcggttccaggaggaggtcgccgcggcgctcaacttcatctaccgcacacagaaggagctcgcggcgtgcaccgacgatctctgcctcaccatggatggctccgggacctactaccagctggttggcaacttcgccgctggccagaagctctaccggcttgaaacaacaaccagtgcagatggagatggcgtttcaactataaatctttcttgttcttcacgactcgtcagggtgaagcttcccacattgagcgcccgggagcatcatctagcagcgcttcaatgtacaagcgg

SEQ ID NO: 18485 - DNA, 5987 bp, Oryza sativa
  unsure (1)..(5987): unsure at all n locations
cgcggcttgaatttcganatttcgacatgccacttagcgagtatatttagtttctttttttttccctgataaaatgtttagctcttccgatccgtttgaaccaaattgtagttttctgtacttgggaaacgaggaatggagtcaaatggattatagtaccattggtttccttttctttcccttcaatttttctctgcacatactcttattatacgatgatgctaattttagcataacgggtgaccatgcatcttaaaaaaatagtagaactatgttatatttaaagtacctcaaatgataaaatgagtagatttcataaaacctgaggtcttaggctatctaacacaaaatcctaaaatttacaatttatgttcatgcccaccatgttttagggtaaaatgttccatacgattctagctacaagtatttcgtccatttgattataatagttgtaaaaaatgtatgagatattttttctatatgcacatgttaattatgtgcttttcaacgagccatcatcatggttttattgagtgaatttcactttggtccccctgctatcgaagtttcactttggagcatttttatctgatttttttttcactttggatcatctatttttgttttcttacattttggaccatccaaactctctttgcggcacatcaacaatctcaagaacattggcaccctcatgaggacgatctctcctatttacattcaagttacatcgttaccgagggagagattggatgtgattatacataagcattagggctaaagtgtagcctaatatgttgctaaaatatattctccccgtcctagcatataagagattttaattggacgtgacacattctagaactacgaatcttagttctgattcgtagtattaggatccaacccaaataccttacattttggaacagagggatgtagtgagtattatttggaaaaaaataaatgaacgagccttatcataacattaaatatgtaagggtatcaccaaaagcgatatgtataattcaagtgataaatgctatggctatattcaatatagcccgcattgtacgctaaacaaataacacgctttaacgtatgtatatttatagaaaaaatgtatagcatattggtatacgagttttcaaatctcacaagaataaaaccaatagtattatctatttaattcatttttatagctatctttgataaaattataatccaataacattatcttcagtttcttttttcaccctctcatgttctgatgtgaaaaaccctctgccttcttgaacccaagaggcttgcagcgaacacacgcagcagggaaaggggaaaaaaaaagaaaaccaaaccctctcgtttcgtcttccccggcccgccccggcttgccggcccccttcccttgttcaccgggggcgaattcaagctgacgagctcgccaccggggtacacgccactctccctcccaaaacctccgcaagcttcaatctctcacttccaaattcctgattttctcgctttttttgggggattttttctgcgccaggattggttcgatcttggccggccaagaagcacaagtttcttcggggatatagcttgttcgcgaggggaaggagttcggtggtggagccttcgccttcgtgatggcggacaccaaggcggacgccaaggcggaggcaaaggcggaaactatcggcggtggcggctctggctcgttcagcgagcaagcgtttgttgagaagcttaacaagctcaacaacacggcgactaggatccagagtatcctttcttccggttgtttatttcttttgcgcttgcaaatttggtagcgctcgtactttatctgtctagtggttttaattgatttactgttccagatgaatagaaccctaaattgcaatgtggatcagtacaactgacataggatatctccttggcgttccatacgttggttcttgcgctatttgtttggttaatattcaccttcttatgttcctaacagtgcttattgctgttagacagcatctcgtgcgttatttactgatgcatacggatataacttagtgtggcaattgtttctgtagcttctggatcatttttttgggcatattttgatatactgttttgaattatagctgtataagtgtatatagatgagcatggctacaaaatttagatttcttatcagcattatggtgtatcagcaatcaaagttggtataataatttctgtttgatgcattcttactgtatacatgctttccattatttttgtttcttggggaaatctttttttcttgtcttttgaggatgattatctttacaaaaatgaaaaataatggcatgaactgttaggtattattttaatagtatccttctgtttgatatgcaacgattttttgtttgttgagaaatactatgtttttcaatgccttttgaggatgactgtatctagaaaccgaaaaatgatgataaggagcgttcgggctttgtgttacattttactagtattttctaggttgtctacttagtacttatatatgtttcctgtacattagaatggaatattttacctgttcaatttgcaaattaataaccagaactgatcatattgccacatactttggttccttttggttggtgctattagggtagtggtatgctagtgctattagggtagtactactttggttgcttatattatctgtctggtagttttgattgatttactattcaagttgaatagaaccctaaattgcaatgtgaattagtacaactgacccagcatatctccttggcattccatatattgccttttgcactgtttgtttggttactgttcaccttcttctgttcctaactgtgcttattgctgttagagttagattgcatctcatgttttacttatcaatacttattgatgtgtacgatgatacacatataacttggtgtggccattttttctctagcttctggatcattcttttgggcatattttcatatattattttcaattatagctgtatataaattagcctagctaaaatatttgtagtttcttatcagcgttatggtgtattgtgctattggcaatcaaatttatattacaattttggtttgatgtgttcttactgtcaatacatgctttccttttgtttttgtttcttgggaaaataagttttcactgtcttttgaggatgattatcttttgaaaaatgacaaataatggcatgatttgttaagctgttgtgttacatctagtagtatcttctattcttctgtttgacgtgtaataattttttgtttgttgtgaaaaattaagtttttctatgtctgttgaggatgattatattttgaaattgactaataataataataaggagcgttaggtttgtatcacattgtagtagtgttttcttgtacattcgaatataactgttttcctgttcaatatacaaattaatgggtagaatcagtcatatatcacatagtttgtttccttttggttgctgctatcagggtactgatatgctagttcaactttttttttttatctcttgatggctgagcacaatctttgtggaattgctttttacgatgttcgaaatacagtgtgacaatatttggttgcactaatgttgtacgcccttcgtcccaaaatataacaatatctagccttcagaatttgttgcaaatataataacttcttcactaacattctctttccaaccaatcacaatcctccatttctcatccaatcacaaccttcctccatttaattctacctattttcttaataaccgtgtataaccctaaaatttcttatatttctaccaaacaggcccgtagtattggcaaatgaataaacaaccttttctattattttatggccatttatcttcatttctaagtcagttaatcagttaggtcagaactaatatactttcatcaatttaacaaataacaaattccctacggttgtaaaaaaaaaacaaattgcaattttttggcctttgaacaaggataaatatagcatttatccacctgcatccatatattcatgctactaagggggtggggggattatgtgatggttatgtcatgtccttttgcttacatattagcaactcgaagccctatgtaaaatcttctgaacaagttttaccacttgctttcctgtgtttaatgccaatgccataaaaatcatttacacagtcatgataccaaattcccacagcatatttttaacaatagcatctagaatacagtagcttgccttttttattccttaattcttaagcagcactttcaaattggtgcatttttcaccgaaagagagccagaaaggttgttgatacatgggagaagcagtataacagtgcaaataaggataagaaagtatcattcctgtacctgtcaaatgatatcctgcaaaatagtaaacgcaagggaggggagtttgtgaatgaattctggagggttcttcctggattattgaaagacttttatgtcaatgggggagaagatggaaagaaagtagtcggaagattagtaagttattcttaattccgttacatgtttaatggcaggaaaagtctatttacttcatttttttctatcacaaggccaaaacccgaaaagtaaaaaaatatatttatttttaaaattacagatagatatttgggatgaacggaaggtctttggaacccgtattgaaagtctgaaagatgacattcttggtggtagcactcatacaatgggtaacaatggcaatagctcaaatccaagctctcacccctcttcagtttccaaagctgtgcgaaaagattctggtacagtaacaaaagtaagttgccagatcttgacctgctaaagaaatattttcttgtgctgaggatggatgcagtatattgtcatgaatgtgagctatttttgttgttttttcttttgatgtagaaacttactattggcgggatgccagaaaagattgtaacagcatatcagtctgtgcttgatcaacattttgacgaagacacagctttaaacaaatgcaataatgctgttagtgttttggaaaggatggataaagatgtagatgatgcttgtacccaaggtaaaggattttctctcttcaataggtctgttatgttgtagatatgtaccgttgaaaaattggcacttaatgcattctgataccttggcctgtattgcatcatgattgttccagcgttattttacttctagttccatcatgtacttgacttgggaaaaaaggaatttacatagtatttccgattttccattgatctgccatgtaaattctagactaaacaaacatctcaaatacataaaaatgatctagcatgttgacaaagaaaattgctgtacataattttataatcatgtgaaaaaaactataatgatgtgattgtagcacgcgttggcatataaaggggaaaaaacatttttctgacatttgttttcacaagtggtggtctagcatacatatcctttttcagtggaccacatccagcagcttaattattttacattgcgttccttgagtcctttatagtgcccactatgcctgtaggccataattattgacaattgctaatttcaaatttgactaaatgttttaatgagtcatagaggaaaagaaaatactgtagggcaaagttacctattaaaaatgttcctagctctgatgatatgaaagagtaaaatacatggccagtccttaaactagagcggtggtgtcacatagttccgtaaacttgaaaattgcacatttatgtccatgataatgaaccacagtaggtccaaacctcgattgactgaggctgaccgccgatgtggcgctccacgtaggcaacaattttgcatccggcccccttttgcaggacagcgtggtggtaatattgtacttagcccctttgagccacaggggtncgagctnggttctcaatgcaatcaagccgc

SEQ ID NO: 18486 - DNA, 1765 bp, Oryza sativa
  unsure (1)..(1765): unsure at all n locations
aggtcaggggaataaatatcaaacaaataggctcttttcacatgattcctgtaagtaacgcaaaccattagtgtctgcgttttcatgtgtggacgcaaaatagttgcctacatggagcgccacgtcgtcggtcagccctggtcgaacaaggtttggacctgctgtgtttcatggacctaaacgcgcaattttcaagtttacagacctaagtgacaccactgctcaagtttaaggaccgaccatgcatttcactctaatcggaaacctgtaccctgactttttatatttacaaagttggatatgaagagatgatcatcctttgacactataatgctttcatcctttcacttcgattcttggatcaaaataatctatgcacaccttactccttttctatttcataggtattcagcaaggatcatcgttgatttctgaccttcaagggcaggaaacagtccttaagcagtgcattgagcaacttgaaagtgtcaacatggctagaataaccctaatcaataaactaagagaagccctcagcgaacaggtcttgagcactttttatatttttttccccaaatgttctaccttgaaggcatactattacattcataaagctttatgttttttctttttatataacaggaagcaaagtcagagcttcttcgcaatcagttgcatgtaaggattattcttttatgcattctcacttgttagtatccttgttattacttcatctttcactgcagaatcacatgttagatctttctatttcttatgccatgtctgtaactcaattgcaatggaacgttaaggtcaaaattatgctgatcattttcatggatccataagcttttgtttgcctagcggcctagcctaagatgccccatgagtccatggcatgtgagcacaaccagagttttgctttgtcaaggacattcattcatgaatttatatcacacatgttcaggatgagtagagctaggaaagacaaaagcaaacatgagaacacataagatgcacattgtatgctctgacacgaagagaagcctctaaactggatagttgctgaatctgctgtacgattcagctctatgatggaagtagtagactagccatggtctgcttgggcagcacagatgatctgtctcatctagtatcctgcttgaagcacaaacctgcctcttagttaccatggcaaccctgaggccttctctggataacaaggcgacatgttatttcctacttattagactgcttctcaattccaacttatgtttgcaactttgcatatatgacattcctctctttatctgtttcaagagaaataggtccagcacattgggaggtctgactatctctatagcataagctatacagttaaggtggcccttgcatgagctaatagaaagatgtgcctgcagtgatgtacccatgcatatgcgttgttattagttgtaacctaggttctatgtagctaacctgctaactccacggtacaaacatgtgtcattgcatcttagttggaaatttccaatcacatatttctgctcccgtatgtagcatccgtctccgctggcttttgttaacattgctatataccatctcagttaaaaccgcagcatctttcctgccactgaaggggtgttttagcagctactcaagaaattatttagattgatttttggctaaccctgatttaattgacagggggatcctctagagtcgacctgcaggcaggctaatatcagctatcaaatnggacacg

SEQ ID NO: 18487 - DNA, 7418 bp, Oryza sativa
  unsure (1)..(7418): unsure at all n locations
agtttatttattttttattcaaaatgattgctatgcaagtttgctgttttccattctttcattcattctgaggatgtggctgggttgttagctcagagtaagggaggataattcaggggaggtgaagtctgtaccctgcattgtaaatacaagtacaacatgtcctctttggcaaggttattattgttcagtaatcctgaacaaaaacctcctagcttgtcacagtaaaagtacgccggtaggaacatatatttgctgggtgcttcaggtatatgaacacacaactttgatatggccaccctgagcaattgtggatcaggaatacagactgttatttctgctgattcttgttccagtctaggcagcatggtcccaggaaatagcccattagcctgtgaaatagaaatgatttggaagaagtgacagatagggagaaaaaggaagccaaaaggagcccacaagtatcattcacatactgatctgaacaacggacaagaaattgctgttagttccccaattgcttattctcggtgaattgaaggatacagcagattaagctagcttacctaacggccggaatgtgagtcatccagctgattaagctacaagctactaagctagcagtttagtggaactaatgatgaaactagcgagacgatcttaactgtagtaaagaaagctgggttaaaactatctacaagatgggataaatcataaaactcatctgcaaaacttttgctaactaaaacggagagcagaatccaggaagaagctgaaggttgccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccggcgccgctgccgtgggctgctgctgctgcagcagcaacctcctgctactcctagcagcagcagcagctactgcattgttgttgccgtcacgcaacaagtcggtgccgatcgttggtgatgcagcagcagttacagagaggagaagatggagcaagaagatggcagcgaacacgcggtgcaaagccttcttcttcatggtgatgatgctttcttgatcagccgtgatgtggtggtagttgcagtactgtgtgcgtgtatggcagttgagcatcaagggggagcaatgctggcttatatatattgttcttttaacttgtgttacagatacagactagcttgattgcagtagcagtaacatgcagatgcaatgtgcaggcgcgctgcttccactacttgggaacatgcagagaacatgccacacatttccctgtaaattttagcttctgtggaatattttgttaagaagaaaggagtcatgcatcaagtgggtctggaacatgccaccctgagacctcacttttgttttgcagacctcaaatagtagtgctgtttctctttgactgaaaaaactccttttccttgagattctcagataatctagtccataaaagtgcttcacattaagcatatgatccataattctttctagggatatatgcgtgagtgccgaccatgtgaaagatgcttctatttgactaatagcatctcttgccgtcaggccggcagtatacgaacaactaaatacaacacgttcggtcatgtgatcagatcagacattcgtttttctttcaagagtacactcaggatataaaagaatctcaataatgttgtatgcttcagattcagatcgggtagcagctcatcgtgcagagtacggctgatcggccgcaaacatatcgtacacagatagcactgtccacggtttcagaatcaagtttttagacccgggcaagcctaacaataacatcagaaattcagaattcattccttccttcctctcttaattttgattttggacagtatatatattcagttcaatgcttatttcagaagaaaattatccaattcagtaatgaacctacatttttgtctgaaacattcgaattgtaggtctatatttgcaaaactgaaacaatgttgaatactatgttaagaataattcttactaatgggatgccctggttaatcataccaagtggaaataccatgatgcatccagtactacataaaaatgcctgtccacatggaagaggctggccatggaccatctgtctcctaagtaaacatgtttgaccataaactaattgccaagtgaaatgctgagcccttcaatcattgcgaagttcatggccacttctacttgaccgtaattgtagatggaaatatggaatcacatggataacgcatttcttcatattacaggaacatcaatgcataccaaatacctgaatctgaagacagcttgagtacatgactattattattatgtcattgcagttttcatagtttcacattttcccacaggcaactgtgtaccgcgaactttgacaatgaggtagcaactattgtcaatgttttaaatatgattaaatataccaaattcaaatgtaatgagcgatactatcttttttgttttttcgttttttgactagcaaagttcagccaccaccaactcctctcttcaatccacataagtccacagatttgatcagccattcgtcaggcttaacttccaagttggttctagctcctgtcaatcattctaacattcttggacttccatagtagatggcatatggaacatgggacattagaagagtggaaatcaacttgtctacatttctaattgtgtcacatgctcattgtatgactgcaaaagggccttctaaaatgaataggaccatctgcggtctctgaacttaaaattggaatgttctaaaggtctgcaaggagctttaaaattacctacacaatttgcaccatggatacacattttgtggcaagaatcgtttttgagacaagctgaagactgacaagaacaatatatgtcatcagagtcttgacaagctagaagcaaaaacgctagacattcggcaggagacgtactgaatttatatgcagaaaagcaaccgacagtaagttcatacagtctcacagatcatgcatgtggttagaaacaggccaatcttgtacaagtggaatatgatgaaacacctatcatttaggaaggttcagggaataaatatcaaacaaatatgcttcttttacatgattcctgtaactaatgcatacattggtgtttgcgttttcatgtctagaaacaaagatgctttagtcttgcgaaatatacaaattttgatgatattcagccagagataagctaattcgctgcgcctcaaaaccggaagctcaccaagggggttcggagttttcgactccgagcccccttgggtctctggggcaccgtcggatcaggcttgtgtggtccagattgagtagatccactccacggcgtgaggtgtcagcgacttgtttgggccgtggtgttgcttgctgggcttgaggtccagcacggacacatgtgtaggcccaacctcacacttcattgcatttaggtgtgatcaagatttgactttgttggttataaaacagtcccgagtttcttaaattttggttacatggatgagccgctacttcctgtgatggcatgccacatctgtatactttccctctggtaataagtatttggcgtttgggaacatcatttgtccaaacctttctcgggcaaactttcaaactaaatatttgagttcagatcaatgatggttacctgccaataaccggttactttttccgaaaccaccggctacaatcacaaaaaatgaaaaatgcatctacaatagatcaaaacaactgtacaattaaaatttgatgtttaaatttgaatctagaatactccggccagcctagagaaatattgacgatccacgagcctagaaacacacgatcgatgactaagcctagaagttagaacatgagatgcactttcacttggactatgagttggatcgacacatgcaagaatattgtgttgcgttaaagcagcaacattttttgttgaatgttgaattttccctttattctgaacgagaacagcaatatttgatgaatattcgaatacgactgaactgtttgctgttgcccaagtaaacatttactaaataattagactcttagttttatttcaaacatcgaaggggatgtagctcaaatggtagagcgctcgctttgcatgcgagaggcacggggttcgatcccccgcatctccagtttttattttttttaaattccttttcttttgtctaatttaattttatgtttttctctaatttaattctatgcgcttctaaattcttgtctaatttaactatgtactttttaattccttttcttttgtctaatttaattttatgattttttttctaatttaattttgtgcgcttctaaattcttgtctaatttaactatgtgctcttctaattttctagtgccatattttgcctctaatttttggtctaattttaattttatgctcaccttattttgtatgtgaatgtgagtatgtgacacgatgaattcttttgccttttttggtttaatttagttttttgagcttctaaatttttataacaattttttatgggattctctttagtactttcctttagtaacagcggctgacagcttggttccatcccacatttcaacgacagctgctatagcctattccttccgtaaaaaagaatagttcatattcgttgtttttagggtaggtcatattatattataggttttttttatagtagaagtacagggctacaagtgcagtatggtgctatggatatcctgcctgccgtatcgtatatagttcatccccactaaatatagttaatgttatttctctcttctcttattaagtcatattaataagagaagagagatatggtttaaattttctcttctttcttctctgcaatctcaattatctttaggcttaaaatttataagtattaatttatttttattttaataatcatattatatctttgcatattatgtaacttagttcattttccacagcaacacggcggggttttcatctagtttatattaagaactcatccaacgtgaattccgttttcaatgcttgttttaaagaaagattcgatgagtgcattttttttaagaacacgataagtgcagttgctcataacttcacgctgaaaaaacgttggcactttgcaatctccattttgcattttacaaaaaatatgtcaataaagagcctgttccctttgatgtcattttcaatcatatcttttttttacaaagttatcaaaaaaatatctacgtttagtttgttgtcaaatttagtcaatacataagaaatcatgccaaaattttgataatattaccatcttgctaaaattttagcattaacaaaacttgataagatttattttagctataatctgaacaggcccaaaaagtaaaaaaggcaaactttttgaatataagtataaaaacaggttaatttattcattccagtgaagagtctaatgccttgtttagtttccattttttttcaaaaacgtcaaatcgaatctttgtacatatacatggatcactaaatatagataaaataaaaaactaattgcacagtttatatggaaatcgtgagagaaatcttttgagcataattagaccatgattagctataagtgctatagtaacttatatgggctaatgacgaattaattaggggcttaataaattcgtctcgtggtttctagacgagttctgaaattagttttttcattatctaaaaacccttttcaacatctaatcaaacgtctgatgtgacacctataaatttttctttccgcgaaggaaacaaggcctaattaatgttgcgttcgtttatcccatgggcgaagcatccgaagcctcactaaatctgtgtttagcacatgcgattagcatcaaccagcccagaccgaagcatctcctcctcttcttccactgtgtgactcgcgcagtgtgatgtgtgtgacacgctgtgacggctgacctgacgaggacaggcgaaaagaaaacttgttttggagggagctttgactttcccatttcacttcatcagtttccctcctccattttcgattcctcctctccgcaatccaaacctcgccgaattcatggcctcctcggccttcaaatccaccacccgccggacccttcaccccgccgccgacgaccgcccgccggctcgtccccgcaaggccccaccgacgtgcccacgcccgttccgcagcgccagcgtcgagccccgcgcccgcggcatcggggagtacgccgccggcaacacccgcaccaaccctctcttagacgactccgcctctccgccgccgacgaaaccgcaggtggatacggaggctgctgggtgtcgcggcggggaggcgagacgggagagggggagggaggtggctcggaatggttcgtgcgccggcggctccgggagggcgcgctctgtgttcctcgcgcctgggggccggggcgccgactcgtcttcgtcgtgggggaatggtgatggaagcggcgggaggagggcctccagggcgccgtcggtggcggtggacactgcaaacctttaattcccgcggcgggacaggttgtttctgattcttagggactgggggactgggaagtctcaagaaaaagaaacttaaaacttttttcttaccactacttttgcaaaactctatttttttttttgcaataggaactggaaagaaatatattggagtactttgtaattctgatatcataccatatacatgtggaatgaaaacaatctctctagattctactatatgataatgaacaaaatctactgttttttttttcgttatagtaagtagaaagattcatagtaatctagttcacttggagttgtcactgtagaagcgcagagaaattgagactcggtctttgcattccatctccaccaatcctttgctcgcaagttctgttcttgctaaattcgaacagagtgatgcagaaatcagagatatgtcaatagaatttcagttttgggagagtatgcattcagtttcgagctcagtagaggtcagaagtgatcattcacttgtactagtggaccataggctggcttttttggttcagtgaccaaagtggtacatgaataggttgttgagttgtattaattgatgcaagatattaactttactagcaaacaagtttgtaagctactatgcttttttattaccaccagacatgccaacacatggctggaaatatccattcagaatctagaagtgccttcttaaaaaaaaaaaatctagcagtannnnnnnnnnnnnnnnnnnnnnnnnnnnnnnnnnnnnnnnnnnnnatataatcatcaaagcccacg

SEQ ID NO: 18488 - DNA, 2515 bp, Oryza sativa
  unsure (1)..(2515): unsure at all n locations
tgtctcgccaccataccccgttctgttttagaacaccaatattgttttacactcatgttctcacttaatcgtgatgctactattattctttcatcgacaggtcatttggcaaagcaatcattcaaatgtcccagtgcaacaggttattgaaattcctcccgagtttgatccagattcttctgagtttgtctccgacataagtgattacacaacagaattcaaaaaggaggaaattttgcacattccttttgagtttgatctagatagagctgatctggctcctgacatagagcaccattcaatagaactgcaacgggaacaaatggaaattcctcttgactttgatccggacagtgccgagctgtctcctgatataacagagtatacaacaaagctcaaacaggtctgactattattatgccaagtgtgctgcgcctccaattctgtgcagtcaacagtcataaccttttactgctttgattacagtcacatgaacgtgctcgaaagctacgggcagatttagctgtcgaagagcaacgtgaacaagagttgagtagagtgctgaagggtattgtaactacaccaaattttactgaggcacataaaagaaggccaagacgaaaggtaactgcatcaaattttaagtatatttgattctgtttgttggtaaactttctattcattttgtcttggtatttgaactgacctttgtctccatgttgtggtaccagagtagtgtagaacgactgaaagtatcgaagcatttggctgaagaggcaatgaattattttgaggaatgtgtctcgatctcgacattggatagcactgatttctcatcactggaggaccctcaaataaattcagttgtgaacatcccacaaaagagcagaaatacatcttttaacaaaggtggatcaagcattgcagaaatccactatccaacagatcgtcattggcataatgaggttagcaaatcaatgctgtttcacttcactgaggctttgagatttgtagtactttttaggaatatcaacccaagtacccaacagcctccatcattcttttaaacatttatttttttattatgtggttcagaaatagtacagtctttactctctgttaattggcatattgcagctattttcatattcctattgttatccactcaaatattcctgaattgtctacgttgtacttaatgtgttgtttcgagtcatattacatattcttgttgatttcccagcagcattttagtagaatgaaaagtaggtctattttgtggatagtaacgatcattctcacactataacaagtacttcttgccctcccaggaatctgacaaccaaacccagtgctcagttagcttaactggatctgatgtgtctggaggccgtacttttagtcataatatgatgacccccgtttcaagaactacaaataactcaagtgatgatctcgatggctttgacacaccaaaaagcagaagttcttgtttctccttcacccatgaaccaacaaaaactgttgagggcgacgacgttcaacaatatttaagaagttttggaaggggaatcagtaaagatctaagagagataaggtcaagttattgtgatgatgactatgtatttcagaaaatgaatgcagacttacttatggatattgtgacatttaagaacagggtaaattttgggggtctccttatttgtaatattagaagatagtgagaaaacatcaactagtgcgctatggtgggaggactgatattcatattagcaacgtgcaattagtactactagagatgtatacatgttcatatgattctatctactaattgtgatttttttggtcatcgactgatatcatgtgatctgcatgctattttctttttaacctgggaataattatttgtaacattagaagatcctgaaagaaaaaaaaatcaagtagtgcgcagtggtggaaatggaacgtgcaattagtagtgctctattgtatatatatccataggattatctctactaatgattttttcgtcattgcattgctctcatgtgatctgcatgctgttttgttacttgggaataatctgttagtactataaagaaatattatatctattcttgtggatagctctgaaacagttcgcatttgattctacaacatccatttctatttgcaatatctttgcacatttcatcctttttaagttataccaaatgaaaaccacaagtttgcatcgactgctgttgacagctgtctctgtaggactatgttacatggaaggacacatgttttaaatccaattcatgatttaatggtgtttcttctgaacattgaaatttgatcattactacagtaataccaggagagagtgtgtgctccctagagtaagtcgtataacaatactgcgaccgccgtttaaaaatgtcgtggttggaaaaaccctggcgtgccccaagttaatctctatacagtacatgggtaccgagctcgaatatcaagntntcatccccgg

SEQ ID NO: 18489 - DNA, 768 bp, Oryza sativa
  unsure (1)..(768): unsure at all n locations
gccgtaggtagatcanactcagtctgcctgcacgncgactctagaggatccccattacaacaacattcaattgaaattacacgatacaagtatttagtccgaacactcatcacatcacaacaacattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcattttttgttagtatggccgcgcagatcacacttgctgcagcgtaaagtcctcccacctgcttctgactcatccatatcatttctgatgcgtctagtttggcgtcgaccctttttcacccttaacttagatggatctggaatgtaaaaaacttgggcactcagcgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgcttctatcaacacacattatttataccgatgcacttgtgtgccttgagcaacaactctatgtct

SEQ ID NO: 18490 - DNA, 790 bp, Oryza sativa
  unsure (1)..(790): unsure at all n locations
ctcggccaccactcagcgaaccaagcagccggttcatttccaccacctccacctccattaccacttatgccacaatttgttcaaaatactggaggaatgtttggaatgggaccttttgggatggtgagtggctctgcgccgcctccacccctattgcccaacattatgtcagcaggttttccaagactaagcgcgcctccacctctgcctctgcttacacaacctcagaaccagagtcagccccagcagcagcagtctccgcaggcaccacagcaatcgccgacctcgacaggattttttcaaccaccaggtgctggcttcttcccaccagtgcaggttcagcaatctccatctgcccaacggcaatgatgattctacaacaattgttgggctataaaggaagcaccttgtgctaactttgtatattaaacaataccctgaggattgatctgatagttggcgagtcctgcgtcgtgaagcaggattaatgcttatgaattgggaagatttgtaggataggcttgcggcttatgtgatgtacaactattccttttggtctgaggagttgttcaactcttcttggttatgtgaagttagttagactttacttttgtttgcatagccagatcttatttttagtcttgaggcaaacaaatgttggcattacattttttacttaaagaggtgcccaagtgaaaacctttttgggctcctctatnnnnnnnnnnnnnnnnnnnnnnnnnnnnnnnnnnnnaggggttntccaannnngatggaaatcaagggccgg

SEQ ID NO: 18491 - DNA, 780 bp, Oryza sativa
  unsure (1)..(780): unsure at all n locations
ccgtcaggttgatctaactcattcngcactgccgcggccgactctagtggatccccatgattgaagggctcatcatttcacttggcaattagtttatggtcaaacatgttttcttaggagacagatggtccatggccagcctgttgcatgtcaagggaaataagtgtttaatgcacgcttcaaggaaaggccgttgtttttgcaattgattttagttgaactcttttctgaaaacaactaagtgagtgcttctcaaacgacacggttgagacagtgcgtctcgttcggtcggagtatgtgcaatgtatcaggctttagacttgattcaaagttggcacccggccaacagcttttcaaacggccacccgggcctacaactttcaaacggtcacccgggcctagctgatcccatcagctgcagatttttcaaacatcgaaccccttttcacaacagcaattttacaagcagtagtcaaacaaaactacgctaggaatcacctcacatccgcccatgaccgggggcacggctgttcgaacagtttgttaacctttgcagagggggggtacactttacccacacgacattactaacccggatcacccagcccatggggatcagccacgttgggagaactccaagctttcatgacaaancattttcaaaagccgatacaggtttaccatatgccgacgagaggggtcccagaccaacaacaggtttaggtccagaccatactgtgccaggaagcccaagggttctccctgacacccaccccgcga

SEQ ID NO: 18492 - DNA, 1021 bp, Oryza sativa
  unsure (1)..(1021): unsure at all n locations
ccgcgcttgaattgcaactcggactccaacctatactagactcttgtatttatctagatttgtagcactaagaatacgtcatttggtcctaaattcttatattttgtgacaggggagaagcaaccagctacactagattgtacaccatctagcactatgaatgaagtaatgctaggttatctaatacttaatactttaatactaagttgttatatattaggacaaataaaatagcaattcagtcattttggttaaccaaggtatggccgaataagaccctgtttagatgggactaaaacttttaagtctttatcacatcgaatatttagacactaattattaatattaaacgtaaactattaataaaactcatctataattttggactaatttacgagacgaatctattgagcctaattaatccataattagcatatgcgatgctacaataaatattctctaattattgattaattaggcttaaaaaatttgtctcgcaaattagcttttatttatgtaattagttttgtaagtagtctatatttaatactctaaattaatgtctaaatacagagactaaagttaaatccctgatccaaacaccacctgaactcaggtagcacgaaaagcttgaccgaattagtttaaaaaatcggtctccatcacttatgtatcggtctggaaaaagcagtccggtttttcaatctcggtcatttttctcccaccggcacagtcaccagacagtggtacgatcgacaaggtcgcgtattgctgccaccaccacgtgctaaacctcaagatttgtgcagtcggcatgcaaaactcctctagtcaatggagcggctatgctagtactcctacattattccgtcgtcactcttatacaaacaaaaaaacggtgcggtgtacgcaccgtcgcggcgccgaccgaccgccagtcgtcgaagcatnnnnnnnnnnnnnnnnnnnnnnnnnnnnnnnnnnnnagagtttcttaannnggagtgtatcaaaagcgcac

SEQ ID NO: 18493 - DNA, 1480 bp, Oryza sativa
  unsure (1)..(1480): unsure at all n locations
gtggccnttgattgactgacaaactagtctgcatgcccgcaggtcgactctagaggatccccttcggaatttcatttcagttctttgaccacttgccatgtaacacttgatccgccatcaatataatgattgtaaaaaaaaaaaaaactgatattgaaccatgcgaactacaaccgaatgaattgtggccctgtttagattccaacttttttcttcaaacctccaacttttccgtcatatcgttctaatttcttcaaacttccaattttagcgtggaactaaacacagcctgtgatctcaagcaaatgtgtgagaccagtacagcacatccccttaccacagaattatgagagaaatctacagcacattacgctgtataatgtacaatacaacacaacgagtatttaccagaaatctccacaagaacacaccccgtctctgaagtgatggaaccgggtacggtccctcatgacaatctctctaccatacacccgagatacaagctttgcgctctcatggcaatcggcacacacccggaggttcttgatgatcctaatgggagctcctggattggaagcgatcagagcaaaggcaatggcgagcctctcgctgtggtaggacagtgcatccgccttgtcctcctcctcgacatcaaacaacgcagatgaggtgctcgaccggtgtccgcactcgcttaatctggtctcaatatcctcaaccatggcgtatatctcctttgaggcaggatgcgtcttgtcacccaccaagaactcatggagaactccattgatgtctacaaagcttgatccagggctcttgtcaatgcccatggacttcatctccttcctcgccttcttagcgtcgtcccatcggttcgttgttgcgtagaagttggaaatcaggacatggtttccactgtcatccggttcaagtcgcatcaattctgcgatcatcttcttgccgagttccagcttgccatgaatgccacaggcccggatcagagacctgtatatcgcagcatttggcacgatgggcattccgtggatcagcttctcggcatcgttaagtcgaccagcccggctcagcatgtcaaccatgcatccgtaatgctcaatacttggctcaatcccgaattcgatctccattctgtcaaagtagtccagaccttcatccaccaatccagcatgggcacaagcacacatcacggacagcacagtgacgccatccaccggcacgccctcaccgtgcattctgtcgaacagggagagggcagcacggccatggccatggactgccaagccatggagcatcgcattgtagcagcgtgtgtccctgtccgaagcggctgcaaagacctgctcggccaggtccagccttccgcacccggcgtacatctncacaagcgcggtggccacaatgcaattgacggcgagccggcgtttcacggcataggtgtgcgcccacaccccatggctgacan

SEQ ID NO: 18494 - DNA, 937 bp, Oryza sativa
ttcaaccaccaaaagtatatgtacacacactgcttgactatactgcctcctctcctgtttacaatgcatgttacaattctggctctgggtcgtcatggtaatagtacctgttcctgttggattccatcactccgtgcctccgtagataacatcaagctggtaactcggttcctgcaacaagcacaaaggttgaggaaattccacaagcccagtgaaagtgcagtcataattcaagttgagtcactgtaagacctccttaccgactactaggacaacagttcatgactggtcattgttcaaacagggaatgtaacccaacaattccagcaagacacaacaaactcaaaataaatggcactaaggatctcatcagacatacgcatcaccaacacaagtagataatgacctttcaataccacagcgttatatacgcaacccaagtggcaaaattaagctgcaagaagccaataaaaagtaaccatctcgcaatgttgaaataaacaacgagcataatcaactgttcagtctcagacttccacaaaccaggaaaaaacagtctcaggcatttaattttccatgtacagtacagaaatgataccctcaatgttgaagatgaacatgtggaggtacagaaatactgatcagagtgaatgctgccctttgcaacatcagatcattgaccattcactacaaaattaagttccatcgctaaaattgcagtatccaatgaatagacacccaaaagtgtgaagtagcctcacggtaaagaaagtatgctctacagccccctgaagaaatgtggttcatgtctactttcattatttagaatttggcacacttcgtgtggaacgagactttcttggagaatatgtggagtaatgttcagcatgcgggcactacattgaaatttcttcagcaaattgcccttatgtcgagg

SEQ ID NO: 18495 - DNA, 707 bp, Oryza sativa
  unsure (1)..(707): unsure at all n locations
ctgaagaatggattttggcggtagcaggagcacaatctccgacagaatttcttcagggaggttggcaatggtgagaggcctacgacgctgctgttcgggcagcctcaccatctccgccattgcaattgagcccccagctgacaatttggactaggaccctagtgctgctgcatccttggctccttgccgctctgaaactgaaatggccaaaaatttcccatggaaagagagcacattaggattccagaccgtcaagaacttgaaagaaaatacagctcaagatgggtgttcggatctcacatgaatcaatcatctcgttttgtgatcgttattcatcctccctccgaatcatcagagtaagtgactgatcataactgataaacaaacaagcaattaggactggatctgatcagggaaaaccaaagcctggactgaggctccaactccattccaccagcaaaagtatttaacaccaagaatcacactgaaatgaaaaggaagattaaaacactaatctaaaatacgaagaagcaaactaaactgaatcatgtctgtccctcagaatgcctattctcaacagtgcacatggaattatcgatcgatcggttccttcaacctcacagcatattgcagtggagggagcaccaactgaactgaatcaagtgctcagattactaaactggggtaccgagcagatntcatcctcg

SEQ ID NO: 18496 - DNA, 1739 bp, Oryza sativa
  unsure (1)..(1739): unsure at all n locations
acatccccatatttatgcnctgtgcaagataccaatnagtatgaatcnaggtgatatnatgtgtggaaaccgattagccatgtgtttccttgattgaatatatttgtatccaagcagagcaaaagcttctttttttctaacaaaatctcagaattccatcccctgcatttgttttgacaagatatatgttcaggctatccttctcttcctcgatcatgaatctttgatcttcttttccctaattattacgtgttagcttgctccttgttagtgatgccataatttcttgcagatgtattgtagcttgaacaggtgccctttggatttggatgacatcgtggatcagcctcactatcatctcaagatggtgtgcatatttggattttgtggcaacacaggccaggttgagctagcanaatgcattctcagaaatgcgttaatattggagcaaatgatcatcgacccaaaagggagatatcggttggatggatattttgggcgccaggaggcaggttcgacgtaatgcccctctaggaattactatcatctcaatggaaacaatcttagttggtcccaaccttctctcagtttcagataatttctgcttcagttcaccattgacgcctggttttattacctaagattgctgacaaatcataaaaatactatgcgtgatgttatataatttccggcctaaggggtgtgaatattcccataattgagtctaacaaaatggtttgcgatcactcatgttccgtatcactgcttgcagccactcatcggcagctgttcgatgatacactcctcaagatcaacaaggagctcacgtacttgcagtttgagttaagagcaggcataaaccagtatgatggtactgtgtattatggagtggtcaataacattgctgatgaagagtcaaagcttggatcaaagttttctgtgccacagattgcattctacaagggattggtatgcaatcaatttgcacttttttttaaaaaatccagctcaatctagtattcgctatattcatgtaattgtatgggcagttggaagcaatagttcatgaagctggaaatgatgggagcataacaaatatcgatgctcttaacacacggattgagaaccaggtatctcgtattaatacccaatcactatgagagcttttgtttctgtttaagcaaatgttttatatttttattgttgcaaacttttatggtagtgtgacaaatgaaagaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcataagatcatttcttgatctccgaagttggttacgtagtaatgatatcccatcatgtgaggtctgcaatgaagcttgtataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18497 - DNA, 746 bp, Oryza sativa
  unsure (1)..(746): unsure at all n locations
cgcgcgccttgattgtcnaatnnnnnnnnnnnnnnnnnnnnnnnnnnnnnnnnnnnnnnnnnatgacaccggcctgcaatcctgcgctcggcagagctgttgctacagctagctcagagtgattaggacagtaaacgcagctaacgctgcccatgcgaagattttctagccccatgctgctctgctccacacgtactcctacaatgcagacacgcagttgccaggccggcatcgtccaagcaccggtgatgcaactaccactattactactacggcagtttggatctaaactttagtcctttttcatcacatcaacctgtcatacacacataacttttcagtcacatcatctttaatttcaatcaaaatctaaactttgcacgaaactaaacacagcctacttctatctctcggttcaaggacatgcaagtcttgccttcatgagtacctggctgaacgttactcctgctcccttgtctcacatataaaagccaatcctaacattctaagataaaaatagtagaaaaaaaataaccaaaatacctctattattgagtaatggtgatagatagataaatagtattgaaggaataaaacttatcattttatgtgttgatagtagatacgatggtagagtgatcttttgtgggacaaaatcaaatttagaagtttgagtttttttagacggagggaataaaaacagtgagttagtcgccaaagcatctacgactacgtaaaactatccg

SEQ ID NO: 18498 - DNA, 1619 bp, Oryza sativa
  unsure (1)..(1619): unsure at all n locations
cgcgcttgaatacaatagcngcacgcctgcaggncgactctagaggatccccatgtaaaaaacaagaataacaccaaggtggcaccgtggcaaccatttgaaagacacactataatgccactataaatcaacaatttgtagaaagtcgatctagtgtgaataaatcaaatattataaagttacaagttggatacaactttttttaaacaatgttgatggaagaaactctttataatagccatactgtatatcagcttagaaagcatatgccgcatatcatccacgatctatcagataaaacgaactagaccttaatctataactataatagatatcaatcatattctcaatgttcttgtccaatcaacttgactgtgcctcaattacctttggatgcattttgctttatagcctaatatgtcatacccaaatgattttctcaaacaattgttcatgaccatgcgcattgacaacataaataatatgctataatgcaccagcccattaatattcttatttcagctcatctgctcatgtgtacattcaagtttaggctgtgcgtgacccaattattctattgtagtggtagtcctgcctcggtaaatttagatatgtttgtgctaccttacaatgctttatgatataattgtagcactttgggttaactttttctacacgaatcttggtcaaaagcaagcataagcatttgtgctttctgtatacaaacatgcccctacaaaaagggcgatgcaacattgaaggtgaggtcttatatgttcaggtactaaaacaaaattcacatgctgaactgctgatgaatacgtagatgttcatacctcttgttctggatgagtttccgtagttcgttgatgagctgcctttcatccaatatcatcacatttggattcatgtagtcaaaatcaataagaatatccctcaagactttcttcatgtcaggatcccgaccaaccggaacaaaagccccacagtcaaatgccagtttatgtttgtcatatactgctttggaaagagtggttttgccgagtcctccaaatccaacaatagagacaatcttcattttctcgtcggaggcatgaacatcatccccaagggataatatctttacgagcttttcactctgcttttcaatgccaacaagctctgtcgtctttttgtatagcgcctgaaggcgaggatcgatggtaacaggacctgtaaccttggcgataatgttgtccaccatgtacctgtcacgccttgcagccacctcctcgactttcttgttcacgtcttggatagctccagcgatcttatggtgatgcttgcacttgttgaagaaattagccatcttcttccggaagcgcctgagcatgtgtgtgtcaagaggctcaggaccatcgatgtgcaccaagaaagcgtcgacgacgtcctccatgtcgtaggacagctccctgacatcccctggccagagcttgaccagctcgtcgagctggtctggaggcacctcaccgaccttgaggaggacagcattcatgctctccagctcctgtgagagatgcttgatcttcttcctcacgcctttgtgcaagtcgtacttctccttgagtacctcaaccagt

SEQ ID NO: 18499 - DNA, 1487 bp, Oryza sativa
  unsure (1)..(1487): unsure at all n locations
aaagaaaaataccaagggtttatttctaattttttgtgaantctaataaaaataagaaaaaaagttgtccatatataggccacccccttgcctcccttcaaccgtccgtccatcctctgtcaagttcgccgcgcgcaacactcgcagcagagcatccaccgatcgtcgatgctcacccccgccatgcacatgctggattcctccacctcctcctccccttggcttcctcccgacctcatgcctcccccgccgtccgccgccactctccaccgccacttccgcggcgccgccgccgccgccagcaccagccgccgcatcgccaagcgccggccgcgcccgtcgcggcgcctgcccaccacctacatcagcgccgatccggccaacttccgccgcatggtgcaccaggtcaccggcgccgacgacctcccgcctccacctcctccatctctctcgccgacgacgacggagctcttccgccacgccgctccagcgggctcgcccggccctgcaggcgcgctgatgcttcccacgctcgacacctcggcgttcctgctcggccgccgcgcggagccgacggccgcggccgcgccgtgcgacgtgtcggtggcgttggtaggaggagcaggtaatagttacagcaacaacagcagcagtagcagcagcggcaactgtggtggtggcttccccaccttggactcatgggatctcctgtaaatctagatcatatattgtcgatttccgattcttcatggctgtaattaaccaagacaagatcgatgaacaggttggagcatctatctctctgattctctgttcgtgtccttgttaattttaagcttatgcctcatatacacatggacgagtttttttatcagtagtgttattttattgatctaactttaatttggagttccttctcttttaattgaggcgactgttaagttcgttttgctcttccttctgctgtttccagcatcactgcatcagcctcaaggttcttaatttatgcaggatttgattcttgtgaaactcttttgctttgtttgattgattggctcttgcttttccattggttttcagtcttgataaacactccttccaacagtacaactgctccagcaccatctcactgaacatgtggtttctgatcatttggtgaacaaaatgtaacaaaagatgtttttttatattagtacattttagagaggtgcttagtgcattaattcagctttagctatataatcaattaatgcaccaaaccactgtggggggcagtagcatgtaaatgctgcttagacactaagatacgttaggatgaagctaacagttcaattggagcagagcagggttgagaatcagtacttggaaaagattgattgtgagatacaacaataataatatcgtaatcatcgagccaggtttttttttagaaaaataaagtattgcaatcatatatgcacacgcatactaaggttcgggcgaagagn

SEQ ID NO: 18500 - DNA, 656 bp, Oryza sativa
  unsure (1)..(656): unsure at all n locations
ggggcntttgtatacaaactattggctgccgcagtcgctttgttgatcccctgagcatcttcagttcgaaaaagcgtttcgcgcagttggacagacacgaggcttcgttgttgctgaagctgctttcaatgctcccagggatgcatttgtcccagcaaacatcagtcagcttcgccacgaactcgtttgccattgccttcctcttctcctcctgaagaggggaagaaaacaaaattgtcagtaacatttgtgtgagtaacaatcaccacggttctgcaattgaatagtggatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18501 - DNA, 3531 bp, Oryza sativa
  unsure (1)..(3531): unsure at all n locations
cgcggatganattctgctcggtacccaaataaaataaaatgttaaaaataggcaagacccaaggtaagtctcctggaaaaaaatggggtcctcccctcttatctccctcctactcctctctctcactcagcgagtacagagagagattgccaccgccactccactacaagtgtactcctccgtccaaaaaaaaactaaacctagaaggggatgtgacattttctagtacaacgaatctggacaaagggctatccaaattcattatattaggagatgtcacatccttgcctagattgtgtttttttgggacagagggagtacacaagaaggggagtataggggagggcctccatggatcatctccgagtggtacatggccctccgttttatgctactgctaggagcatgcctcctagggtgtaacctccgccacttggaagccaaccccagctcgccaaccgtcaccagaggcatgccatcgaaccatgctgccagttggaatagagagggccaaggagggttggctcagtccggaggaagagtcactcaagttcgacggggtgatggcaagcgtggtgctcgagctcgagcgagatgttgccaaggacttaaaggctcggggagctgaggcaccttgtcatgatgtcgatggtgcaactcgacagaaggagtagcgcggggacagagcaactgcttggaggtggccatcaagtcaagggagtatagtatggtgtccagttcccactagcaccgttgtcaccctctcctccatcacatccaaagatgtcgttgttgtcctggttaaccaccgttcgagacttcgagctcaactaccaaaccgaacctcatcacttccctatctttgagaagatgccaccaccacacaggctgccttcacagtttggcgagggaaccgagagaaaaaagagtgggaagggaggagagatgtagtcacttacatgtggaccctatatttattttgttaatttctttgatcaacgaaaagccaccatagttgagggagtcttgcatcagctttaatagtggaagggatcgccaattttttcgggttttacggttatgtgatacaaatcaaatcagatttgcccaataattgagcgagtaaaaacgaactttttcctactttttgcatcacgcctgatgatgcgtttgtgatattgtgggcctcaaccaggtgcaagcactcccgtcctgagtccatcgacgcatataattttggcccggaactccaattccatcacatacaatatcggcccagtatgtttgtgggcttccggcccaaatcgccttgggctgtagcctgcgggtactcaggtctctgggggagtcaagggtttaacccgtcctgcgacgcggagcaccggccgccgctcgccgacgcaagacaacgacgatgccgagcttccctccgcccggcgccgtcaccatctgcgagatcaaccgcgacctaggtgtgctatctccactccctgctccccctctctctgctgtctccaagctcattccaagtctgtgcgttgcagttgcggcggatgcggtgtccgacgatcgagccaaggatgcctacggggatgtcctcgtcagtacactcccatcttccccattcttcctccgcctcgcataatttcgtctttcttttttcattcacaacactaattttattaggcctctaattgaaacttcaatttggggtttccagggaatggtcttcagcccgattcctttccagccggatgcgattgttgcccacccacgagcctcctgctgccactgaagctgctgagcctgctgagattgtccccagaacaagtttagcttccaccatagctgagtccttcaaacaaatgatcttcccttcatgcgatgtgagttgggtcttcatcatatcttactggctccatgtctccattgcttgtgttcatggttatattgcttttctgtcatacattgacccattctttttgttcacccaaaatctacccacaagcatatttttgtgtggaaagtgctcaggatagattttgtaaaaactgtacttacgacaaaccttttgtttttgcagccaaatctgctacaagaaattgatacccagaaagtaagttggaatccgcacaagcattgcttggcatttgtatctgggaagaaccaagttacagttcatgactttgaggagccaggtgagatctgctgaactttcttatgttgtattaataagatagatatgatgaactgaagcatgatggctatatgaacatttatccttgtatttaatgaactgaagtatgtttctcaactcagctaaagccaacaactaatcatttgtattctctgaacagataataaagaatcctacattctaacaagtgaccatcaaaaggatgttaaagctgttgaatggaggccaaatagtggaaagatgattgcagttgggtgcaagtatgtcctactgccaccatatactagagcactattaaagatttgttttgatattcttttcatgtcataatacctggtggcacaatctactattaggttaacttattattattattattattattattattattattattattattattattattattttcaggggagggatatgcctctggtcagcatcatatcctcgcaacgttgcatctgtgaaatctggtgtcacctcttcttcctttggtgcctttcctaaaggttctggtggtcaatggatactcgtggacattctccgtggttcttctgctgagctagttagcgcactttgttggaaacctgatggaagatatcctttataagttttcagtgtagcatttaatcattggtatcattgatttccatctctgttatttgaaaaataaagaaatgtaacctaaaccaaataatatgtcttcatttgcaaacacaaaaattaccagtgactctagacaattttccttgacacatatctccacatacttggtgtccgcctcttgtaatagcccatcattcacaatttgggacgtttctcaaggtatataaatgtcatcagaatgcagatacctagttccatcttacacagaactgcatactaatatctgtggattttcttccatttcagggttgggaatgcctataagacgtggattaagtagtatatcattagtgcagtggtcacctagtggagattaccttttaactgctaagctgtatgaacttcaactttagttattttcattactcatagcatttgaggatttatatagtttactttttttaattagtgatggaacttttcacttatgggaaacaaatacatggacgtcagaaccatggtcttcatctaatggatatgtatctgtaagtagtattcattcttaaataagtactgttcaacatttaacattgttatttaccatgtcacaaggaatggattcttaataagtcatgaaatgaaagggcaaatgctttgcatgttatgggcgattgggttgtgttttancgggacgaagcgcanatgcattcaaagccgcg

SEQ ID NO: 18502 - DNA, 695 bp, Oryza sativa
  unsure (1)..(695): unsure at all n locations
gcgctgancctattgaatccattcggacccccgcatccctacagaaggggttcacgtatgcaagctttgatgggacccaaccctctctaaatgtgctggtctccaattagtgtctgaacggccccagcctgtgtaatgcgtactgtgcgtatgagcaaaattccgggttcagcgccaacaccctttaatgctgaacagcttttgaaacaggcgatcttcgctgtcacatattccttcacagacagctgccaacaggggatgatgcacactgctagttattatttggactcacttgaaaaggcagacacgagcttagatatcgacaagtcaagtggatgtattcgaatcacatgtcggctgtttcagagctatccacaagaatagatataatatttctttatagtactaacagattattcccaagtaacaaaacagcatgcagatcacatgagagcaatgcaatgacgaaaaaatcattagtagagataatcctatggatatatatacaatagagcactactaattgcacgttccattttcaccactgcgcactacttgatttttttttctttcaggatcttttaatgttacaaaaaattattcccaggttaaaaagaaaatagcatgcagatcacatgatatcagtcgatgaccaaaaaaatcacaattagtngatagaatcatatgaacatgtg

SEQ ID NO: 18503 - DNA, 783 bp, Oryza sativa
  unsure (1)..(783): unsure at all n locations
ccgtgtcaaaatatgctccccaatgacaaagttctgtagacgccatacatacgcttgtggagtatccgtatggcaggtaacaacgttacaccaatcacgtgagcgtatctcagctgataacagaagcaaaaggtttctcagcttaagttatagttttttttttcatacaggcaaaaatataaaaagaaaagggtgcaaatcagcaactagtttacaatgcacagctgccaaacataatgaaacactttgttacacaagcgctaagcaaatgaccagatcaaagatgttggaggacatagtttctgggtgccattttcattccacaaacataaaaagcatttattaaaatattcacattgcaatgtcctaatagattatgaatactgacaggcaatattaaaaggccccaattggaaaatcttcagaggtcacactttcattgactttgacaaaggtcatagcagcagtaaaatcagatagttctgaagaactaaaagaaactgcactatgaaatgggggtcgtctgttgtacaataggcatcctacatcttactacaaaagtttatccacttcttcaactcttatttctgttgccgctgctctccacatgtgctcctttgtaatggcatgtttataatttccagaatgtagttgtttccattggaatacaagcaatttctctaccaaggagaaaaaagnnnnnnnnnnnnnnnnnnnnnnnnnnnnnnnnnnnnnnnnnnnnnnnnnnnnnnnnnnnnnngaactgcaatcatcaaggcctcc

SEQ ID NO: 18504 - DNA, 942 bp, Oryza sativa
  unsure (1)..(942): unsure at all n locations
cctccccttaggacagcgcgcggcaatacccggcgaacctcacaacaagtccaatgttacctcgaaaagatcccccttaccaggatggaaatgaggccgacggcaacgccgagacctttcatggtggccggtagagccataatgccgcccccgataatgaagttggcgagtttaaacaccactggcgggcacgccggagccctcgggtggccggcgggcccgtcgccaatgagcggcaggtcgtcgttctcgccgccgccgccgccggcggcggcatcgccgtcgaccaggaacgaatcttgcttggagatcttggcgtggccgttgtagccaacgccattggcgacctcgaatgtgcgctggttggattggagctcgatggaggtcaatgggagggacgagtaattcgtgttcatcttgcttcttggcgcatcaaagattggatcaatcaatcaacaacaaacacgacgagaaattcctcgtcgaatggacaaaactgagccaagaaatggaaaaaaaaatgtataaccaatctacagctccaagaacacaatcttgcccccaaaaacggaacaaaattcgactgcaaactacatcagctgatcagccggtgagatctcagaggggcttggcacacattggtggcatctaccacacaagaaactcaaattttcttgggccagatttggttggagatcgaaacagaaacaagaactgaaattcgtcctccctccgaacaaaaattggaggaaagagagggaggcgtgtacctaaggattgggacgagagttgagagatttgaggcgttgaaactgtggagagatctggggttctatctctctctttattttattttattttnnnnnnnnnnnnnnnnnnnnnnnnnnnnnnnnnnnnnnnnnnnnnnnnnnnnnnnnnnnnnnnnnngggcgactatggcgg

SEQ ID NO: 18505 - DNA, 974 bp, Oryza sativa
  unsure (1)..(974): unsure at all n locations
ntagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtagtagtgagcaaatcgcattgagctaataccacaatcagtaactagcccctgagctcgaaccatgacttaaatacacaatcaccgctccaaagcatctcaaatcacgcgttctaacttgtaccagatcaactcgctccaccaagctccccgtaagctactccgatttgagacgcgagcacacaaggccaagggtggacggtggtagggcggcgtgggggtgggagacgagcggggagaaagcagctcacgttgtagacgtggaaggccttgccgacgctgacggcgacgaaggtctcggtgccgaggcgctgcacggagaagggcacgccgccggccgtgatgtacccgatggcgcggaacggctcgaagatccccatctccctctctctctctctcccaccgcggcggcggcggttacttctccggcggctgctgctgctgacgatgcttgtcgagggtttggccgctcagcttgggtgggggtgcgccgccggcgagggttttagaggtgggggttttggagcggcggcgggagaaggaagggtggacgctgtctgggtaggtcagtgttgttgcgttgcgtgatgatgaggtaggatgggccgggccgggtgatctggaccacgagggcatctgggtcctggaggctggagctggaccgagcccaagttgcgagttctaaagtttctttctttttatttgtttttcagttttnnnnnnnnnnnnnnnnnnnnnnnnnnnnnnnnnnnnnnnnnnnnnnnnnnnnnnnnnnnnnnnnnnnnnnnatcatccccccagcg

SEQ ID NO: 18506 - DNA, 827 bp, Oryza sativa
  unsure (1)..(827): unsure at all n locations
gggggcnnattgacattgtatttcagcttccatnnnnnnnnnnnnnnnnnnnnnnnnnnnnnnnnnnnnnnnnnnnnnnnnnnnnnnnnnttcaggtttttgactgctggtttgagagtggttccatgccatatgcctacattcattatccatttgagaaccgtgaattgtttgagaagaacttttctggcaactttgtggcagagggattggatcaaacacgcggatggtttgtttcacttcatgaaatttcacagctgttttatacttgtgtctggtactaataattttagggtgcattttcttcttttgcagttcatttatgaccttggatgatatttcatgattatgtaccatgtattcttgtaacatacctatacagatcatgaatgatgaaagtggaacaattagttacacttaccttgaattcatttttgcttgttcagaaggcatgtgatgttattcatgaattattatggttgaccatggattgtctgtagtagttttgatagcagttttttctttcttcaataatattttacactttttgggagaaaaaacagtatcctatgctattttatgttttatctgggttaactggtagcaatgatctggtgttgattaaaagaattctgtaatgcttgtgcttttatcacgtttactttatgagattttggtgggcaaaaactaaattcagttcctgctaatgatattagtggaatccttgtgtattgtgttctaaaatgnnnnnnnnnnnnnnnnnnnnnnnnnnnnnnnnnnnnnnnnnnnnnnnnnnnnnnnnnnnnnnnnnnngggttcaatcccac

SEQ ID NO: 18507 - DNA, 1463 bp, Oryza sativa
  unsure (1)..(1463): unsure at all n locations
tcggccccnatgatttgcacatcannnnnnnnnnnnnnnnnnnnnnnnnnnnnnnnnnnnnnnnnnnnnnnnnnnnnnnnnnnnnnnnnnnnnnnnncaatgtacaagacatgtcgtttgtcatttacattgcaagggtttctccagtggtcacagatgatctccttgtccatgccgctggtaaatacaaccttatctgatagggtgtacttgtctattttcgttgttaatgtcttggcattctctttgttatattctgcatggtaacataagtgtctactttgatggaacaggcaaccgtgagcattttgatgcattaaaagtatatttactgtcaaggtctatttccagattgaagaatgaattccaggctgggaatggcaaggtaaatctacaacttctactgaacttttttcagaatacttgttcttcatgccttaaattgcctttgttcttacagattacggtggatttcattgaaggcttcccaccaattgatctccagctgggaaaacatgtttttcttagtacaggagatttctacctggctactcgttcttgatttttctttcaagcatcccaattttgagtgatttatctttttttttactgcaatcattttaccccgggccctattctatttgtgcccacaaagcaatgtatgtggtttcatctgccatgaaagaatgaaaggggtactatcatattgaatggtctaatcgaaaactcgtgtatgctgtactgaatactgatacacccgtgttcatgtggctacacaccgattatttaattgtgccaatagcggttaaagcattcagttaattgtctttactacaccaatatgagttgacgtgtgtgaagtgggaatattttggagaaattcatcgaacttgtccaaactatttcacctccgttttatgtcattctttgaagggaatcctgtgccgtctatgcctgtctgttgttaccaagctggatatatcctcgtaccctcgtggggcccttctctctgtcaagcattgacgtgactggccgttctgttggacagcatcataattcataaccgtcattttcagtagctttgccagtgatactggcctgccatttgaacatgcgctggctagagagcctgaccaagtaggcaatggtcagtggtcacccaacgattgtacccccaactgctgctatatttcgagctatactattttcttccaacagattggtgtcatccaagtccatgccatggcattttccctttttagtctaaaataatagcgcctttacatcgacggacatcattatataggagtactaacgatgtctgctgtgcaatgttaactggttaagaggggacaagcttatgcctttgtcggtcatcctnnnnnnnnnnnnnnnnnnnnnnnnnnnnnnnnnnnnnnnnnnnnnnnnnnnnnnnnnnnnnnnnnnngggtctaatggactac

SEQ ID NO: 18508 - DNA, 1436 bp, Oryza sativa
  unsure (1)..(1436): unsure at all n locations
cggcncccatgacttgcanatgannnnnnnnnnnnnnnnnnnnnnnnnnnnnnnnnnnnnnnnnnnnnnnnnnnnnnnnnnnnnnnnnnnnnnnnnatttggagggaataataatcggagtgaggtgcgggagcgagagtctttccatgatgacatgcgtgtaacaacttgggtcaacgtggctttcttctggctcactcgtactccctccgtttttaaaaagatgatatcattaacttttaactacatatttaattatttatctttttccaaaactttataattacataattttttttaataataagaacgttaaatgtgtgataaaaactcaacaacgtcatctatctaacaacgattgaccccgccgtgggcgcctgtgctggccgtcgatggtccgtactagcatcgtatccaccggcagtcaagacatgatctattgatctccgagtccagtttggtttggagaaaattgatagagagtatatatgggtctgggagctttggatgttcatattccagtacctgacgaatcgaattttgagtccgagtcggaattgggaacacatctgtccagccaatgaatacaatcgtgcagtctcattggtacgtgtacccaaccaagtgacaccaatcgttgatcttaagagaagtttaatattatagcccactattagctccaatttatctatagtcaatctaatagccaatttatataatagttgattactttactactaatatatggtcccacctatcatatacacattatgtcttggaatccgtgctgtagctggctacatatctgtagcatgctgctcttctctctcatcttttatctcattaaaatatatttacagctggctaatagcctgctattgtacctgctctaatttgtctgctgctgccatctcatcatggctggaaaaaagaggcagaacaaaaagagaggagacgtgtcgaagccatcgcaacgacggcaagcaaatcagcgcagtaacgcactacccgcggaacagaaacccaaagaggacctgatcagcaagctccccgatgacatcctcgtgcccatcctgtccatgtgcccctacgccgacgccgagcgagccgccgcggtttcacggcggtggcagcatctccacacccggctccccaacgttcggttcagcatgtccgtgcaggggcttctcgcgcctcttggcgagtcgagcaaaccgcgcgtgcagagcatggcgcgcacgcttcagcggcgctgctgcggcggcggcgacaccgtgaaaacgcttcacattggttaccggaaggacgtaccgttcgagtgcaggtacgcggaggaattcgtcgcgcttgccaacaccacnaaggctggagcctggcgtgcaatgcccgagggggctcctctaccaggaccctgcgaagtggccctcgagcttgct

SEQ ID NO: 18509 - DNA, 871 bp, Oryza sativa
agaagagatcaagctgaaaccagttattgcatttgattgtgggactcttttggtctttgcaatacttctgtgctttttactaatgacatatatagggatactgttctcccacttctgtttttctgaataaatacaagtcactggcagtaatgatactgttttctatttttatgccaccaataaatattctaccagtactatggccattgaaagtagcatcagacagggaagtgcacccttttttctccttggtagagaaattgcttgtattccaatggaaacaactacattctggaaattataaacatgccattacaaaggagcacatgtggagagcagcggcaacagaaataagagttgaagaagtggataaacttttgtagtaagatgtaggatgcctattgtacaacagacgacccccatttcatagtgcagtttcttttagttcttcagaactatctgattttactgctgctatgacctttgtcaaagtcaatgaaagtgtgacctctgaagattttccaattggggccttttaatattgcctgtcagtattcataatctattaggacattgcaatgtgaatattttaataaatgctttttatgtttgtggaatgaaaatggcacccagaaactatgtcctccaacatctttgatctggtcatttgcttaccgcttgtgtaacaaagtgtttcattatgtttggcagctgtgcattgaaactagttcctgatttccccccttttctttttatattttggccggtatgaaaaaaaaactataactaagctgagaaccctttgcttttgttcacctgaaaacgctcactgaatgggtaaccgtgtacctgccatccgtactcacagggg

SEQ ID NO: 18510 - DNA, 1451 bp, Oryza sativa
  unsure (1)..(1451): unsure at all n locations
acgtccnaaatgaatagccnnnnnnnnnnnnnnnnnnnnnnnnnnnnnnnnnnnnnnnnnnnnnnnnnnnnnnnnnnnnnnnnnnnnacaatgctaaaagggtatatgatagaggatgtgatgggaataccaattttggaaagctatcgaaactggggctagctcctgtactttggtgtattattgttggcttgcttgctacatatatacactctgttatatcaggtaagtaccatttccaatgtcgctcactccatttgatctcccacgatgcagtatttactacatttcattctttcaggtcaatatatcatggatatgacagcaccatttgggctgtttgcatggtcaggagttttccttgcaactgctggcctagtcatgttctataaatgtagcaggtacttacgaaaatgaagattagttggcagttagtattaaaagttgaaaactcaagatagcatggggacatattgccagcatgttgattcttgttagatactgcttcacaaatttcaatatagtaacacaattcattatatattttttcatgttgacgcattttacatcagctgacctgcttatcagaaatgtggtagatgttttacttatatggttatgcccttctgttcttgcattctttatctgttgagcattttactgtgtgtaaatagcctgctattcttctgttacctacccccatgatcgccagatgagatatgcagcatttattgattatcctttagctgcatcatgacattggcctatgctatctgcaggaaagatcctggctacatcaaagcaaatatacgagattcacaaaatcaaagggatgatgtaagtttgaaatattagcttagttaatatagctttctacaggcacatttatcttctctttggactcgtgtgaatcttgtttgattcatttccagacttaaagccaaacaatatatccaaaatttcacaatcctaatcatgagtatttattcctttaggaacctttgttgaagttggagttagacaatcccgcacttctgtctggtaactggtcacagctttgtataacatgcaaagtaagtacagcattgtcgattagttttctctttgctaggttgatatttgggcctctgattccaagggttattctacagattgtgagacctgttcgttcgaagcattgttctacatgtgatcgctgtgttgagcagtttgaccatcactgtccttgggtatctaattgcattggcaaggtacttacgttcttttgggtatcactgtgttgagtagtgatcaaacatggttgtcatctcttctggagatgaaatggataacttatgtcttaaaatgctgaacttttannnnnnnnnnnnnnnnnnnnnnnnnnnnnnnnnnnnnnnnnnnnnnnnnnnnnnnnnnnnnnnnnnnnnnnnntaatgtcatcaaggggcccg

SEQ ID NO: 18511 - DNA, 731 bp, Oryza sativa
  unsure (1)..(731): unsure at all n locations
cgcccccatgatgacactcagttacnnnnnnnnnnnnnnnnnnnnnnnnnnnnnnnnnnnnnnnnnnnnnnnnnnnnnnnnnnnnaaatgaaaatttcccttctagcgaagagaaggagaagcacgcacgcagcacgtgaacttccagctctaaacccttccccctctcttggtccaagcccctcctccccttacccccccgacgacgccgccgtcggcgtcttatcacccgaaaccctagccccattcgccgcggtcgccgcctcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttctacgacgggcccccgttcgccaccggcctcccgcactatgggcacatcctcgcgggcacaatcaaggacgtggtcacccgccaccagtcgatgcgcggccgccacgtctcccgccgcttcgggtgggactgccatggcctccccgtcgagttcgagatcgacaagcagctcggcatcaccaaccggcagcaggtgttcgacctcggtatcggcaagtacaacgagacctgccgcggcatcgtcaccaaatatgtcgccgaatgggaggccgtcgtacn

SEQ ID NO: 18512 - DNA, 747 bp, Oryza sativa
  unsure (1)..(747): unsure at all n locations
ccgatacagttggttgacaatctgatnnnnnnnnnnnnnnnnnnnnnnnnnnnnnnncttccaatcttataataatatttggtgttatactgcaaaacaatatagtaattttatatatttacaattttaaattggaactaacaacaaaataatgtgcacacagagtattttgttaatgcatcatactagaatagtagaactattccacagaactaagaaagtgtgtgaaaataatttgtgcaggtgagcatcgtgtttcaacatgataaccttactcaattgaaatttgacgaagaaaagttctctgtcaaatcaaatttgtgcataataactctaagtttacagctaaagtagatcattatggaattataagtgagaaggttgtgtgatagttacttagaatatgtctaagctgtttacaaaggaaacatgatgttgtaggttattctattttagtattttgcatgggtaaacataatgttggacaaatatttctacaattgtatgcaagtataaaatgcaaagcctaaacgatatgaagaaaatgaagtctagtacctcaagaccatcaacaaggcaatggtgaatatatccagatttatagtcgtaaaaggtataatttgttactgttccttccactctctgatcatactggtgctcatttttaccatagagcacctcacttggtccaggttctgctacagtaacccatgatactataacagcttttccattatagtccacctt

SEQ ID NO: 18513 - DNA, 802 bp, Oryza sativa
  unsure (1)..(802): unsure at all n locations
naagcaattcggctgattctttcgcannaatggcctcgtcatcgtcatcttcgtctgagtttgggggattggaggaggtatgatgcatgggaccctgatcgtttatagtggtccgagcttgccattgcaagcaaagatatcatcttcaacgatggcgtcccatgcaagctacgtgcaaaaaggatcatggcattttttttctgccttttcttcgtcccaattgacctttttcttttgctggaaacctggaatatattccttaagaaagttcacaagaatatataaaaaataggagaccacttgcagcagcagtaatggctgtgacaaggaaatgatcaaatgaagatagtagtggtagaagaaaaaaaaaagatagtatttgagcaattgagctgtaccaattgctccttcagtccacttgctgtactctactcatcagtactgacaatggacggataaaatacctactgggatctcttttcttccatgagaccatgaccatccattatattgactctcaaatcttcagtaaaatggagcataacaggagcaagcaaataggaaaagacaatgggatctgccttattttctaagaaatggaaccattccattcagtggcgtgctgcgtgggctcctaaacggtgcgattttgatataaactttctatgtatatgaatttcttagaaaatattttaaatctattttttaannnnnnnnnnnnnnnnnnnnnnnnnnnnnnnnnnnnnnnnnnnnnnnnnnnnnnnnnnnnggagtagctggcgatcagtngttcaatnnccac

SEQ ID NO: 18514 - DNA, 777 bp, Oryza sativa
  unsure (1)..(777): unsure at all n locations
acgatgctgttnnnnnnnnnnnnnnnnnnnnnnnnnnnnnnnnnnnnnnnnnnnnnnnnnnnnnnnnnnnnnncattcttcaatctggaaatagaccttgacagtaaatatacttttaatgcatcaaaatgctcacggttgcctgttccatcaaagtagacacttatgttaccatgcagaatataacaaagagaatgccaagacattaacaacgaaaatagacaagtacaccctatcagataaggttgtatttaccagcggcatggacaaggagatcatctgtgaccactggagaaacccttgcaatgtaaatgacaaacgacatgtcttgtacattgtgagactcctcacagatcattacctgccaaaccagacaaatgacaatgagattaaatgttttatatccatttcaactcgtgtcaacaccaattggtggtgatgatagtgcatataacttggtgttcatgtaagaaaaatcaaatcctccaattgatagagataaaagtcagttaacagtaaactgaaacagggagaatatccaaactcactgcatctggtggcgccgccatctttggaattagtggattgccaagagcatcccttatatactgatcctgaacagaattacagtagctttcattaaggatgttctgatttatgaaacaaggaccaattacttatgccaatttagctgacctgtgactgcacaatctctactagagtattcttgccatcgtccataggtttgtaatatacatcaactaagtctgtcggttn

SEQ ID NO: 18515 - DNA, 9092 bp, Oryza sativa
  unsure (1)..(9092): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatttgaacatctccaccttgttcagttagagaacctccgacagttgtatctcttcaccgtgaaatttgagtgtgtcgttttgcatcagttacagaaccttgaggagctgcatctttcacagatagaaagccaaaagtctaacaaaccggtttgcatcgagtgtagccaaccacttaggaagctccaaaagattgtcatgaccaaaataataaacaaagggttacaaatatccgtgcaaggaggagagggtgacaaaaatttattcccgggtcttcagcatttggaaatggaattatgtgagaatttaagattccaaccatccatcccgaggagcacccattacatcatatcaggggaaatatatttcgataaatttaattaccgtagaatattgggttcgttcctgttcccatcgttcaagcaagtcatggggacatcaatccctggatcaacatccaggatggaaatcaagaacaccagtggtctatcttccgaaagatggaagagcattccgcacctcgagcttctaaacatcacagaactaacaatagacaaatgtgttgatagttgtccagtgccaaagtgcatcctgggctggaagtccctccagaagcttgagatacggagatgcgaggatattgaattgcttccagaatggttgggagagatgtcctgtctcactgagctcatagtggagacctactggatggaagctttgcatccatgcatccggcggctcacaaatttgcagagcctgacacttataacatgcttgaataggtttaaagaaagatgcaagtcaggagatgactggatcaatatcaagcacattccgcatatacaaattacagatagaaatgggcgtacggagatcatttcaccaagttgtacctaacttctaacatccgctgaaaacaaaggtacaccggatactctgctgtttttatacctcatgcttccactgtaggccatgcaatagctcaagctaagaattttgtataagaaaacaacagcagcaggaagttttttttttttttgtgtataagacaatgcgaaacatctacgtaccattgtttatttcttatgacggccttacgaggcagcaacatctcttttggactaggacattatttgtacccaatttaatacttgatactatatgccttgtgttttctttgtgcaatcatagatgaattttgttagaataaaaaaatagatgaactttgatctcttgtattaacatccatcatattgaattattgagtttgtaagcttttactgagattagctgtgttattttccattgacaatgtgacaacctgcagttcttgtgcgtgtttggaacgaagtaactaattgctatactacgttgcagttattcattaccaatagccactcaccaattgtttgataatctcatgcagcattagtttcgacagagagagaaaagaaaattgaggagctagctgatcagttgctgggacagtatatagcaggaagatattaaccggacagcccatcagcccagagtgtaagttaatggaataatcttttgccattaatatcatgtacacatgtaaattagtgatcatgcgtgacaatggtgctctgttttcttcagttgccgatcaaggatcttaactacatgtctacatggtactgtcaaggctctatgatgaatagattgtttatctctgtgcgtgcaagcctttctgctgcatattgtacaaacgaagcctcgctgttccatagtatgctgaggacttgtgttaggttgtatgctgaatagtgaatacatatactccgtaccaaatgttaaccagctggttttcccgtacaattacacgaaccatttgaaagtaattgtagctgctgtggaattatttctgatggacaacgtactcgtacattttcatctatcagcatacatggttgtaatctggtcatcatgctttgttctagattaatgccttactctgattagcgtggtgatttcgaggccttaataatgaacatggaggctccacagcattatttcctttttgtggccaagcatgatttaacctgaggacaaaatgtcaaaggcctaacgtacgtatggcaacagaggatgagatgaaggccttgtttagttcccaaatttttttcttaaaaacgtcacatcgaatctttggacacatgcatggaacattaaatatagattaaaaaagctaattgcacaatttgcatagaaatcgcgagacgaatctttttaagcctaattattccatgattagccataaatattagagtaacccacgtatactaatgacggattaattaagcttaataaattcgtctcatggtttccaggcaagttatgaaattagttttttcattcgtatcaaaaaactccttccggcatccggtcaaatgtctgatgtgacaccaaaaaatttctttttcgcaaactaaacaaggccgaagagcaagatacgaagcccatattccatgccttgaccgagaccatcaagctactccaccgtgctaaaatataaaagatattggatgatgtgacacattctaatattatgaatctgaacagtttttatgtccagatttatagtactagaatatgtcacattcacccaaaatattcttacattttgggacggagggagtaaaagagaatccacaaaacaacatcatcggtgcgaatcgctgtaatggctaatgatccatacatactcctttcgttccagaaaaaacgaatctatgactggatgtgacacattctattgctacgaatctggacatacatttatccagaatcagattcgtagcactaaaatatgtcatatccagtactagaatggttttttatgagacggagggagtacatgtctgtcgatactacaacaagttttctctcggagcagcttttaattggttcgtgtaatttcttgtcaattactcctttcctttcaggctgtcaattactccctccgttttaggttataagacgttttgactttggtcaaagtcaaactgtttcaagtttgactaagtttatagacaaatatagtactaagttagtttcatcaagtcaataattgaatatattttcataataaatttgttatgtgttaaaaatgttactacttttttctacaaacttagtcaaacttaaagtagtttgactttaaccaaagtaaaaacatctaataacctaaaatggagggagtaacttttgtcccaaagaaccgaactgccaatggaatggcagaaaggaaaacagggggcgaaaaatgtactatgtgattagggcgttcacggtggacttacgtgacgttcagcctcgccctccctagtctgcaaaggaaaaagcacacgccacgtttgcttctgggcccaaaaaaaagtttttgtgtccaaagtttgccaccgggttcttggaagaagctactcatttgtgtggagagaagctaatagtactagtactcatttgggtgagaagaaaaaggagagagataaaaagtaaaaagtttgtcaccggtgagacccactactagtatttgcactgtgaagtatgaagcttacgaggttctttatctacgtggcatacgagcaatggcaaaaatcggtgacacactgtgattgcccttagataggaaactgggtgtggaatcggcagcgtactgactgccaagtccacgacgtcggtcgtactggtttgattccacgaggcggccgactgggtcagtccacaataatcgtgtataatactatcgtgtaccgctaaagagacgcgatcacgcgaacgaagaatgacttgtcccgattccaggtgcgaaatcgatttcctgatatattttttttctctcgctggttgtcgttcatggtttcatcggagctgttgaacgcgtaatcgatggaacggaatgccatccgatccatccaagccagcctgctgcggacttgccgtgttttgtcaccgtggaatggtggactccaaggcgatggatccatcgtgcagccgtgcatgaggtgatcactgcatcttttggcttatgcctatactcgccagccaaatttaaaatttttaatcttaaatttaaagttgattttaagagtttttttattaaagtttatttttcagtctttacttatagattgataagaacacatatatagaagttttgataagaacacatatatagaagtttcatttcaggtctccaagtcgacaacggttagatgtgttattccaaatattgtactagtgtgattatgatgaataagagcaacaccggcttcagccaacagaagtaacgctattacctatcagataagaggcctgaatctgtataaaaatcattgtctccgtctcttttacttcaatctcgtatataccctggtaacaacgatccctacagtatgcaaaatatcgtagttacgatctcaaacatcggcaataattattaatgttttagacaaagatatagttttcaaaatatgtctttcactatacctaaatgtgtgtttatttttattataatactgtatttgtctttaaactgaatatttttaagttataaaaatttaaattaaaccttatctaaatcattaaaaattatgaaaccagaggagggagtagctcgttaactcctagccaagtaagacttttactgctgttaaggttaggacaaggagagtcgctcattatccactctagagttgtgcagaaaaagaccgaactgaaaagactgagattgagaccgagaaattgggtgaaataccaaattttgttcggtcaatttggttagtctccttaagtgaatagacgaaaaaaccgaattaacaaaatatgtctaaatgcaacctacaatccactaagttcaataggattaaactctaattttcatatccatacttcttctaggcatgcaacataataaaagtctttactcatacgtgcttacggtttttttatttttatttttgtgttgaaaatttccattatttctttgcatatataaaaacgttgttaaatttcggtcagaaccgagaccgagattgaatttatcggtcctgatatttttacattgaatcaaaatgaccgaaaaaccgacaccgaatacccaccctgttccaccctttccattatgcatccaacggtgatgtgctaaacttgcagtcactgtggggattttccttctttttttcagccaatcacagtggagtttcccgtttcaccaccaaccttcgtctccgccgcctccgcctctctccttccccctcgttctccgcttccacccaaaccaaacccaaacccaacttgcgaaaccccaacgaatcccccccaaaacacccacccagtcaaacactccccaactccgatccccacccccatggcgtcggagatcgaggtgctcgaggacaccaccaccacgatggccgcctccgccgcccccgtggcgcccgcgtccccatccccatcccccgccgccgctgccgacggcgaggagggggaggggccggcccctgcggcggaggacgactcgctgaagaacgacgtgtacacggcggcggcgtacggcgatctggagaagctgcagcggctagtggagggggagggccacccggtcacggagcccgacggcctcggctaccacgcgctccagtgggccgccctcaacaaccgcgtcgccgccgcgcagtacatcctcgaggttttcccccctcctgcttcccgcccgagcgtctcgcgatttggctggccttcgtgtagtcgttgtttgctagctagcgagggatttgggtgggggtttggtaggatgcgtcatcaaccaatgcactttatgagccgcaattttatatgtttttgaaccgtggactgtttgttgttatactgtgttggctaggtgtattcacttttagctcattggctggtgttttggataccaaattaccagtgcctgtggttgaattactccaggtttgtgaacaattttgttggtggccaactgcattaggtgaatatggagggtttgggactgctgcaagctgttatagctggaaattgatgtgcttttagtaggtttcggatgtttatatgacctggagatgatgccagtttttcagtatctcattttgtatgttgtaggcttgaatagaaatggaactagtgagactgtgctttggtttatccctgaattttcatatggatgtatgtttattttttccattggatcattgagaatgtggacatgcttactgctggataaagcagatgagaattcagctggcctgtgcagcgcccttgaggtgtttccgtttaagtcttcttttccttttaatcttaagatcatgagtgtatggtaggctcagtatagtctgaataagaaaggttactaattgtgtgcctactaagtgcatgaataaactcgcacataacatgcatactttgatggtaccaggaatttatcttgattgtggtatgtagtcagagtatgttattctctgcatgtagacgaagtatcactatgctattcagtgagcgcattctgcacatataattttgtttgaccggactatgattttgtgcttggtctttgaacagcatggagcagatgtaaatgctgtggaccacactgggcaaacagcacttcactggagtgctgtacgtggacacatccaagttgctgagcttcttctgaaagaaggagctaaggtggatgttgctgatttatacggttatcaggtctgaatttgacttcccttctgtattttggtccctgttttcctggtttgttgctttggttgtccaatgttggttcatgattctgaaagacaactaagtattgttggatatttgtttgccaagttaactgttgtatccacactaggggatcagggatttccagtatataaataaataaataaataaataaataaatttaacctatgaattctctaggtaaaatgaaaagcaagaatcaacaacttttgtctatggcagtgaatttgttaaaaactctatactgctgtttgcaggcaacacatgttgcagcgcagtatggccagacagcatttatttatcatattgttgcgaagtggaatgctgatccagatgtccctgataatgatggaagaagcccactgcactggtttgtaccttgttctctacatttatcattatcttatgttgcactggagtagtagtttctaccagtgcacttagtaatgcatgtccccataaaccttcagtgccccttatatttctttctctctctctctgtttttttttggcatattaccttgtagggctgcttacaagggatttgcggattctatacgtctccttttgtatttggatgcttatagggggcggcaggataaagaaggcatgtgctaaatttatctatttccattattacctgtactgctgtgcacataacagtgtaaaccaatggcttagccatatctccaattatatcagtacacttcagagcatgagatttacttctttactacaatgctgcccctaggttgtacccctttacattgggctgctattagggggaacctggaggcatgcactgtgctagttcaggctggcaaaaaggatgacttgatggtgaaggataagactggtctaactccagcacagcttgctgctgataagagtcatcggcaagttgcattttttcttgtaagtaacatgaaccatggcatttctgtttttgtattatagccattcttttgtagagcccaatgcattaagccattaacagttcatctactagagattctgccaagttacttaatatgatttgcgtaatgatgtttactaataggaaacatttttcttcatcattttaggttttatattccttctgacttataaattctttagagctgagtttcatgtctccatgatgaggtgttattggtgtaattcactgattatgcataattgcatacataagctttctgaactttgtagtttccctgtagattcagtacaagaagctgcaaaattctatgacttctacacatggaaatgatattattgaccagaaatgtcataaactagcataagacataaaactatgtaaccaaggaggcaaaatgctactctttgttgtgactttgctgatgcttatatgctcttatatatttttattatagattcgttgtgagtttgggaaccgaaatgatttcctgactttttgtgattgcacatgtagattaatatccttttcactaattcattattgttaatctagctaatgtcataagagtggtcatattgaccttgaggtgaaagaatattactggtatttcaagagagaatctactggaagatgatccttttgatgatgcttgtttatttagacagaaacaagacttgatttgatgattgcttgcaggacaatgctaaaagggtatatgatagaggatgtgatgggaataccaattttggaaagctatcgaaactggggctagctcctgtactttggtgtattattgttggcttgcttgctacatatatacactctgttatatcaggtaagtaccatttccaatgtcgctcactccatttgatctcccacgatgcagtatttactacatttcattctttcaggtcaatatatcatggatatgacagcaccatttgggctgtttgcatggtcaggagttttccttgcaactgctggcctagtcatgttctataaatgtagcaggtacttacgaaaatgaagattagttggcagttagtattaaaagttgaaaactcaagatagcatggggacatattgccagcatgttgattcttgttagatactgcttcacaaatttcaacatagtaacacaattcattatatattttttcatgtggaggcattttacatcagctgacctgcttatcagaaatgtggtacatgttttnnnnnnnnnnnnnnnnnnnnnnnnnnnnnnnagcggatctgcaatgcatgcagggggcggg

SEQ ID NO: 18516 - DNA, 24075 bp, Oryza sativa
  unsure (1)..(24075): unsure at all n locations
cgtgctttgttgncatggannnnnnnnnnnnnnnnnnnnnnnnnnnnnnnnnnnnnnnnnnnnnnnnnnnnnnnnnnnnnnnnnnnnnnnnnnncagcatgttgattcttgttagatactgcttcacaaatttcaatatagtaacacaattcattatatattttttcatgttgacgcattttacatcagctgacctgcttatcagaaatgtggtagatgttttacttatatggttatgcccttctgttcttgcattctttatctgttgagcattttactgtgtgtaaatagcctgctattcttctgttacctacccccatgatcgccagatgagatatgcagcatttattgattatcctttagctgcatcatgacattggcctatgctatctgcaggaaagatcctggctacatcaaagcaaatatacgagattcacaaaatcaaagggatgatgtaagtttgaaatattagcttagttaatatagctttctacaggcacatttatcttctctttggactcgtgtgaatcttgtttgattcatttccagacttaaagccaaacaatatatccaaaatttcacaatcctaatcatgagtatttattcctttaggaacctttgttgaagttggagttagacaatcccgcacttctgtctggtaactggtcacagctttgtataacatgcaaagtaagtacagcattgtcgattagttttctctttgctaggttgatatttgggcctctgattccaagggttattctacagattgtgagacctgttcgttcgaagcattgttctacatgtgatcgctgtgttgagcagtttgaccatcactgtccttgggtatctaattgcattggcaaggtacttacgttcttttgggtatcactgtgttgagtagtgatcaaacatggttgtcatctcttctggagatgaaatggataacttatgtcttaaaatgctgaacttttaatgcagaagattatgttgctatgtatatcttaagaaagttgctataacattatgaagagctctgtgctctacaatacaatctctcttttttggtagcttttcgtttgaatgtttttccctgccggataccttcttgtcctttggtctgatctatagtgcactgtaactgcagaagaacaaatgggaattcttcatgttcatcactctagaagtttttgcaatgatcattactggttctgctgccattataagtattgtctgctaagtcctttgtggttctgtccttaataatttggagtgaaaaaaaatttccataagcctcaatgctgtttttgtcacagggatggtaagagatccggcttctccagcatcctttattccttggctcagctattctgcttttaaccatactggggcactttcctttttcataatggacctcttccttttcttcggtgttgcagttctagcagtagtccaggcatctcaggtatgtaaaggttgaatttagcttgctacttgatctttttttttctcatgagaaaccaacctatttttgacctgataatgaaaaaaaccaggaagcatgtttattgtctttacaaccatcagtaaatgttctgtaatacaaagtttcatatagaaacttctctgctgattttatgagggtttgccccagaaatttatgaagccttgctggatttgtcaaatgaacatgtcataattatatagttcatgtgtgtatcccctataaagtttggatacagtagaagtaacattgaattttaggcaatgaaattgctgtgatacataattcagtagcaaaactgatattccaattacaagatagagttgaagtcagtagatgccaggtattatctggcttatttgatctattaattagttttctgtgatgtttctgtatacgacagatctttccatctggtagctataactttttcagaatggacacgaggacttgaggagcattttttctgttctgttttatgacgtgttcatgccttacttccatctcccatgcagatagcgaagaacattacaacaaacgagatggcaaattccatgagatacagttatctaagaggtccaggtggaagattcagaaacccatttgaccatggagcgcgcaagaactgctcagaattcttgttaaatggatacaatgaggacattgaacgtcttgatcatacgtcacacactgatgaggaaatgggaatgatacagatgacaaacgcagtctctcagaatggcgagggcccttcccaccatggtaacggcactggccattcttgtgctgaatcacatgctcactcaaaatctcacagtcaagtaagttcatctcagtgttgtgaccacagtaagaagaccgatagaacaccattgggcctagggctgggccttggacgaaacagtgcttcccggcagtatgtccggtctcttctcccattgtgatttgttatatgcagatcatgtgtgtgctctctgtagattgtatgtgttcatgctgaggctccattatttatttagctgcttgtgacataccacataggtttcgctagcttacgttaatattgttggggtgctagctgtgtgaaaattcagatctattagatccagtattttttgtggtgaatacataggagatgaaggtagcaaggtgctcatgaatatccgctgatccgcagttcagaaatgtcttgtcgctcctgaaaagagggcaacaattttgtgcagatgcagcagcatgaaacatcttcattgctgtgtcccttggtgtcaatataactccagcattttagcttctggatcttacatctgtgggaaaatgtagttgtaaactaagataattgtaaatttattagcaaattctgaatttagatactcttgttgtgatctatagctgtactgacagtccagaaagttgtaataacaaaacaaatatctgaactcttgacgtgttatgaactctcgtaggacctacgaatggatgatgcatccgttcgaaaatataggtacttgtgcatggtttttaaatgtatacggacgatatgcatatttttggaacagagagagtaatagttttttttttccagttattccccatttaacgtatctggcactggcagtacgacattgcttgcagcttgtatctgagtatctcgagttaatcactttttagcccatgaacattcagttcaggagtgaggagtatggtacctcatgatttttaagagaaggatggccttgtcggcttgtccccaccagtggatggctggctgtggccggagaggaccaaagaagtttgcaactcttccctgcttccatgttaccgacacttataaataaattcttaaatttaaaatacacaagaatttcaagttcatgcagaattttccctgtattgaaaactgaaatatctctgcctatctaatctaaaactgaaaaacaaataaaaagaaagaaactttagaactcgcaacttgggctcggtccagctccagcctccaggacccagatgccctcgtggtccagatcacccggcccggcccatcctacctcatcatcacgcaacgcaacaacactgacctacccagacagcgtccacccttccttctcccgccgccgctccaaaacccccacctctaaaaccctcgccggcggcgcacccccacccaagctgagcggccaaaccctcgacaagcatcgtcagcagcagcagccgccggagaagtaaccgccgccgccgcggtgggagagagagagagagggagatggggatcttcgagccgttccgcgccatcgggtacatcacggccggcggcgtgcccttctccgtgcagcgcctcggcaccgagaccttcgtcgccgtcagcgtcggcaaggccttccacgtctacaacgtgagctgctttctccccgctggtctcccacccccacgccgccctaccaccgtccacccttggccttgtgtgctcgcgtctcaaatcggagtagcttacggggagcttggtggagcgagttgatctggtacaagttagaacgcgtgatttgagatgctttggagcggtgattgtgtatttaagtcatggttcgagctcaggggctagttactgattgtggtattagctcaatgcgatttgctcactactacctcgattcaatcgagctgcttcattgtacatatgagctttaacgctagcctctctcaccttgcatagttttctgatgtagctaactcatttttagaaactaactggacttatttcttgttttgcagtgtgctaaactgaatttggtcctttctggtaagtctgtttttttttttgggctatgtgaagattcttcatgtatagcttttttccttatggttttatgtgatcgaaggacctcaattgcccaagaagatccgtgctcttgcatcgtacaaggattatacatttgctgcgtatggaagtgatatcgctgttttcaaacgaactgatcaggtgagggcgttactgtgcttgcaatagcagatcttgcattatcgtgttagttactactagtactagttacttgtttaggcgattgaggcaaccattcatattattactggtaaaagcaggggcttggtgttcttatctaaatattattactggttcacttgaggttgctacattttggagatagtcagataatgtgctcctataatatttgaaactggaaatttgaatagtttctgaatgaaatggttctttcaaactcccaaaaaggatatccaaatgctacattttatgcccatcaactgctacaggattcctctcaatcagacaattcttttttatgttctaactggatctctttcaatcaggtggttacttggagcaaacatgaagaaaagatcaatatattatacccatttggagaatacattctaagtgcagatattaaggggaatgtatttatatggtccttcagaggatcagagccaaatagtgagcctgttgggaacatatcattgggagacaagtttacaccaacttgcattatgcatcctgatacttatctaaataaggcaagtggagtttcctttgctttggagatagtttagaggtcaaatttattgtgcattcaattccatttctggtaataaatctaatctggtcttacgttaggtcatcattggaagcgaagagggtcccttgcagctttggaatatcagcactaagaagaaactttatgagtttaagggttggaactcatcagtatgttgttgtgtttcttcacctgcccttgatgttgttgcagtcggatgttctgatggaacaattcatgttcataatatacgatatgatgaagagttgatgtctttcaatcatcaaattcgtggtgctgtgactgcattgtcatttcgaacaggtgttttgatcgacttgttgtaaattagaacctttattaacatttttcaccagattattacaagaatggaaatgtccaatcaaaatcctgatatattcatttttccttgcctgtcggtttagtcctgtaatctgttcttgactgtgaatactcaaatgacttgttagaaagcttgtcatattaagatgggactggcagttttggcaccacctaataattatatgttagattcagttcaggaaatgctgctgttgcattttttttctatgatacagatttcatacatgagctgaagtgtttcatatattcttttaccagatgggcaacctcttctggcctctggaggatcgtcaggtgttattagtatatggaatcttgagaaaaggcgccttcattctgttatccgggaggcccatgatgcttctatagtttcacttcattttttcgcgaatgagcctattttgatgagctcggcttctgataattcaataaaggtaagtgtcaagcttaaaagctgttgtacagaaacatgcaaaggtccaaagctgcatgcagctagtacttaaccagatgtggggcatcaactgtacacttagtagcggtgagaatgattcagcgcattaaaatcgtgcctttgtgctgcaccaaccagttgtactctcctgaatgtctatggtatttcagtgttagccttttattagtgaggtattccaggatcctcactagaaacaaactagccaggaaagatgaaatttatactggtctggaattggcattaccatgtcaaataaagttttatcagctgcaaaacgttatatcagtttatcttgatagtccagtaatctaatatgctgtttaccagatgtggatatttgatactaatgatggagatgctcgtttgttacgatttcgaagtggccatagtgctccaccacggtgcattaggtgacaagtgtttcaatcatgtcttgctttttttaaaaaaaatcagttggatattttattagtagtaaccatacttctgtcgatagattctacggcaatggaaaatgcatcttatctgctggtcaagatcgtgcctttcgccttttttcagttgtccaggtaactcactgtctttaacttttatatgaagcacatctcctactttcgaggaacttattaggaacatggcagtgatacatcatgattaacattctaggtgtacgtttttacatcaattaggatgctgagtctgttatttgtcatttcttcaatactctctggtctaataaaactgtataatggttctattctgatcaaccatgctaaggcatgtgaccttttataagtttattcatgttttaggcatactattgtttcagcggacttacacctttataactattattttattattaactggtctgctcccattttcttctaaaaaaattgaatttatcctagcctgcattagtaaggtggatatttctgtgtgacaacaatatgagcatagcagtgagagcataaatgaaacttcaattcctatcacttccgacattcttccttgtttttctttctgttgaggtgttgagtgaactatggaaatactattcatcagatgcgtttggttttcgctgaatcctgcatgtttacgttcttatcaggatgccttgcctctttgagaaaaaggaaacgttagcttagctcactatttaattctattgacacaactatttgttgacaggatcaacaaagcagagaactttctcaaagacatgtgtcaaaaagggcaaaaaagcttggattaaaggtatggatttgattactacatttattccctacctatttgtttttccttctctaagatgttaaaacttctctgtcatgcaggaggaagagatcaagctgaaaccagttattgcatttgattgtggtactcttttggtctttgcaatacttctgttgcttttactaatgacatatatagggatactgttcttccacttctgtttttctgaataaatacaagtcactggcagtaatgatactgttttctatttttatgctaccaataaatattctaccagtactatggccattgaaagtagcatcagacagggaagtgcacccttttttctccttggtagagaaattgcttgtattccaatggaaacaactacattctggaaattataaacatgccattacaaaggagcacatgtggagagcagcggcaacagaaataagagttgaagaagtggataaacttttgtagtaagatgtaggatgcctattgtacaacagacgacccccatttcatagtgcagtttcttttagttcttcagaactatctgattttactgctgctatgacctttgtcaaagtcaatgaaagtgtgacctctgaagattttccaattggggccttttaatattgcctgtcagtattcataatctattaggacattgcaatgtgaatattttaataaatgctttttatgtttgtggaatgaaaatggcacccagaaactatgtcctccaacatctttgatctggtcatttgcttagcgcttgtgtaacaaagtgtttcattatgtttggcagctgtgcattgtaaactagttgctgatttgcacccttttctttttatatttttgcctgtatgaaaaaaaaaactataacttaagctgagaaaccttctgcttctgttatcagctgagatacgctcacgtgattggtgtaacgttgttacctgccatacggatactccacaagcgtatgtatggcgtctacagaactttgtcattggggagcatattctgacaccgtcatcaggcagcaagtcaccaattaaggtaatgcatgttttcttaaattgcatgtatggaattttcattttagactagatcaatgtgacctttctttgaattagctttcacaagttggagtttacaagtgttccattattttgttttttaatctttttctgacaggcttgtgcaataagtgcatgtggaaattttactttcttgggcactgaaggtggctggatcgaaaaatttaacctgcaatcggggattagtcgtggcagttatattgatacatcgttggcaattaagcgtgcacatgacggagaagttgttggattagcgtgtgatgctacaaatggctctcttattagtgctggatacggtggtgatattaaggttccatgctctcttgctttttaattctattgtaaatcctgtggcatgctaagtaattatacaaactacaaacagccttttactgcacattttacagagtggtgttgtgcactttgtttcatctttatgtcctcagctgggtaatttgattcttaatgctgatcttctagtcctaccataaggaattgcatattgctgcaaacaccagctatttgtctgcatatgtttgaacttatctttacaagtataatgtgaacttttatccatgacaatattacttacctataggattgtcccctcttgcaggtttgggattttaaaagttgcaagctaaaatccagactggatattggtaaatctgtcaccaagattgcataccaccgggcaaatggtagtatttaacatatttgattattctcgtgtataattctatgcccaattaacagtcttatgctattttatgtcaggtcttcttgctactgtagcagatgatatggtgcttatattgtttgatacagtagcaatgaaaatggtccgtagattcgaaggccatacggaccgtgttactgatttgtgtttcagtgaggatggaaaatggctcatctcatcgagtatggatgggactcttagaatatgggatatcagtttagcaaggcagattgatgcaatgcatgtcgatgtatctataacatctctctctatgtctcctaatatggatgtgttggcaaccacccatgttgatcaaaatggtgtctatctttggtaagcttcttttgcatttacttgtgctcaccatgttcgttttgtagaccttttatgcagatctaagttaattttggagatatcatttagcaaaatattagataagctttccatctgttattactcccgcaaaatcatgacatggctcatttggcaaataaacaattttatctgtccatcctgtagttgatgacatggtactgaaattatgtaccatcagttgcaagtaaacaatcaaaccacctcagagtacaaaagaggatgaggttcatcctggaagatctacctttgtttttgaaatattatcagcacagcgttgagaaaatttgctctcgtaagtcagtctccagtgtgctggttttttagcacatcatgtggggccaacttaaccaattgcacattgttttccaacaaagtactttcttcccaatggtgtcttcccattcttgtttttgccactaacaaaccacctcagtattgacatcccatcaaattctgtctgcgtgtctgttcagagccttcaagtaccattctaccatccccatcaagttctgtctgttcagagcctccaaagtgccattctaccccttgtcttattcccttcctcaagtaccaaccattgtgcctctagtggcagccccttcctgtcacctccggtcctcagcagctagcatgccatagctggtcaaaaccccttgtccagatggggtggggtgaaaatggcaaagcgagaagttcccaaatggaccaatggaaaaaagtggcacagttgataactggacttctcttagtggcataatttctcgtaatattcacttgaaaatacgttggcctgcttgaatgtcggcactgtggttagaaccacttgaatgtggtagcttatagctgttcccttctactccataatattatactattatgaataacatatatagtatgcagtgttctgtattttattctttctgatatacaatccgctgtgtttctttctaattttgacagggttaatcaagctttgttctcaccatcaacaaatgttgataattattcaagtggtaaacatgtcagaaatgtgcgtttgcccactgtttcatcaacagaaaaatctgaggaagagcccattcatagttcagaagattcaaaagaaagtaaagttaaaccttatgttataatggatcaccaaataccaaatatgatcaccctctctttgcttcccaagagtcaatggcaaagtctggcgaatcttgacattataaaggtatacttttttacattgcaagtgacaattgtgtaacctgcatcactatgctactttgaattataatgtttttttttgtttaaaggaacaactaaataagttctcatcatatttctgcgtcttcaggttcggaataaaccaattgagccaccaaagaaacctgagaaggcgccttttttcttgcccacagttccatccctttcgggggagatattatttgagcctgcggcgaacagtaaagaaacagacagcagtactgaggacacaagtcacaaaaaaatggctgacctctcctctcactttagtcggctgttacaatcctgtggagatacaaagaattgtgagtgtttataggcatatttgctcaagtttaccttatttcatggtttagctcattgattagactacaaggagatgctgtccatactgttgcttcacatacttcacttgctgcttctattaagtcgttatgtagtgccatattttgccgacagaagcatggtcaaaaccgggagatatttgttagtgttgtggcctgtgctgctgatgcttgtcatggttgagatgctgactcttgatctgttttacagattcggcatttactgactacctaaaaggcttatcaccatcatctttagatatggaactacgagtgctacagttaatcgatgatgagccacaaaatttggagcagagacctgaacttcaatccatttcattgctgttggactacttcatacatgagctttcctgcaggaataactttgagtttgttcaggctgttctcaaattgtttttgaaggtatacactgttatatattgttcactctgttctgttatttttgtaaaagaataaaaaaactctgttatgaaaatttctcacagggtatatatggtatgtattttttttcctaaacttgatttttgcctttcctggaagcagatacatggtgaaacgatacggcgtcactcaatgcttcaggacaaagtgaagaagcttctagatgtccagagcttagtttggcagaagatagacaaagtgtttcagagtgcacgatgcatggttacattcctcagcaactcacagttttagtagcaggtgatttctttttcatttgatatgccaaatggtttcgtctctttcaccgatactgcttgttttgatctttgcttttgccaaaagatttactattttgtattaattagttggtgctaaaatattttcagataccggcctgccagcattatgtttatctagtagtagcgaaaggcggtttcttctgcagtttatcttccataactcgattatttccttgtcactcgcaggttggtgtggggcttctttgtggctgctgtaccattctcttctgtcttaccataccgtctgtcatggactcagggattcagggtaaagctacaaggcgtctgcgtgctgttaacaacgatatgcaccagcagtacttcaggatcatgagacaacaattttgtagttctgttatttattgttgcattcttttgtaacatattgaattactgatgtatcgacaccgttttgcaacaaaaaagaaaaggaatgtcatgattgatattttaatttttggtgggtgctatagcattcagcaaaactatcgtgacagacttttgatttctcgagaacaatggcgatggccctgataggatctctctattctctaacctacatgatgctcagttttcgtatccatacaactaatttggagagatctcaagagtacaatatttcggacatttcggtcgacgcttcgttgtttactttggttattaagagggcttgtacttccaaaaaaaacataaaaatgtgtgcaactcagcatttatcttaggttatgggggagaatttcattacattcaagcgactgcaaattaaaccagtaattttctggcctacggtttcaacggtgaaaatgatctccaggctctatactccactactcccgaacatttatgaaaaacgcctgaaaactcaagtgccaaacatatcgtttcttttcttttcatgtagtagacaggcaacaacctcgcagtacaacacaaccagcttcttatcatcttgtgctgccttaccaataaatgcaaatacatcaaagaatctgtcaatctagtccaagctcccaaaaacaaaaaccttcaagaaatgctcctgcacctctaaaggtaaacaaaatgtatctgagctttgctcaagtagtacctctgctgtcttctgtatctgaccatgctaatacagtctgtatgactgccatggcaatgcactaaccctactaaattgttcatcatgatagatcatgcagacttgctcctcaggctgtatacatttccaattactccaataatgctaacaaccatggccaaaccaagcatcacaattgacaggagcctctcacccttacctaaagacttgccttccttgtccaatctcaatgcaataagggccgggaaaatgaaccccagtgccaaccccgtcgtcgcaccggtgaacttgaaggccacccagatgtttggtatcatcgtcgagccaagatagatgagtgccaagagcaccactgtcaaggtgagcatctttttcctgctatggggcgctaactcgccaaagatcaacgagtccaccgtctgcctaagcgagaagtggacacccgggaagacgagaaccagatggatgacatacccaatcctgacaatgaagttgaggattgagctgaatctgatcccgagatccttgtcaaagttggtgagcacatcagattcagtgtcttcgccgaacaagaggtaccctgagaccgcagtcagtgcatataccacaacacatagcacagtggtgatcctcccaatcttgtacatgttgtgaggtgtcttctccttgagctcattgtagattggctgaacattgaaatggcagatgtaggcgttcgtcatgatcggtatcacgacgagcaaatccagcattgctgccctcgagctaaaatccggccccatcctcggcatactgatcttaccctcaacaaccttcaccagcgcaatgatgcatgacacaaccacaaacacgacagcaagcgcgaccgatgcagcagacgacaagctcaacgaatcgatcttctcgagcgcgcacaacggggagagaaagatcacaagaaccaccaagatcagcagcctccggttatcccactcgccatgcccgatcaactgatccatgacaccaatgtgcttcagtgaccctgacatcacatctccgatgatgatgaggtacacgatgagcacgccggcattgttgatgatgacgcacatctgcgccacgatgctcgccggacggccgagcgccttgtgcaccacctcgccgtaggacagcgcgcggcagtacacggcgaacctcacgagcagctcaatggtgacctcggagaggatccccatgaccaggatggagacgaggccgacggcgacgccgagaaccttcatggtggccgggagggccataatgccggcgccgatgatggaggtggcgaggttgaacaccgcggcgggcacgccggagccctcgggtggcccggcggggccgtcgccgatgagcggcaggtcgtcgttctcgccgccgccgccgccggcggcggcatcgccgtcgaccaggaacgaatcttgcttggagatcttggcgtggccgttgtagccgacgccattggcgacctcggatgtgcgctggttggattggagctcgatggaggtcaatgggagggacgagtaattcgtgttcatcttgcttcttggcgcatcaaagattggatcaatcaatcaacaacaaacacgacgagaaattcctcgtcgaatggacaaaactgagccaagaaatggaaaaaaaaatgtataaccaatctacagctccaagaacacaatcttgcccccaaaaacggaacaaaattcgactgcaaactacatcagctgatcagccggtgagatctcagaggggcttggcacacattggtggcatctaccacacaagaaactcaaattttcttgggccagatttggttggagatcgaaacagaaacaagaactgaaattcgtcctccctccgaacaaaaattgaaggaaagagagggaggcgtgtacctaaggattgggacgagagttgagagatttgaggcgttgaaactgtggagagatctggggttctatctctctctttattttattttattttcgattattttttttcttctccctcctctctctctctctctctgttcttccttctctctcataaaagtatccgataaactaaagaggatagtcaatttacgttaattccgagtacagttagctccaccaacccagcgattcaatgtacccactagattagcaaatgacatgtgggcccataggatcgtggggtccacgcaatcagtgggtgtgggtatgtgcttgagtaacatttggggatctgcaactcgcgcggtccggccacatgggaggcgtggatacatcccttcgatctgattggccagcggttgctggtgggtcccactcagtggctagtactgcctaccgcgtggcccacctgtctgtcagcgtggaatattcactactagccctgaactgcacgtcctcaaatttagatggattttatatatatcacacaaaataattttattatttcctccatcccaaaatatagcaattaatataaaatgggacacatcaggctcgttcagttctgattaagatgcaagttttagctcggtttttgttagcatgattttcaaaatgctaagtactttagtacatttaatgtgaaaatttgctttagaatatcatataaaactatttttaatttaaaataattaaaactcaattaatcgtgtgctaataatttttatgttggtacttaatcttcatctacattacaacgaatctatatgggttgttatattttagggtagatggagtaattcaatttaggataattggatcatgccattttggtaagcataggcaatttcgccacttgtacaacgcttaaccaaatcctgtgttgactaatggtgttcaccgaagatcttatcgatgtttggtttgactagaaaatgtatagtaggccaagtcaattcattgaaccattctacagttgactaaagtacagatcgaagtttcttggagaatagtttgtttagttctgtatgctttctaatggcattttgaagtcctcttatcacctttattttgcaaattgtactattctcaaataacataatcgcaaaagcaaatttgctctttatcatagcattgaaattggagtacatgctttttggcttagtgtgacaacttaacattaaagcaaatcccttgacttagtatgaacatcttacattaagcaaatcccctgtcttgtgttgccgacttgccgtcatctgcactcaagaaaaaagggaacacctttgctctcaatgcacatgatatttcttcacttcagagcaataccataatctcgcaatgaaacgatgtttgcacatgcacttttccgcatcacaagattttcttctataaacatatatcaagaaaatgttactgtctacagtttgacactgaaatttagtacttcgtttgcactagtacagaagcactcatcgcccgtaatgttcctcatgatcaatgttagtctgatgatctcaaacctgcttcacatgaatggataatatgctccgcgaacaacctataccattgttagcattgccaaattgccgttgcacccggaagatgattttcttcactgtctgatgctataacaatgatgcataatcaagtagcataagctgcataattatgcaatccatctggatctgggatgatgatctgagcttcttttggaagagagtcatcatccacagtggcttcagcttcagctagcaactcgttgcagtgaatggagagggtacgtttttcttgctgaaatagcctgcaagcagaacaggaaaatgagctcaaaacatgaaatggcgtaaagacaattgagagaaaagaatattgaaacttacggattcttgcaaagcattgggctttgaactgttaaaacatatttgcaggaagagatctccttaattgaactaatcactacagtgggttctgaacatacaaatctaacctgtagaaagaaagtagcaagtgcagtcaaacatactacttaatatgacatagaaacaaaacgtttttttttttcatacctctgtttcccggggcatatcagtgagatcgcagacagtcccatttgtgtacaggtggacatgatacctgaaacatgaagaaaagagattcattcaagtgggtttagcttacagatataatttgctttatatatccttatattcgtatattacctcttagaggtgtctatcaggttatcatcttcatcagcagagtcagatgtttgattttcatagtaagcatcagttgcatcagcatcatattcacccagaacatattcttgaataacctgcaaacaacacaaactttacgtggcaattcaagtgctctagaaactgtcggctgcatttattgtcaaagataaaatattttatttttcataatgtagtgtgtaactgtggccagaacttgtctctcctgtaaaaactagcaactcttggattgacgcatctcagatattttttagatagtgcataaagaggataaaatacaatgactgatctgagcaaagaaaataaacaggatggggcagcttaccttctcgccctctacgtggacttgtcggattttcccgtagtagcaaaattcataagaccaccaaccttcatgctgtgtcaaaatagtaatagcaataatcagtttttgttcagtcaatataaaatcaggcagtggaacacatgcagttctactgaccgcataaagaaagagttctatctcaccctgtagaagcactgatccttgagaatttccagcaattcatctggatcctttggcttaactctccgttcactttctatgataacattggttgcgttttgtgggattatcgacttcatggtttttgtttcctcaacaggtaggaagcatgtataatgtttccccacgtggctagtcattggtacagattcctggccattctcctgcatagtacaccatagaagtctttgattgtgataacaggaagtgttcttggaataaagtaaagagcgacaattgctgaaaataactgaaatttttgatgagaatggaatgaaaaacacatgatttacaacaaacataatcaacattgcttagatcggaatcgtttatttatcacagctaatcactaaatctcactacagtttagacaatgcctttatattaccaacaccaaggctagtaggctacattagcaggtatgaggattgttcagatcttgctagcttcggttctaaaagatgtacacatgatcaccgagtgtgcagaatttgtgacaactaaataaagctgattattcctgtaactgtaaaacagaggaaaatttagcaaaaacttactggattaaatggcgcatcgacaggatggaactcaacatggtacctcggctcacgcgaattccgcccaaacggcgcacctgacatcggcaacaattcagtgcaattctgctttgtttttcctcttgcagcaattagagatcgaaaagtaagaaaataaatagatcatggccaaatggagttaggtccagcaaatcatcagttattagcaatttcagatcatacaagcacacaaagaacagccttcaactacagaattctagatctaggcagtaaatgaacatggccaccgtgaagcaagcagcaggcaatcataatcgaacaaaatgaataatgaaatcgacaagtattccatcaatatacgccgagaaatcgcatcgagcaagtggtgaatttggatcgagaatgacatgaagagagggacagtccatggggggcgcacgacggatcttgatttcttgccgagactccgacgcgattacctgaactggtgaagatctgatcggcggcggcagtcagagccgcagccgccgccgccgccacgacgaagagcaccacgcgcgccccgccggcgagccccatcgtcggcgacggcgcagggttctctcgacttatctcttcagcgttcgcgtgttgttggtggtggcgtttttcagtcttagacctcgaagacgtattcgctgattccgccttctcaccccgtatacacgccgtataggaaagccgttttccctacagggaagcgctacacgatggaagcccaacttaattaacgcggatggattagttcgatgaaaaaaactgtaattagcgcgcaaactaaccaccccgcccgcgccgcgctaattctgcccgtggcggaatgcgacggttttgctgttcgggcgacgcgacgcgacgcgccacgccgtgcgcgtgcgttcgttcgtccgcagccaacttccggcgcgcctccgcgtgagcgcgcgcgcgccaccggccgcaacgccgcgcgtcctcatccatccgtggcgccaagcgggctggcgggcgggcgcggcgccgcgtgcgacagccgatggccgcaggcgcgcgcgcgcgggcggagggagcgcctatatgtttagtgcggcgcccgcttctgtcaccgccattgcagacgctcggagaggctcagagcagcagcgaggaaaggttttgcgcgagataggacgaggaggaggaggaggacgaggaggaggagcttgatcgtttgccagttcgccatggaggtccagcgcgtggcggcggcggcgggtggtgttcacggcttgcagcgcgcgcccggtgcgatgggtggcgggacgtcgtcgctgctctccgcggcggtgcaggagatgctgatggtgcagaagagcaataaggccatcaagaagccgccgcgggcgacgccgcgcctcccgcccgtcaccggcgagcgccgcggcggaagcggcggaagcgtgtacaggggggaggccacggcgccagcgccaaagcgcgcggcgcgggcgtggcacccgccggcgaagagggtcgccaggagcatgctgaggcggggcgcgccaccgtcgccggagaagaagagaaaggtcctgacctgctgctgcgcgcgcctcccgccggggttacgctgcgcgctgcaccagtgcgctcccggccaatcgtgtatgcggtcgcattgcggcggcggcggcgccattccggccaccagcgagaccgtggcgccccgggcgtgcgggcgcgccgggtggctgttcagcgagtacgcccggtggcgcaggagcgtgtggatgccgagccggttctacctagagcgcatcgacgggcaaccccgtccgccgcccggcgagctcgacgctggccgccggccgccggcgagctaaccgcgcgtagatatgtaggaatgtagcaattgttcttagcttcgtagcaatctgatgcaaatatatatcaaatcaagtatgtgaaatggtgcatggatgaaatgaaacaccgtgcactgctcctattgtatttgcaacaaaaagaacaaaataagctaaaaatagttatagtacatttgcagctatatttgttgtttttttacaatttgtagaagttgaatttagtcttacatatttgtggagtgatatattttatattaatctatcttaccatttttgtcaaaaaattttataactatttaggtggcataaatgaaacgagggatatcccctcgagggatgaaatcactttcccatgtacaatgtgtcatagttatggataccacatacctaatagtagtcgactaaactcggcagggcccatcacataccatatcttatacggaaacaaacctcgtatatagaaggagttccggataaggaatgacgagtagagttctatatgaaaacgacaaggactactcagatcgtatccatatttatctacttagttctacttggacaaaggggctgggtataaatacaagcccccctaggaggagaggggacacgccacaaagccacaagccaatacaaaccaatacgctgtcagatctcgacatcagagtttagcctagacaaacccaatccggtgcctacagaagccggcaagagggatctagtgccatctctgatctcaccgagtacggattcgaggaggaagactaccctgttgtcgtctacgagttggttatctagccgccaagtcgacgacagttagatatgttatcccaaatattgtacttgtgtgattcagatgaataagagcaacgccggctccggtcaacaggatgtagggctattacctgtaagataaggggctcgaacctgtataaaaatccatgtctccatctcttttacctcaatcacatataccctagtaccaacgatcctcataccatccaaataccgtagttgcggtaccacccgtcgacacaatgtgtactgctctgtcggtccaccaatccgccgtcatgtccacagaggttgtgggggagcatgaggaggggctagctctgcgactctactcccgagacttcttgccgaaggagcagggacaacaccatagctataggtccctcgtgctggcccgcctccaacgtgactcggcgtgcgccgtggcgatgtcggcccgcgcggcgatagcggcggacggggtgaccacgttcaacctgatgctggcaaacgtcatggtattcgaggcattggcgactaagcagtggagataccgggtgacgatagagttgtatgtattgatgttgtacaacaatggttgatgaccctgtccatgattcgtagcaacgcggtaggcggtttgatccgattagatttttgacgacagttgacagtttggagtagttaaattggaccctctactagccaataccccatctgtcccaagaaatagactaatcctacctacgaacctggacatgtgtgtccaggttggtagctaggaattcgtttttttagaggacggagtagtatatgttaagtttgatgacagttattgtttagactgataactttcactccctcatttttcatgcgcacactttttaaactattaaatgatgtgttttagtaaaacttttatataggaaagttattttttaaaaatatatattaatctattttaaagttttttagcttgtacttaattaggcatgcgctaatccaccactcaattttgcgtgaagggatgaagggttttcaacctctatcatcgaacactcaattaaaatagcagcccgtatggcgggcttgtggcctacaatgttaggggccataaggagattagctcttcgatcttgtgggctctaacatgtgatgatttaatcgagagatgagaagattgcaagattgagaagatacgcaaaacgagataggtcattagtgtatgattaattcagtattaattattttaaattttaaaaatagattcatatgattttttaaaagcaactttcctatataatttttttacaaaacacaccgtttagtagttcgggaaacatactcgtggaaaacgaaacaaactttctttcctttttccactgccgaagagagcctagtcacgaaaaaagtttacaagcattggattgtttttcgtttttcatatcatctaattagtcatgtaaaaaattgataaaatagatcaatatgtggtgataattgtatcattctacgaatatttacgtttaaattctgcccacctgtatcttaagcaacgtgtggtacatgaaaaacaaggttagattgaagggtgactcggcacaaacaagtgctctacacaataataatatcctcttcgtatctaaatatttggcaccgttgactttcttaaacatgttgaacagtttgtcttattaaaaaattttaaataattattagttcctttcctataatttgattcattgttaaatatacttttacgtatacatatagttttatatatttcacaaaagttttttattaagacgaaacagcgttaaatatttatggatggatggagtaatatatattatttatcatcagtaatcagttaagtatcatactttggggcacttgagatctcaaagctaagccacctttcatcgcgcttgacgcatttcctctgaacccaatcccagctgcgcggccgcagtccaggcaggagcccacgtaggatgcctttcatcagcttgtcgcagtcttctaccgacagagacttgctctcctcgtcccacagcctcggcagccggccggcggcgagctccaccgcgacgtccgagaggcggccgacgctctccacgcgcacctcgtcggcgaagcagcagcgccactcgaacacgcgcagcctgggcgcgcgcacgcggacgcacgagtagcgggtgaagagggcgcggaaccgcggcttcaggtggtaggcggcggggtcggacgtcgccatgggctcggtgtcgcagcgacacgagacgcggagctccgccagctcgtcggcgagcacggcgatcccggccttggtggcggcgctcatcacggcgacgtcggtgacgatgaggcgcctcagccgcggcatggcggcggacgtgatgtcgatgccgccgccggccggaagcgtgcacttgacgatgtgcagctcctccagcgccgggaagacgacgccgccgccggagaggaacgactccgggcgtagcaccgccaggccgttccgcgcgagccacggaaggaggcgacgccgggcccgtgcaggccgggcggccgcaccgcgtaccagtacagccgcagctgcagctcggcggtcgccggcggcagctcgagcgaccactcgcgggcgtcctcgtcggggagccccctcgcgcactgcacgcccagctccagcctcgtcgcgttggccagcgcgacgaactcctccgcgtacctgcactcgaacgggacgtccttccggtaaccaatgtgaagcgttttcacggtgtcgccgccgccgcagcagcgccgctgaagcgtgcgcgccatgctctgcacgcgcggtttgctcgactcgccaagaggcgcgagaagcccctgcacggacatgctgaaccgaacgttggggagccgggtgtggagatgctgccaccgccgtgaaaccgcggcggctcgctcggcgtcggcgtaggggcacatggacaggatgggcacgaggatgtcatcggggagcttgctgatcaggtcctctttgggtttctgttccgcgggtagtgcgttactgcgctgatttgcttgccgtcgttgcgatggcttcgacacgtctcctctctttttgttctgcctcttttttccagccatgatgagatggcagcagcagacaaattagagcaggtacaatagcaggctattagccagctgtaaatatattttaatnnnnnnnnnnnnnnnnnnnnnnnnnnnnnnnnnnnngcgccttcaaactggcatcatnttcaaacccct

SEQ ID NO: 18517 - DNA, 2821 bp, Oryza sativa
  unsure (1)..(2821): unsure at all n locations
aatagtgggctatatatttaactttctcttaagatcaacgattggtgtcacttggttgggtacacgtaccaatgagactgcacgattgtattcattggctggacagatgtgttcccaattccgactcggactcaaaattcgattcgtcaggtactggaatatgaacatccaaagctcccagacccatatatactctctatcaattttctccaaaccaaactggactcggagatcaatagatcatgtcttgactgccggtggatacgatgctagtacggaccatcgacggccagcacaggcgcccacggcggggtcaatcgttgttagatagatgacgttgttgagtttttatcacacatttaacgttcttattattaaaaaaaattatgtaattataaagttttggaaaaagataaataattaaatatgtagttaaaagttaatgatatcatctttttaaaaacggagggagtacgagtgagccagaagaaagccacgttgacccaagttgttacacgcatgtcatcatggaaagactctcgctcccgcacctcactccgattattattccctccaaatccaagctcagttcgatagagctgaggacaaatatgttgattaactaaataacaattattatatatttttaaaaaatatttggttttttaataaacacctacatgtattttttttagaaaaaacgtattgtttaatagttcgagaagtatgctcagaatatagcaaaatcaaaactcacttcccaacatagccttatgcaaaacaaaatagtaagaagaaaaatagtatttcagtccactctataaataaaacatcatactccgagagtttttttagaaccggtaaaataatgattaggaaagggaaaatggaaataggacgatgtttaggatcggatgaaatgagttacgagtgacttatcaaacagtcccaaagaggtcggatactgaattttcgcgtgttacaatgatgcacgaacgtgattcgagtattcgacaggagaggtagctaggctgaatgcacacattagccgcaggtacaattagcccccttatcgtttgggcatgtacggatgatacgccatacaagcaaaattgtaataatttgtgagtaaaagttttctacgtatgttcttaacgatttaaaaaccaatgctgaaaaataaatttcgataaaaaaatcaacatcaactttaaaattaagttttaaaatttaatttttagttaatgttgattttatataaggcaaacgatgagagatagcatggtgccatgtaattagcacgtatgattagatgtaggtacggttaccgtaaaaagtgaacagagtaaattgcgttatcagttcttaaatttataacagggttttacctaaatttacaaactaggcgtgcatcgagtttattaaacttggttttccacatcatccggtctaaagtattgtttgatcgtgatcttacctgcatgacatgtcacataaataatgactggcatatttgtgataaatagttaaagactttgttcattttattgccactttaaactctattaaattttaatgttattaagttttgataggataaccaattaaacataatgttaccaaaataccaatgctatggtacccaagtcgggtagttttgaaagttttttttttcataaagactgctaccaatttttgaaaagactttgaactaaatttcttgaacggctatcaaaaatctgataggatcaaactattattaaattttgccagcaagcactgaatcccccccgcctcccccgtgccgcgttcctgccctcctcttgagcgactacgccgtcgccggccacgctttcctcctgccaatctgccccagtcccgactgcccgctccccctcgcgcccttcctgctcccgaccgacagcaccctccccgcttcctcttcagactcgactgcttcgatgatcttttgtgagtcctttgagtttttatctctcctcgaattcctgtatttttcctgcggcctaatcaaatggccgtttctatgtttttcctgtattttgcaatcctctgttttatacttgtattcctatcaaaatgctatgtttttcctattcctatgtttttccattcccgcgatgtaactatattgtctttgttattaacatttatgttcatgtctaaattgttcaaatattctgccgaatttctattggaactatataacatataaacttgttattcctaaggctttttcatctttaagattatatagttaatctctagtatttacgtgattgttgttctacgttgaagttaaccaggagtactaacaacatgagttgcaaaattttacggtacctataataaaagagtaattttatcattcttgagaagataccagaggtaccatattgtattgtctagtgtaaaatttagtacctttagatactaggtattaccaaaaattttaagtagaatttaggtacctcaaatatttttttaaggacggtaaaatttctcataataaaatttatggtctccttagtggttttcagtttaacagctttaagctgtaatttggtttctatgtatttgtgtatattcttctttgcgtctgtgtaggctagctgtggcgttcaagaaggcacttggagtctaagcaattgccaaacgggccatagtacaaggaaatggactggattgttttttttttcttttaccactgggccaatcccggccggaattnnnnnnnnnnnnnnnnnnnnnnnnnnnnnnnnnnnnnnnnnnnnnnnnnncgctcaaaaaggcgatcaaaccg

SEQ ID NO: 18518 - DNA, 787 bp, Oryza sativa
  unsure (1)..(787): unsure at all n locations
gtgggnaatgaacgactgatnnnnnnnnnnnnnnnnnnnnnnnnnnnnnnnnnnnnnnnnnnnnnnnnnnnnnnnnnnnnnnnnnnnnnnntgcaacagcagcatttcctgaactgaatctaacatataattattaggtggtgccaaaactgccagtcccatcttaatatgacaagctttctaacaagtcatttgagtattcacagtcaagaacagattacaggactaaaccgacaggcaaggaaaaatgaatatatcaggattttgattggacatttccattcttgtaataatctggtgaaaaatgttaataaaggttctaatttacaacaagtcgatcaaaacacctgttcgaaatgacaatgcagtcacagcaccacgaatttgatgattgaaagacatcaactcttcatcatatcgtatattatgaacatgaattgttccatcagaacattcgactgcaacaacatcaagggcaggtgaagaaacacaacaacatactgatgagttccaacccttaaactcataaagtttcttcttagtgctgatattccaaagctgcaagggaccctcttcgcttccaatgatgacctaacgtaagaccagattagattattaccagaaatggaattggatgcacaataaattngacccttaaactatcttcaaagcaaaggaaactccacttgcctatttagatagtatccagatgcataatgcaagttggtgtaaacttgtcttccaatgatatgttcccaacaagctcactattttgctcttgatcttn

SEQ ID NO: 18519 - DNA, 6034 bp, Oryza sativa
  unsure (1)..(6034): unsure at all n locations
tatgggttttggangnttttgatnnccnttttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccaaagaattaagtaaatatttaccgatctctcataagcatgcacatgccctgcaaataccaagtcaaccttgtacttcacaaaccatttctcaaaagcagccctcatactctcaccctccatgtaatgtgcttcattgctgttgtacatgggagaatgcatgagaacaataagccaaggagtcttctctctatccacatgcttcaattcatacttcaaccaggtccattgaggagtgtattttactggtaaacatcagagataagcttataaggcatacaacaaaatattcaatgaaaagaatcatccaactatcaaatcatacatgcatcacataatcacttctaaatatagtagatgatggtcaggatattacgccaatgaaaaaaagatactagtagatctgcactcattcaagggagcatccatgcctgtccccacacaatgttacaggtttcaaacagctggaacgcggaaccttgcattattagtagtttcaaactttcaatcaaaccagagaagactttatgtttctatccatccgcatcagagataaagaatatcgtcatactcacatttggatcagtaagaagacaagaagacagtaacacgataatttcttttgtctaagaagtgctacttttgcccctccttgacttggaattttgaactacgtgaagcacttggaactcccaagtcactatcaccaccacagccgccaccactaaatctggtggtttgtacagacttaatggcatatacaaaacaaagcaagtcagagaaaggatctttatcttaccgaatggagaatagctagaaagcacaatgatatgagcagatgcacgtctgactgcataccacataggagaactgctctttgatgccaaatatggagtgtgacatctatgcagatatggcttaaatgtagaagtttctccctgaaaacataaatacgaatgcggtcagggttaaagaaagacaactatgtcagctagttaaaatgctcaggtggaactgcagtgttattctgaacaatggataagttattactccctcagtcccattttaagtgcaatcatgagtttcctcgtccaactttgatcgtccgccttatttgaattttttttataattagtatttttgttgttatgagatgataaaacatgaataatattttacttgtgacttatggtttttaattttttcaaaaaattttcaaataagacggacgatcaaagttggcgcggaaaaccatggctgcacttaaaatgagacggacggagtagcttataagcacagatccttgtcagtgtgtaaatccacgtacagccagctataagaaaaaataaactaatacaaagatctatagatcacatatctattttcttcagtattatttgcctgtaattgtcctcttctgaacatgctaaagcaaggaaaaatccaaaaaagttgggagtttacaaaatgtcgagaaatcactacttccaatcagaggaatatgtggtaaaaaaaaacaactggtgtatagatgagaagaatgttaacataccagatcaggcctgtattcaatttcatggttaccagcgctccaaatccatggttgataagcggtactacgttccacaagccgcccccaagaatcccaacgaacaccatcattatgttgatatctatcagcatatgacaaatccccaacaaataaaacagtttgaccttcgcttttctcataatgttgaagggttgagagggaattaaatgtctgccccagatcacctagcaaagcacagccagaagactttagtatcaacaagctcggacactataaccatatcttgacatagtggttctttccatgaagtcattgatccccattttttccgttcatgtattcccttatcctaaagctaggatgtttgacaagaacagaggatgtgtttccagtccttctgatatataatcttgttgagatctatcttatatgactcatgcaacctaggtaaaatcctagaagagatgttgcagagatccaaagtaattcgatgacacatgctgttaacaaaaaaatacttgagaaaacaaaagacgaaccaattatgccaaatgtgtatgatgcatctggatcaattgctggaggagtttcaaaccaaaattctcgagctgaatctccacttccaatcttataataatattgggtgttatactgcaaaacaatatagtaattttatatatttacaattttaaattggaactaacaacaaaataatgtgcacacagagtattttgttaatgcatcatactagaatagtagaactattccacagaactaagaaagtgtgtgaaaataatttgtgcaggtgagcatcgtgtttcaacatgataaccttactcaattgaaatttgacgaagaaaagttctctgtcaaatcaaatttgtgcataataactctaagtttacagctaaagtagatcattatggaattataagtgagaaggttgtgtgatagttacttagaatatgtctaagctgtttacaaaggaaacatgatgttgtaggttattctattttagtattttgcatgggtaaacataatgttggacaaatatttctacaattgtatgcaagtataaaatgcaaagcctaaacgatatgaagaaaatgaagtctagtacctcaagaccatcaacaaggcaatggtgaatatatccagatttatagtcgtaaaaggtataatttgttactgttccttccactctctgatcatactggtgctcatttttaccatagagcacctcacttgtcccaggttctgctacagtaacccatgatactataacagcttttccattatagtcaccttgagtgatatgaacctggcagcagaccaatcaattaaaacaccgtcgattcattgcaatgaactgatctggcagaagagtttagatacctgctgtggcgcattgtagccgtttggaaccgcaaaccattcgctttctagaggtatatcagtcgatgggtactccgtacgcacgtaagagctcgtgcggccacaggagacgccattgacaaggcacagaagaacatgtaacagtaacaacgcaaatctccagcccatcactgatgcagaacactaccgatccccgttttgaacctgttacatgttcaattgagaccaaaacaaacacctatgagatattgagattcatacgagtatgaccacagaaaatactcgaaatgagggattaaacgtttttttaaaaaaataaaaaaattgtgcacatgaatcagccacatggctatggtgtgtcgtcctggacctccctggtacaaccagcagagattcgtacagaataaacacgaacagctatggcgctgtactaccagagggcacccaatccaagcacaccccaagttcggatggatcttcaatccacgcctcgcgcccgctcaccaagcgaagcgcggaggaggaagaaacgaatacctgattcgaacctcccgagacggacgcgccggtggaatgggggccgcgccgccgcgccgtctcgccggcgaagacgacggagaggatggcgagcgggagagaagcccaccacccaccagcggaggcgaggagtgaaggcggcgtagcaaagctgacacctcacggaagcaaactctgtagtacaagtataccgcacggctcgtctactacggtggtggcgagaaaatggaggagaaagcgtaggatcgcagaggatctactgattcgaagtcgagacgaggaggaggatgattcgaagcgaagctggaaaaagggtgggaggattcgcttaccgtgcaggggaggggatcgtctcgcgctgggttggggacggagacagagagagaggatcatgtttggtgttacgagacggctgttagttgggacctttcctacttagcgcataattaattaaatattagttattttttagaaaaaatagattaatataaattttatgaaacaactttcttatatattttttaaaaaatatatcgcttaacagtttgaaaaacgtgtgcgcagaaagaagagagatgggttggaaaataaataacatagtagtgtgattggtagtatcttcatttttcagttcgagttgctagttttcctcgtttgcgagatgggttggatggatggttttgtttccgtggttgttgatggttttgtaccggacacactgaaatatctaaatatctgttactacttccgtccatggaagtagtagcaattaatgatcgttttaaaatcatttagctcaaaagatgtctaatttataattttagaattaaatttctataatcatattattttatcggttgtgtgtcaatctcttatctttaaagctttgatgtattactaatttctttacgaaatcactcgaatagttttcctatgtaatcaacttgtagcagtgtattaacttaagatttcaatagatatttataaaattatggcaggcattagttactgttgtttggttggtatactgaggttgtcaatatttataataattgtatgccttaacttatctacagttttggccaatgaaataaaaccacaatttggctagcaaaaggcaatcacacacgcgcttgtttgagtcatgatggaattggaatctataggatgaattgtgctaccgctctagttatacttatgatatggcaagatgatggaatttgcttcaacctaacaaaccttaagtcaccgccataccgctcctttcaagtgatggtagggtattgtggagtatttttcctttccttttttcagcctgctcctccagttttcctccgtttgcaatacaggttggatggacggtttgcttttgtggttgttgatggttttttttactgaaataccctctccatccaaaaaaaaaaaaaacttaggtttccgcgtctaatgtttgaccgtccatcttatttgaaaaaaattaaaaacataagtcatgcataaaatattattcatgttttatcatttaacaataataataacaccaatcataaaaaaaaattatataagacggacggttaaacgttggacacggaaacccaagaattgagtctttttgggatggatggagtatttggtagcaattaatgatataattttaaaagtaatcaattcaagaattgcctaacatataattaattacagtttaaaattttctattgtcaaattatttgtcacatatcctattttactataaagttattccccactaactccttaagcttaacatgcaaagatgccacatcatcatccactaacaagatgccacatcatcattcactaattaacaagacgccacatcatcatccactaacaatcatcatgtttaaacatcgtgcaaacatgctatatctttatagtttttataatttaggagcttttcaaatacaaacatgttaaattatcatacaacataattcacataatgtttcaatgtatatctttattatgttttatgatatcctatataagtcctcatttagttagtgcttaaatgattaatctatggtccaaattatctttctcctttttcctctaattaagtcgtatcacattaattgtttttagcctttagatgattaatctacggtccaaactatctccctacttttcttcttccataaagtcataccaccttactttttacgtttgaatcaccattctactatttaagtttaaattatcataaaccacattaatttacttaatctgatgttatctagttatcttgcacgttattttttttatcatactaaattnnnnnnnnnnnnnnnnnnnnnnnnnnnnnnnnnnnnnnnnnnnnnnnnnnnnnnnnnnnnnnnagagtggcgatcattcggccac

SEQ ID NO: 18520 - DNA, 18851 bp, Oryza sativa
  unsure (1)..(18851): unsure at all n locations
tgcctgcaggtcgactctagaggatcccctccaaactatctccctacttttcttcttccataaagtcataccaccttactttttacgtttgaatcaccattctactatttaagtttaaattatcataaaccacattaatttacttaatctgatgttatctagttatcttgcacgttattttttttatcatactaaattcccgcagcaatgcgcggggtttcacctagtattgtttatatcgatggcatgtgcatcagcctcgatgtgttgttagtatcatgataaaaccacacgaatgctttctcgtgcgaacagctcacaagatgtgtattaactttgaataaacaaggctttcaatatattttaacaaaatttatggttattagttactcctactaagtattggaagtatatggatctcgacacaccacgataccaaatctggaggattgtttgattcattgattggcatattgaggttatgttttggctaccaaaggccaatcacatcgcacttgtttgagccaatcatggaatctagatttaaaaagataaaccaaataggcaaaatctaaaccgagaagcctatcggtttagcgttaaccagcgacaaaccaatttgtgagaagaactgctacatgtgctggcgtgcatgcttgtttttcctcttagacatgcatgtcttttccttccttcttataaagttttctctcaaattacttatccgatctacaatccgattacaccattgtattcgttacaattaaatcttcacaacaagatcttacatgattatattacgatgaaaaaatatttatatttgtaaattacttttgttatatacataagttacttttatcatatatataagttacttttagatttgactaagttacttcttagacatataaaagtaaattcaataaagtctaaaagtaatttacatatattataaaagtatcttaaaacaaaatggaaacatactattgcatttttttcaagttgaaaggaaacactagatggagtacaaaccagctaccactagttgtgtagtcacgtccaatgaaaaaaaaatgaatgcattaaagttactttatttttgttataagttacttttataatatatgtaaattacttaagctttattgaatttacttttatatgtcgaagaagtaatttagtgaaatctaaaagtaatttagatatattataaaagtaatttataatttttcatcaaaatataatcatgtgagctcttgttataaagatttaattgttacgaacataacggtgtaatcggatcgtagattggatgagtagtttaagagaaaattttatttgaagtataggtggaatatgatctctcatagatggagtggtagctgatttaaacaaaccagctaccattagctgtgtagtcacgtccaaccaaatagatttagtatttttatatttgagaaagtagcttatgacatggcaagatgatgcaatatattttgtccgttaaacctaacaaactttgaagtcactgccataccgctcccctaccgtcatcggcatgggtggaaatcaggccagcttcatatgcctccatcaaaatcgatttatttatccttttatcatatggagctgttcttttaacaatctaaggagaaaacggcgtaaaatctaattttcgttcggcaataaacaactttgattttctaaagtcagcgtaacttatctagctagattcttcgtaatgagacttatttacttgaactcaaatcttagactttcatggctaattattttttaagtagtaggactttgctagtattaagatatgctacatatatatcttgacatctcaattattaaaaccgttataatttgactctaaagatagtattcatagtggtattgatgtgaatacgagctgcgttagcaaataccattataaatactatcttgtgagtcaattacattggttttaacagttaaggatcaagatatccgtattacggttgaggggcgtgaattagatttaacctatatatcggggagtctaggtggacttattccaagtaataaaccccacaaaatggaagctcgcgaagcccacaagccgcaggaaagcccgcgacgagaataccaaaccaaatccaccaagtccaaggggatctctctctcgcctcgcctcgcctcgcctcgtctagttgagcagccgcgacgagcacggcggcgacgacgacctccgccgcgacgatggccgcgcgcctcctcctcctcgtacttttcgccgtcgtggcagcgcgcgtaggcgcagcggcggcctatcagcccgggtatgtccccccctcgccgcgccacccccaatctcgttttgctccgtgatccaatccaaatcgaccgcgagttgaccacggctctcgctttggtggttctccagatctgctgaggggcacacgatcgcgggccgcatcaagatcgatggttagtctccggctattctcaccctatggctcgagtgaattccgtggagcttttgtgccagatgcgtgcattgaggttgttgttgtgctcggatcgttggggatcgtactcgtgtagcttaggtgcatcagatatctttgtgtgtcagggttgtttggggataaaagccttttttaacattcgatttcatagttggctatggtcaatttgctggaattattttcgagatctgccgattaaagtgtccctaactttgtacttaaggtagtgactaacgagatttgatacactatttatcgagctcatctagttccgtcttagcgcaagccagcgctagccaactttgttagctatcgactacttagcagctttgagggtttgttaatttagttagtgatttttcaggcactcgtggaattcattgcatttgtgcaagctgtttttcagatcatgcactgatacagttcgatgagcccctggttttggttacttagtctcatggggtttgcttagatgacagttggtattcgtattgactgattttagctgagctttcattggtcagggggtatttgattatgaatatctgatgattttagctatgttttacaagagtttgaaagtgagctttcgtggaattttgaattgcaaaaaccgtgtgttgtactgttgtgattgccatcatagtttatccggcactttttgtttctaggacgagtctctacctgcgttacaacatgttcgatagatatgttggcaacttggcatgagcattgaagcccacgtttcccaaccatgcttattgaaataattcagaccacaataataaatggctgctgtatagtgtttcagaccgcttttaacttttacattttctcttgctgaaaacattgttagcttgtggatagaaccatgggtttttcagtgctggatatttcatgtgaactcagattgtcaaggcaagtcttagttttctttgcactcagggatcttgcatttgctccttatctggaattaagtttccatacccgtgaagccaaattgtactaattattataatgataaccagttgatgtcgttttttttttctgttttatgtgcttatagctgcaagtgcaattgcaaagggctttggtcttccagccaagacatcaaacacaaaagtgatacttaacggtggtcagagggttacatttgccaggccagatggctactttgcattgtatcctgcaaaatctgcaaaaccatatgtttacaacctttcagctccattttgagttcccggattagggaaattagtcatttttcattaaatttaattagcctgctctattgttggatgtctcatatcttacatttcctatctgttatgggtagccttattcctgaaaattagatatagcctctgggttgctaatagaaataaatctagctctgttgttgtagtattcttgtttgttattttttttccaatgtttccttgtgggcagcaatgccacaatgttagaagagcatactatgttgctttttgttcctccttgacatgatatgcttaagccacaatgtgccagctggtactcatttaattgaggtctcctcattgggctacttattttcaccagtaagtgttcattagtcatttttttttctgtaacatgggttaaatgggcatcaagattcattctctattatgctgggtgataggttcgggtagacatcagtgccaggaatcctgggcacattcaagcagcattgactgaaaacagaagagttctaaatgagcttgtgttggaacctctcagagaagagcaatactacgaggtgactaatactaacctcatgtttcttatttcttcagtactttctattgtataatatttaataagcagtcaatttccccccttctttttcctagaaaagggagcctttctccattatgtcacttttgaagagccctatgggtatgatgcttggttttatggtcataatggtcttcgttatgcccaaaatgatggagaacataggtatgctgcacacttttagccttttatgtccaaatttgagttataatgtaatagttattacactatattttgtgcccacaagtagcagctatgcagaacaggattcaagcccaatagacattttgcaccatgtagctcgtatcatacttttgcagaaagatattacatttaattgtgttgttcattccacatctctcattctgttccattggttgtaaatttaggccccgttcttttctgcttactcatcagattattgtcgcatattatttgctccacgcagctgtggagccaaggcccagcgaacctagtctggtgccggggctccaccgcatgcagcatacaagcatgacatattatagttacctaattacgttgcttttctgtatctaatcaagaacaaatcagccatgcaaagacaaagtagcaaggcgatataattaatacccacaccatcactgtagttaggatgcaagataatggtaaaaagcatatatttggtaaaagtgcctttttgtttttaaattagcttgtatttgtgtatatttttagttgccattgtctactcctgttatgtaccttctcagttttttatttacagttcgttgcttcattctatgatatgtttttacagtggttcctttcttgagctccttgagcaaaacatttgtgggttagctgtttgtttctttaatcagcttcgcattttacaaaatatttatgtactgctgacatgaaagggctgaaagagcttatgttatttggtgatatgaatgatgtatatatttttaataaatgttaccttataatacttgttgatattatgtatgtattctacctgactgtctctgttttacacttgaagatcccgaggagataaagcaagctcaagaacaaatgaggaactcccctgttccatccttctctggcctattagcaagagcaaacagctagacatactacacggggatactgcatggtttaagttaagtttatgatgggatgaagagcagtactgaacaccacacttgaatagaatctttccctagcacaaggtggaaactctttctccatttttattgtactttaagatgtaataggtttgtgggggtagaaccttctgaatctaactgaagtagcgatgcattattgaattattatagcccagactgagttaagtgtgttgaattttggatgttcgtatatttcacgccttgttgaatcaactatagctatactcatacttgatgttgacctgctattagtcacatgacgttatgatgtactctcgacttgataaacattaggccatgtccatatgcaggtgactcaaattgcttgcttgctcttcacttgattaacatgtctacgtatctgtctatactacaactcttgccagattttaagccgaaagaaagctggaaaccaattatttgattgaaatcctgcttaatttgacacttgtgtagcatactaggctagtagcatgtggccaccagatgggacatgttccactagagtacaatccatgcatactctcagagtctcactacataccttcacacaactggtcacactcaagtcacaaccatgggaaattttgtgctctccaatggcctgaaaaagataaggcaccaaaagaaccaggagccgcctgaaccagatcacacctaccttgcacctcatgaaaatgatgtgtcccattcacagaatcacacaaccttttgtgctgaagaatcaagaacacaagacaaattctaacaaccagacacaaacccccatcattttgaatttggatttggactaatttgtctcctggcatttgtattttagccaattcgactgattctttcgcaaaaatggcctcgtcatcgtcatcttcgtctgagtttgggggattggaggaggtatgatgcatgggaccctgatcgtttatagtggtccgagcttgccattgcaagcaaagatatcatcttcaacgatggcgtcccatgcaagctacgtgcaaaaaggatcatggcattttttttctgccttttcttcgtcccaattgacctttttcttttgctggaaacctggaatatattccttaagaaagttcacaagaatatataaaaaataggagaccacttgcagcagcagtaatggctgtgacaaggaaatgatcaaatgaagatagtagtggtagaagaaaaaaaaaagatagtatttgagcaattgagctgtaccaattgctccttcagtccacttgctgtactctactcatcagtactgacaatggacggataaaatacctactgggatctcttttcttccatgagaccatgaccatccattatattgactctcaaatcttcagtaaaatggagcataacaggagcaagcaaataggaaaagacaatgggatctgccttattttctaagaaatggaaccattccattcagtggcgtgctgcgtgggctcctaaacggtgcgattttgatataaactttctatgtatatgaatttcttagaaaatattttaaatctattttttaactttataagagttaattcattcatttgtagaaaaacatgtcctgcttgggaagttgggaaagcatcagcataaaatttgattttaggatcaattgtcatgtcctttttgtcaattttttggccagctctctttcataaccgctaaagaagacaaggaaagtactcgtatttaaaattttctcccaagcagcttagtttctgacttgctgatttagtcatactgatacagctctacatgaacccgaattattgcagttaggcttccctccaaatctgaccatctgtatgccgtgctgtatttaccatctgtatctttctttattcttccttgtagagaagaaagtgtcggcaacatcgtgatggaaaatgggttgctcccatgaatctagagagagtatagacagaacatcaccatcaagtgtctcacctaccattgcaaaaagattaaattatgattagtatataaatccaaatccatgcaataaacaaggaaaaaaatatcttagacctgcctaccatccatggatgtgtgctgatgtgtgtgagagattatctctatgcataagtgtgaaccatatgctttactttgtgttaatctatgagatggtacatgttactacttaactagcatctcacaagtcacaaggcatatgctcacatgagaaatgggatcttcttcttgatccaattttccttgcacccaactacatgtgaagtgttccaatatgcatttatggagcaaagcttttgcacagctagctgcactatactacaggaattgttctttgttggctggatctattgtttcaaattcgccaccgagtcgcattcgaattgttgtttgttgtcgaacattacaagttacaactcagtgccaactgtatttctgaattcattggtactgccatctgcatcacaaatttttgtgttatcattttagaaaacgttttttgctcgccagtaggttgtttgaaagcttcattgtactttgttttatctgtagtgtttttgcctgtcattaagtggcggaaaaatcgattcgttgatatcataacgtgcctatcggtgtcatagtatgctaattatattataacatatgaataagcagttttgttatatattttgtcgaaagtcgttgatgtagcctgacatcggtcctagaaccgtagatctgcccctgctgtcattagcaacaaaactatcactgatattaatgaacatgtgccgatcgatttcattgagcagtttgagttaagcgtttctttttcgcaaggttggagatggttaattggcatttattttggtttggatatatgtgggtgtcatattatctttctgtataagagaagtaaaggttgctattttggtgccttattatttgtcatgtataattgcagcatgcctgtattttgtatcttaatgtgtataaagaaattgtcataaatctggtccatctggacctagatctacctaatattaggacgactgcttcaattccagctatgcaagtgatgtttccttcaaaccaaaccaatgacagcctttgtaaaataattactcctcaccagcagcatgcagcatgtgattacatcctttaatttcatctcttctcactacttccccttaacaaccactgatccccctgcttcctagctactaatactcaaataaattgctgtccagtacagtacagtacagtactagtgtgcgtggttacataacaagacacgattaaattaagctaagcacatgctctgttgtataggataccatttgagcttgatcttgcacatctctcacaccttttgggtgtgtttagttcacgctaaattgaaagtttggttgaaattgaaataatgtgacagaaaagttgaaagtttgtgtgtgtagaaaaattttgatgtaatggaaaagttgaaagcttgaagaaaaagtttggaactaaacccggcctttgttaattttgcatacatagcttctttgatttaactattcaactagctaggaatagttaatccaaatccagctataattgatggatccatggttgtgtgaactgcagcaaagctctccaagtggattccaaaatatattcagtgttacacgtctctagcaccgacattgatttgtgagatgcttcaaagagtccaaataattgagtaggagtagtatagtataacaacaaccaaatatgcatgcatgcacattgctccatgaaagcatccatctggtggctgcatgctaatgcaatcatattgtaggtgtgtgcagagttgtaaggcaagctatcaccagggaccatgcatgcatcatcttttgggctccatgtccatacagattaaatcagatattaattacgctctttttactcttgctaaagtctattggtggtggtgacagtaattgttccacttttttttttttgaaaaatgctttttactcgacctactggtggtggtgacagtaatttccactctttataattgaaagatgccttttactcttactaaagctgcaataggaggtggtgaaagctttcagttcttcttctctctctgaaaattgcatcaacttagaggcattgcttatagataatagggatgaatggttaatcactggtgtcaaaagaatataatacttataaccatcatctgcagtacatttactagttacctgtactagattttacaatagcttaatctacttaacaaaggtctggttttgacatttcaatcatctcagataagtgccgctacatcagcgtgcatgccgtgcatcagctaacttttgcaaaagcgatatctactatagtggataatggatggaattactattgaagggtgaagttccacgtggaattaattcgctctgccggctcacctcgtccatcatttatgcttctttttatctgtcgatcccggaactaatttacatttaggtcctctttatttaggcttagacttattggtctagacttttaagttagtttattggcttatatgatttataagccggtggatttaatgtcctaagtttagtggttgagtcatacatctacctcacataagccaaaaaagcttcttcaacctagcttttggcttaatagtgttagagtggcttatggcttcaaaaaagccaaacggaaaagctgcttgtttgtttaggcttagacttttcgacttataagttggcttataagcctaaacaaagagggtcttaatatatcacgacatattagtactatcgttttcttaagactatactcctacactagttctactactgtctagctactccctcatgccaaaatattcaaaatttgttctgaaatataataacttcttcacttaaattctcgtctcaacaaattataatatttcaccatttaaatactcatctactttctcctcttaacaattacattcttctcatatttaattttatttttttaagtatccacgtctaattttagaaacttttatattttaaaacggagatggtgtactgctactactgtaattaacgcgaaatcggcacgaacaatgcgagtcaaaattgtaccgtgccgtgtgtcccgtgtgcggatttaggttgatgagaaaaaataaagatgttcgttattcaaaccagatgtctgtaaccggtcaatttcaccattaaactaactcatgatcgagtcgagtcagtgatgagtcatcaccggccagaagatcacctcgatcaacgatgattatctcccattctttaggctattaggccgaattattcaacgagttggtgtacgagagaaattaaccaagctttctgcacgtactccgatgtcttcgtctcgtaatctctcgtagtaaaatattttcgttaagtgtcattcgagagaaaaaaaatagggagaaatctccgggaaagaaggaagagctttgccggtgtgtttatccattatccacttccttatcctaaaacacggtaaaaaaaaacagtattcctacacgctaatacacgtcagattaggtgagacgtagtacaaggtttgtttgaacggcaggagttcaaaccaaccaactcaattgatattgaaaagttaaagaagttgagaaacaaagtaattctgatgcaatacgattaattaaattatttacgagagaccagtgatcttattacgcgtttatgccaaaataaggtcatacaaatgttcattgctgatacgataaacccacaaacctatcgtacgtgcttcaactcaaaacaacactacgtatcactacgataaaaccatactcacttagtactagtactgtttataaaaagtactactggtactactagggcccctttgaatcacatgaataaaaaaacagagaaataggaaaaacataagattctgatagaatgtaagtggaaaacagaggattgtaaaacacaggaaaaacaggaaaaataccggaatttgagaagagataaagactcaaatgatttttttcatgaggttctacctcttgttaaaattcctccaaaacttatattgaaagagtcatttcatagaaatttcataggattccatagggttcattcctttgattcaaagagttttatagaaaaaattcctatagaaataaaatcgtctaaaatttatatgaatttccgttgaatcaaatagcttaaattataacccccgaattgctccgtttcatccggataaacacgagaaatcacccactaaaaaatacagtccaattagtcaagaatccgaacgactgaaaaattacgaaaataccctccaccttccccaccgtaggagtagtactactacagtacacttcttctcccccttcctctccttataaaaccccgcctcctcccacctcctctcctctcctctcctcctcctcttcgcgtcgaatcctcctccgagaagaggagagtacatgaatcctagcgcgaggatctcgcaggtagcaatggcggcgatactgccggacctggcgacgcaggtgctggtcccggcggcggccgtggtcggcatcgcgttcgcggtggtgcagtgggtgctggtgtccaaggtgaagatgaccccggagcggcgcggcggggaggggtcccccggcgcggccgccgggaaggacggcggcgccgccagcgagtacctcatcgaggaggaggaggggctcaacgagcacaacgtcgtcgagaagtgctccgagatccagcacgccatctccgaaggtgagggagggggactgactcacccccgtgtgctgttcgtgtttttttttttggccttttttgggtggatctgagcacgcgcgtagttgtgtagatctcgtgccgtcgcagcggttactggcgctaatttttgctaatttagttgtttttttttggttgcttgtggcgtgaacatgttcaaaagtagcttatccgagcatcaattatggggaatttgcagcacaagattgatataattgtggggaatttgcagcacaggatttatatttttatattgctgtgaagagattataaagctcaggttaagatggcgctgcttttaatcaagcggagttgcgtgtctagcagtagtgcttgtgagcttgtgttactttatttattgtgtgaaatcatgagattcctctgagttctatcgaatttactgtggctaaagtagtattctattgtgtggaatcatgagattcctctctgagtttgattgaatttactgtgtgcctaaactataacgagagctgctacacatacgatttttcacgtacgatacttgtacgactaacgatttccagcgaaagcccgtaacgtttgtctcctgttttctagtgatgcacgcacggcgttcaccatcagttagaaatcatactagaatcgtacgcagaaatcgtatgcatagtattttcgaaactacaactatgctagtatgctagatgtgaactgttacattgttagttggatctacagaaacattaaacaatcatgttcccactttacacagcacatgttataataattcttagtcagtgcgtgctaatcgcgggtcaattaagttcgtttgttgcgtctgctgagatattttattggggagatatttttagtggggtagatcagaacttgaattgctcagttcttagaggccctcacgtaaagccctgcggtggccatgctgtggggataggagaatttactgatggaggaggacaagttattggaccagtggtcctacttattgctcttaggaggataagaagataacgatttttctgcgcacctgcattattgaagcagggagaaaatagtttcattttgactgtatccacctagcttggaaggaatcctagatgcggcgcacatggacgggacgatcttgtggtccattcattaatcataaaccttacatgtaaggttataattcaaggacagttgcaggctgagaggtggtgatttatgtagtttgtcctatgttaggcgcctgctttcttggcaggtttcatctctagcgatgcttgggtgagttttaatattgtgaaagtgttaggttctgtccttttctagtaaagttcaaacgtatttttggaaatatttgtttggtcaacatttctttcttagaagactatagggcttgcagttagtgtgccttacttgtggagtcctgctatgcatatgatctgtttcacaggaaatgctagatatgctaatagtttgcatggtttgtaatttgtgaatctggttttgtggaaactttctaggattggaactttgtttaatcaaatacatttttgttggtttcaattggttggatatttgagatattgggttactgaccagtgaccaaagtcccatctatttcactatttaatttagcctttgttaccatattttggtgctcatgtttatggagtccagtcaaacactacaattagaaaaacaggttcagttctaattataaacatatttatgcgttgctagctttggtgttttatgtttcagctattattattgttatcgctaaccttttcttgtcattgactaattgttgtatatttgtatgcgtctatgatctaaatactgttttttttaaactgtaaacaggagcaacttctttcctcttcactgaatacaagtatgttggactattcatgggcattttcgcggtcctgatcttcctcttccttggatctgttgagggattcagcacaaagagtcaaccttgccactacagcaaggataggatgtgcaagcctgcccttgcaaatgctatcttcagtactgttgcctttgtgcttggtgcagtcacctctcttgtatctggtttccttggaatgaagattgcaacttatgcaaatgccaggacaacccttgaggcaaggaagggtgttgggaaggcattcattactgctttccgctctggtgctgtcatgggtttcctgcttgctgcaagtggccttgttgttctttacattgccatcaacttgttcggaatttattatggtgatgactgggaaggtctttttgaggctatcactgggtatggtcttggtggttcttctatggccctatttggccgtgtaggtggcggtatttacacgaaagctgctgatgttggtgctgacctagttgggaaagtagaaaggaatatccctgaagatgacccaagaaacccagctgtaagaattctttcctgacgctttaaaaacttgtttcttaatattacttgaaataatttgttttgttcttttcataatgatttgtgttattgagcaaagcattaaaacatcgataggaatttatgtgcatgcaagaatgatcatttcttcctccttttgcaggtcattgcagataatgttggtgacaatgttggagatattgctggaatggggtcagatctctttggttcctatgctgagtcatcttgtgctgctcttgtcgttgcttcaatctcttcttttggaattaaccatgaattcactcctatgctgtacccgctcctgattagctcagttggtatcattgcttgtctgataaccacacttttcgccactgatttttttgagatcaaggctgttgatgaaattgagcctgccctcaagaagcaacttataatttccaccgttgtgatgacggttggcattgcacttgtcagttggttaggcctcccatattccttcacaatattcaactttggtgcccagaagactgtgtataactggtatgcccatatttaaattggaattccatcttttacttagaacttcattgttaaaatcattgacctcatttccctgattttgataggcaacttttcttgtgtgtggcggttggtctttgggctggactaatcatcggatttgtgacagagtattacacaagcaacgcctacaggtgcttataagtctgatcatattcaatgttgtctgtaatcttatatatttgcttctagtccctcatgtccctcacaccttgaatttcccttgtccagccctgtccaagacgttgctgattcctgcagaaccggagctgctactaatgtcatctttggccttgctctgggatacaaatctgtcattattcctatttttgctattgcttttagtattttcctcagcttcagccttgccgcaatgtacggtgtagctgtggctgcccttggaatgcttagcacaattgcaactggtcttgccattgatgcctatggccctatcagtgacaatgctggaggaattgctgagatggctggcatgagtcacagaattcgtgagagaactgatgctctggatgctgcaggaaacaccactgctgccatcgggaaggtaaaactgcttatcttgtcgaaagtgtttttatgttggttttatgcttcatttccactctgaagtcaattaaaaatttaaaattgtgtttgcacttgtaaatatttttccttttgttacaaatgtcacaattttaaagttaattcccatctccatgattgtacttgtagggtttcgccattggctcggcagccttggtgtctcttgccctctttggtgcctttgtgagccgtgccgccatctccactgtcgatgttctgacacctaaagttttcattggactgattgttggtgctatgctcccatactggttctctgctatgaccatgaagagtgttggcagcgcagcgctcaagatggtggaggaagtccgtaggcagttcaactccatccctgggctcatggagggcacaaccaagcctgactacgcaacctgtgtgaagatctccactgatgcatccatcaaggagatgattcccccaggtgctcttgtcatgctcagccctctcattgttgggatcttctttggtgtcgagaccctctcaggactacttgctggtgctctcgtttctggtgttcaggttcgcacattctttttcacagccacactctcatcacttactcttgccatattgcattcataaccatgttgcttcctttcagattgccatctctgcatcaaacactggtggtgcctgggacaacgcaaagaagtacattgaggtaagaacttatcagccatcttccatcacagcaacacttgacgtcaagcagtttttttcccctcccatattcgccaaacattataactctcgttctccctggttttaggctggtgcatctgagcatgcaaggaccctgggcccgaaaggctcagactgccacaaggctgctgtgatcggcgacaccattggggatcctctcaaggacacctcaggcccctcgctcaacatcctcatcaagctgatggctgtcgagtcgctcgtgtttgccccgttcttcgccacccatggaggcatcctcttcaagtggttttagatggtgacgatagatttacgaggacgttatttttgccaggagggcgctggaaatcatccatatattatagagttcatcgagttgacacatatagttccctccgtttcctatttgttattactgtctgtccatcagtcgatcatgctaagcttattagcatcatacctgtgtctagtttttttgagtctggtagttgtagccgatgggagcaaatcactggccacctacaggtttggacaagagtaccttgaatttgcgttttcctgtaggttggatgatacgatgatggtgatgattattgtacgtgcacggaatgcacctgtctcagtgaaattttcccgggaaggttctgctgtttctttatgtccttgtgggaatgttaggatgatcttgtacaaaaaagaaaacaactctagtgatagggggtggagtacatgtgtgccaactaagtttgagttgtcttgaattattgaagtaaaatactttagctaaaatgacgtagtagtgcgtgtgcttgcttttgttttaagatagagaattatagtattattttgtatactatattttcctcctttcttgcttcgttcgtttcatattataagactttctagcagactcacattcatatatatggtaatgaatctaaatatatatgtgtgcctagatccattaataactatatgaatgtgggcaatgctagaaagttttataatatgaaacggaggtaataatatgaaatggaggcagtatcttatattttctttatcctaaataaataaatctaaatttctggatatgatagatagtgtcacattttttttgataggtttgttagaaatttattttgaaacgaggaattacatctacactctatcattcatattgccaacagggtttacgattccgatagaccctttcgttttggccactggcggaatttgaaatttcgcgaaattcggtgaaaaaccaataaattccgaacaaatttcataaaccaaaatttgaatacaaattctctaaatttgccgacaaattctcaaaaactggtcggttttggcgaaattccgatcgaaatcatcgaaatttcggatggagttcttgtcaaatactgctgcttttcggtttaattttttattcttttctttcctgatgtaagtttcagtaaatacacataatacattatttttttcgaaaatttatatcccaataggttctatgaatatcataatatttataagattttatttgatttattctttttttatcaattcaaatttgaatttaaatgaaacttctcaaaatctcatacggtttttactttcgagcctcgtcaaaacatcaaaatttcgcgaaatcttaccggatttcgtcggaatcgaagaccctggttgccaatcatcagcactaccatcaataaaaataagaataaatagtagtactccatagtccatactggagtagtgattttctgccggcgactcggatattaatcgcagcaactaatcgactcctcaccattcatctcaaaattcaaacaacttcttcacttgatgaagaagagcttcccatcagaaatcgatccccattcatctcaaaatcaaacaacttcatcgtgcggacggcgtcgccggtgccgggcattccttcccagccaccattcttccaagcgcccgcggacgcccacacctttccttcgggcatcttcgccggtgagcctccgccgtcgtcttcccggcagcccacccagccgcggaacaagcctagaggagcggctgctccaggggcaaggcggagagaggtcagtgactcagtgcgtggtgaattcgagacgctagcttagaagggcttggagcctgaaggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18521 - DNA, 12763 bp, Oryza sativa
  unsure (1)..(12763): unsure at all n locations
atattaatttccgcggcttcagggaaataattgacagcaacgatcggctcctcaccttcattgcaatttataggacttcttcatgtatgaagataagtctccatatgaatggatcccctttatgtgagaacaacattatttcgtcgacggtggttctggatgggtcatccattagaagggccattctcacaagcgcgcggcacgtttgactttccgtagactatgttcgcggtgagctgcgactatagtttcgccgccagtcaaaacatgcggggtcaaagcttagagaaacggctgcttgacaggcaagcggaacaaagctcagttaatcagggcgtggtgaaaccaagacgcaggtctataaggtcttggaccctcatgaagtgntggagggggggggggtggggagacttccggtgcgcgttgacttgctttcctcgttcctgttttgccgccatggttgggttcggagagattatcgcctccgcggtgatcaaggaactatcggggaagctgggctctccgatttggaacacgatcatgtctcaggtgaccttcagagatgatctagaagccatcaagagcatgctgagcagcctccaagcgaagctgaacgatgcggagaggaaatcgcagacggatggcagcgttcgcgacttgctgaagaaactcaaggccgtagcctatgacatagaggataggctggccgtttatgaatcgagctccaacgatggccatgatggttctctcagacatgtcagcatccttcctgatcatgatttctcgtttaaatgcgatttttcagtctaactttgtgtttgctaactgacaggaatggtcgagctttcctgaaaaattgaagtcacgatataacttgccaagggagatgaagaagatgaggagaagacttgaaggaataaagaaagaaatggatctcaccagctttaaggtagatggtgccacagaggagcaggattcttatatcagtcggcatttagagcctagaagatacagcagtgaggatactgtcggaaggatcgcggagaaagggagaataatggatctgctgctatcagatgaagaacactccattattcctatatatggacttggaggattaggtaaaaccactcttgctcaaatggcttttagtgactgcacaacacagatagcttttgagatgctagcatgggtttatgtgtctgagaaatttgatcttaatgcaatcagtttatctatcaaacagcaatgtaatagccatacgctccaatatggtgattctggaattcataatgttgctgtggagtctatcctcacggaaaaacgatgtcttattgttttggatgatctctgggaagaaaataattttaagctggatgagttagaggcaatgcttagactctgcaagaaaggtagcaaggttattgtgactacacgtagcaagaaggttgctgaccgaatgaacaaagatttgcaaattgaattgggtcttctaccaaacgaagactgctggaccttgttcaggaaaaaagcacgagtaccgacaccagtgcctccctacgtggaagcgatgcgggagacaatagtggagaaatgccaaggtttgccattagctgtaaaatcccttggttactttctaggaagaatgcgtccgactgagtgggaacaaaacctacatagtaatatatgggccgaaaaagatgatcgttttccagataacggagttatagccaacttgaagcttagttattacagcatgccttgttctctgaggttgtgctttgcatatttgtcagtcttccccaagggctcccacatacagaagagcagtttgattcagcaatggattgctcttggattcattcagcccccagaatccatcccgacagaacaatacgcagagtactgcttgcaagaactcattgaaatgtcctttttgcagaatgtgaacgcggcaactgcggtatgcttcctcagccgcaactctttttctctcttttttcccattcgattgatttccaaatagtattattatacaatattttatcaaaatttcacatgatattatatgtaaaaatggtggtaatcggaacaaatatgatagagaaaaatgagtttatagataaatgtaatttgaaggaatcgagtaagcggaattcaatggaaggatcacttttgctcggaatggtaccgaaactagtggtatgtcaatggtcaatacccaattgaaatttgaccaatatttagaatggaaagacgcatcacttgttgcatactatttttgttagtggaatgataaataccaactactctggctaatattgaaatggaattgataagcttgacgctccctcctttcactttggttgctgtggaggtgtccacaacatggtggtggatgcacacaggacacaaaaaatgcttagctttggcagtctacttctgttgaatagacttattcatgggcagcctagccagatcttccaccattgggctaaaattttgggcccaaagtcatgaaaaaagcctaaagcttgaaatcagaataaaacatatgcatgcaccaacaagttcaatccaaatttaatcctgaaactaattggataattggaatattgtctttttgttgacatgctatgatatttggatttaaaaatcttgcgaaatgttagatgaatattgtaccaatgttactattttttttttcagttttttcatagctatttgtactgagattaaatgagtagcacataaatttgatgcatcaaatgcaagcagcagtggtttggtgatggagtcatgagtaacaccacccatcaggttaagtattatgtacatgtgggcgcacattcaataggattttattgaggctagggagttgacgctagtctttgtctctttgagtatgtgttaaggggtgtattcatggaggtgtcagatgtggtttgtgtccgtgagtgtggtgtgctggtggagtggtgtgtgcccgtgtaatgaaaaagaagaagaagaaatgcctgttgtagacggctgcaccttggtcgtacgcatctagtattaagaaacgacgggcaaattgaatttgaactccggataagctctaaccattttatgtgctgagttgggttagtttcacaccatataaaatgcattcgtgatcatgcatagaaagaatgtgtctgtcttgctgttttatttatcctactctgtcaagtgactaaacttaatttttcagatgtctgcacgatatactgagcctcacaatgtactcaacatgcatgatatagttcacgatcttgcaagtgtaattgcagctgatgaagtatgtatctttcatgccagtgactgcagtagctccaacactaaaaattgctgccgctacatgaacctcttgaaatttgagtgaattttcccgagatcccatattgcccaatacagcaagagcgcttcatttcaaggattgcaggaaatctcccaagaattattcagaaactaaattcttgcgcatcttagatttcagtgcatgcaccatcaatgaactaccagactcgatcagtcatttgagtctattgaagtacttgaatgtttcaggcctaagtggcacattacctaaatcgttgagtaaactacatcacctgcaagcattgaccctgtcaacaaacattgaccttgttgagctcccttcctacatttgtgagtttctcaagctacagtatttggatctacatggctgctcaaaactgaaaaaactaccagatggcattcacaaacataaagagctccaacacctgaacctatcagactgtacaagtctagaatcacttcctttattcagttcacagtctggtgggcttcaaaaactttcattccttaatgtatcacattgttctcaacttgtaaagctgtcgttcctcgaagaaaaacttgagaagcagcctgatcattatctgccaaacatggtacatctaaatatgtcattttgccccaagctgcaagaactgcctactggattatttaagcacatgaggaagcttctttttttgaatttctctggttgtacctctcttgaggatcttcctgaatttgtagagcacgacgctggctgctcgatgttggaggttttggatttatcgggttgtgctaaactgcctgccctccctgagtcttcaactgaactccgtgaactccggtgtttgaatctttcaggctgttctaaacttcaaaactttttgaagttgattccacgatggaagtttggtacattagagtacctcaacatctcgggggttggcgcaaaaagtgattctgaggcaccaggtacctctgcagaagaccaaagttcacaagatcccattaaagagttagagttgggtatgctgcaggaagatatcatcacccaaggcttgtttcgtctgaagtacctgtccattggaggattcactctctactcggagcaaggtattgcaagaatggtggaccttctgacactgcccaattttaatgtacgcctgcaagatgatgggaggtgcagcaatattttgatcctccagcaaatccttgatgttacacatcgtcaactcaatatcaagtgcctagagaatgtggtgttttcagaggaagcgaagcagcttgaactggacaggatgcgacagtttcattcgttgggtttcgaatggtctttatctggtatggtatcttctgttaaacaacgagcagtgctgggtaatttgaggcctcataggaatttacagtccctctctataaaaggttacatttgcaccgaatttcctgattggattaacaagataaatgatacactcccagacttggtgaaacttgtattctctgatatcaatggttgtaactatatcccaattagtcaattaccaaatttaaaagagctagaaattaataatatgccccggcttaacaagatatatggtacgctcccaaacctggtgaaacttatattgtctcatatcgagagatgcgaccatatccctgtacttggtaatttaccaaatctacaagagctagaaatctataatatgccccagcttcatgatgcacgaattgggccatgcaataagctaagaagactgacactggtaggactaccaaatgaggccacggtacatttattttatgatatctgtacacacacagaagtacagatggtggaatcaagtcatggctgcgatgaagagatgacagaaacaggacaagagttcaacacattacctggctgttcttttcgtaaaaacgaagtgagaagaagtgaggaactttctagaggcccatccactgaaaagggcaaggtaaagaattggtttgacgctctattattatctattggaggagcaagggcaaagaaaacattggcctcagcattgtcccacatttcactagtgccagaagagtcccagttgtcaccaaaactgtctcatggttgtttggaggtcacaagtgcagcgctccccgaacttgattacctacaaattggaagttgccatgacctgaaactgcatcccactcccccaaagagcaaagagtacttcgtcaaagatagcagtctcagtctgcctgtagacaaggaagatacttcaagttttccatcacgtgcatatgatcagtatactgaaggatgctcacattcaggacaaggtactgcgatccctccacacgaacatgctatgcagaagtcgatccctagattgaaatcaaaactgcatatcgaaggctcacgagatcaacttcgccaatggacagaacttctaagcacccacttggacgagttgactatcactgacccattgttttacaattcgaagtatttagaggaagagagcacagttagtgaacatgattccctggagagcatctatggtctgccacagtcatgcattgccaacttggagaaaataaatttaccgccatctcatcaatatggactagaagaatgttctaactatgataatattgtggactttgtaggtagaattgattctcaggttccgtatatcaatattggaaaggtatgtagtttctttgtttctagcagtaccaagcaaatttactgttaagtctagtagatgtcaagggtattagaatactttcccttctcttgtgtacataatatatatgctatttagggctaaatcaatgcactgttgaaaatccccaattcactaaaattaacatgatatgagagcaccggatttctttattccggctagatatggcaaataggaattccccgtcgaggaatgcatccccatccctgctcccgcgaaatacaatggggaaaacttgttcctatctccgcgggaattaatccccgtagggtctacatccctgcttaaaacaatatatagatgtgaaattctatatgcaatgcaacacatatattcacactttatattaatatagcaacttatacccactaatacatatgataaaaacacaagattaatcacataagataagtaaacaaattaaacttggaccgaaaattaaacttgaaccctatgcgggtctctgtaggggacggggacggggacggggaatggaggatcaccccatcccacgaaacctaacaggacatgattcctaccatttaattcccatgaactaattctaaccttccccctaatagagggatatatttggttgcaagggtgggatggatcaggataggttggaccttttttaggtttggttttgggatgggtgggataggatggttctcttaggtagtgtttggttggagggatatcccgggatgggatgggatgatccccaaaaccaagtgtttggttgagagattaagagggataggatggttccaaaaagagaatattcctccaatattcgggacgatctcatccgcgaaaatctggcggacggcgccatcccacttcgcacgcgcgcggtaaccctctggcctaccttttttttcaccgcacccctttcctttctccttctctcaccggcggcgggagcatgtgtttggtttcatgactaagtgggatgggatgaagccatccctggttttggggttggaatcatccactcatctgtttagttcacgggatgggcttatcctagttttttgtttggttgaacggatgagagagggatgggatggacaccgtttgcagccaccgtcaacaattgccaagtgggcgtaggagtggcgaccaggcagaggagcgtgtgcggcgtgggctcgcgacagcgggtgggcacggctcgcgagcaagcctgcgacgagaaggcggaggagtggctgacgctggctcacgagcaagcaggcagaggtgcagcgcgggctcctagcaggcgggcggcgagcgcggccgaggagcgcaagcatgcgggcgataagcaagcggaggagtgctcgcgggttggcggcgagcaggcgaaggagcggcagccggcggctgggtacgcgagccacggaggagctcggtgatggtcggagaagtgggcgagcaggcggacgactagcgacgaccgacggtcaagagaagctgcagcggtgactgacaagcaggcgacgatgattggcgtgcgggtaggcagacgtcgggcgggcgagtgaagtagcggcgcacggttcacaccgtgcgcccgtcgaagtgggtcgagatgatcagctcgattttgccgggcgctttggacctggatctaacaggaatattcctcgagaactccccgcgagacaggggcggacctaggccttgggccacctggaccgtgacccgaggcctaggtgtgaaggcccattaggatggtattttttccaccatgtaaacagaacacaaggcctaagtccatcatcttcattcttgtttactcgctgcactgcttgctgctgctgctctccagcacacagcttattgttcatcatgtcactacttctagactagtggagttgatatgccactgctatttgggccagcttggctattattctagctggtagcttctttggacatcctatcatgcatatctagtgcttcaaggctgatgcaatctgctggctgttacatcccactaagtatggcattctgctacaaacatatctactagtattccttctttgctaatacgttagtgtaattgagcatgctgctagtgttattcgctatttcaagtcaattacaatctactgaatccatccaagtgcactgcatctctactagtttacttgtgtcttttgctagtatgttgcaatgtccaatagtttccatcctgtctaccaagtccattgcatcatggtatttttgatggcatattattatttcaatatgaattatccctacaatcttcagctatgataataggatttaaaaagtaattagtgctccgtctttctacttgacaggggagccttctcagagtgtataattagtataggtattaaaaagaatggatttaaattacccaataacaaacacaaagatggctctgccatcactgctccggagatttgcggatagttgaagcgttgatactggtctcatgcataatcgatctatataacctggctaaagctcaagcgtgctgctttgaggatgcacacgtattacaaatacatgcaagcttccagccttccatgcgggtggtcacataaaaagaaacatataatgtaatgcctgcgcaggtgcataagctatcaaattgatgtgctttttacagcagatagctgtggctgctattatacttactagcaatgttcgtttgggatttaaaaaaatggtagttgtgtttacagattatgcctatgtctaaaaatgcaggtgggcactttttccgtaaaaccaattgaggaaggaggaatattctgctcaagtaacattccattactgtataaacactatgacggacaaagtagcagcctggtcattaaaaatcttgagaatttgaagggatcactgggtgaagtccaagagttggcgaagtatcagcaagttcgtttggtgtggtccagaagcaatttcattgaggattcaagcatggctgaggacaaggcagttctccaaaaactccgaccccaccacgacctggaaacaattgaaatagaaggctatcggggtgatgaattttgctattggatgatgaatataaattcttcccttccaaatcttgtgactgttaaactgtctaacatcgcaaactgtcaatgtcttcctccacttggccaattagcaaatctggaagtattgcacatctcagatatgcctagcgtcagaaaagtggacggtcatgtttacggcactgagaaaccattcaggaaattgagagaacttgaacttagtactatgaagaacctagaggaatggttaaccactacactactactaacaggtcacaatgaccatcagctttcacgaagcgaagaagttttccctaatctccaggttcttctcattgcaaattgtcccaggatgagatttgttccaggtttccctagaagtcgggagtgtaccctcgagaaaagctacagcatactattatcatttgaacagttcatcggaagctcaaacttggccttgatcgcactgaaaataaatgactctggctcatcatctgatatcgtgaaatttcttcaaggctgtgtaaatctgttgtatttgactattgattcctgcatcgatctaatcaccttgccagaacctatcaaaaactgccactgcctcaggaaacttgagataacgaactgctggaacttttctgtattaccggagtggttgggagaactaactttcctgcagaagctagatattcaagcaagcaaactggaatatttgccacaatccatccaacgcctgactgccttggaacggttggtgctcaacaagtgcaactacaaactgcgtgaacggtgcacatctagagaggataaagaaaagattaaacatatcaaaacaattgatatgaatgaggtaactccgactctggatcggtaaattattttgtagaggtgcaattccatcggtggagcagtgtggaactgtggatggaggggatagagagaagagatatgggagagttgacatgtgggaccaagggtatttctaacaattcacatgatttttttcctatccaaccagaaatgattattttaataggggcagtgtccaccatcaaatatccaacttgagagcgtcttcccccaaaacttcacttacagtgtccttcagctaaaactacgaagttacaacgccttgtatcaaaatttgccttataaaaaaatagtaatgcaaaaattttaaaacgtgtgcacaaacttctattatgtgctagtaggctagataaaaaaaattcacagctttttgaatcttccagtggtcaaccaattgtcaactcttacacgtatattagggcattttaggctttcttttagaaggtatttggtatatggcatattaaagaaactatggataaacttggtagtatattatagaagggacaaagttgatgacaaaccatgaatcagtgcaaactcaatggcatagtaaaaacatcattacatgaccggttgcaccggcctaagccaacctcaagctacctccagtctaactacgcctccttggtgttagatcgtggttgctctgcactacgcccactcaaacacttgttcacaaccattgttcttatttacaccttaggactttatttcatcacaactatgattaactatgtatataatcatggtgtcaaccccaacgtgtggtccagttcccgatggcacacatctgctttagttttttggtttagatacttggagtcttataagatttgaccaatcatataaccaaaatggtaaagtatttaatttgtgattggagtgactagcatacattgggtatcctatgctagatgtacaaactatttatatgcaaactaccatgatatatctctatggtgattcaacttcaactcatttattgattaataatgtttccaaccattctgtgtgtatgttaacattaaccattggaggtcatttacacctactcccttcattttaaattacttttcgttttagttctatccatagtcaaaacattcttaatgttaaccatcaagttctagaaagatatatagtttaagattcactatgagaaactctcatatgagtaatgcatatttcgcatgttgttaattaaactatgtaaatttctagaaattgatggctaaagttaggaatatttgactttaagacaaagaaaaacgacatgtaatttgaaatggagagagtatgtataaactaacttagatgcaggtcaagcttacatcattacggcaagttcaccatcatttatatcttctttttttcctaattgtaggtccctttgatgtacttgactccaagctatataatgcttcttcagcaagttactagttctcaatttatcgatctgcatattggtggtctggaatgtatgattggcttgagggagatggagaacttagaattacagacaaaaaaggagttatcctcgttgagtttggagtggtcatatgcctatgctgattccagcgataaatacgcctcttctgagagagggatgcagaatagggctgtttttgaaaagctccagcctcatgatagccttgaaatactttgcataaagaactatgctggtgttgatttccctcgttggatgtctttactcccaaatcttgtgcaattgaagatagttggcatgcaatttgaatatctacaccttgatcagtttcagaacctcaaagagctgtttctctccagagtgcaatttgcgcatctccacctgaatggtctgcagaacctcatagaattgtctctctctggcctaaaatttggacatctccacatcgatcagttacagaacctcagagagctgaaagtctccggtgtggaatttcaacatctccaccttgaacggttacagaacattacagagttgaaactctctgaagagcgatttgaacggctccatattgatcagttacagaacctcaaagagctgaaattctccagtgtggaatttggacatctccatcttgagcggttacagagcatcacaaagctggaactctgtaaaaaacaatttgaacatctccaccttgttcagttagagaacctccgacagttgtatctcttcaccgtgaaatttgagtgtgtcgttttgcatcagttacagaaccttgaggagctgcatctttcacagatagaaagccaaaagtctaacaaaccggtttgcatcgagtgtagccaaccacttaggaagctccaaaagattgtcatgaccaaaataataaacaaagggttacaaatatccgtgcaaggaggagagggtgacaaaaatttattcccgggtcttcagcatttggaaatggaattatgtgagaatttaagattccaaccatccatcccgaggagcacccattacatcatatcaggggaaatatatttcgataaatttaattaccgtagaatattgggttcgttcctgttcccatcgttcaagcaagtcatggggacatcaatccctggatcaacatccaggatggaaatcaagaacaccagtggtctatcttccgaaagatggaagagcattccgcacctcgagcttctaaacatcacagaactaacaatagacaaatgtgttgatagttgtnnnnnnnnnnnnnnnnnnnnnnnnnnnnnnnnnnnnnnnnnnnnnnnnnnnnnnnnnnnnnnnagaatggggtatcattcngccgcatg

SEQ ID NO: 18522 - DNA, 4524 bp, Oryza sativa
  unsure (1)..(4524): unsure at all n locations
gtggnnnnnaatgnatttgctcncttcnnnnnnnnnnnnnnnnnnnnnnnnnnnnnnnnnnnnnnnnnnnnnnnnnnnnnnnnnnnnnnnnnaaggctttttcatctttaagattatatagttaatctctagtatttacgtgattgttgagctcggttgcagttaaccaggagtactaacaacatgagttgcaaaattttacggtacctataataaaagagtaattttatcattcttgagaagataccagaggtaccatattgtattgtctagtgtaaaatttagtacctttagatactaggtattaccaaaaattttaagtagaatttaggtacctcaaatatttttttaaggacggtaaaatttctcataataaaatttatggtctccttagtggttttcagtttaacagctttaagctgtaatttgtttctatgtatttgggtatattcttctttgcgtctgtgtaggctagctgtggcgttcaagaaggcacttgggtctagcaattgccaaacgggccatagtacaaggaaatggactggattgttttttttttcttttccactgggcgatgccggccggaatttatgaagattatgagaaattggcacatatgaacaaacaacaagcctgatgtattcaatacagtagacaacacctatcaaatttgcaagatacctggctctacctttcatccttcgtttttgatcgtgtggcttccaatttcgactgtcaattgtcatatagtcagttactatgcaggatagtagaatggagaacgtttattcagttatactagtatcttgctaatacctgccttttgtttgaggattctaccaggtcaaatctataatcgaagggtgtgtttagttcacacaaaaattgaaagtttgattgatattggaacgatgtgatggaaaagttgaaagtttatgtgtgtaggaaagttttaatgtaatgaaaaagtggaagtttgaagaaaaagttggaaactaaaccaaaccgaagtcgagatggaaggatgggccttttctgtcggccttaccagacggctgcgaaacgaggggagtgtgatggtagtggtttatatgtgtacagaaaccgagaaacaaaggcatgtggagtatccctccgtccttaaaaaaactaatttttagagatgaatctggacaagcatttgtttagattcatctttagaagttatttttttagacgaagtttttagatctgaaagcatatgacaaacaccaaaagaaaggacagatatcattcatcatccagataacatcgctttccagcctctcacaaatgctcagtggaagcacaaaaaattattctcaatgaccacttgtgatagtctatgatttgccctgtctttagccttgatatgccatttgaatgacattttctgcaccaatgacaaaaaaggagatgaattaggaaaaatgcaaaagaaattgcacatttggggaaaccatccgctgaatatgtacttacctcagatgtacttaaggcacctcggccttcttcagcctctcgacggtgaacttggcactggtgagaatcagctcatcattgtcgccgtagccctggaacccatccttggagaagtgcaactcatgctgatccccattgacctgtcaacagagaaacatcagtgaacaatggatttcatcaaaatttctggagcttttttttttaagaaaatgagataaacccggcctctatgtctaatcggacgcacacagccaaaccaaaatttctggagctaaagtgctgaacttcaccttgttggcaatccagtagggtgccgggctgaaagcgatagggatgtgtccatcgcaatggattaacatcaccatgttcttggaatcaggggtgagggctttccccttgccgggtatgagggagactgagcccagggagccacagtccttgcactacattcaaacaaacagatggaagcaaaaatttagaaaccacaactaacagatggaaatgaaagaagaaaatgcatccatacagtatgtcacaggtcggatagcacatcacgaatgccatctgacctagatggtgagggcaggggtgatctgggaacagacagatctccttggcagtctccccacggcagacgtcgcatgtcaactgcagatcaaatgaaacaaatattaccacctaattaactgttaacctataaggaggatgttttattggagaatgcaaaatagaaatggttccagttaattagcttaacagctagatcaaagaaggttgaatatgtgagtgtgttgattatttttttgttaaactgctaaatttttggtactaaatataagtaacggaatccaccagaatcctacgtcccacagcacacaatacattaaactactactaccattcatatgaacaagtgaacaatttttttttctgctaaagataagtaatccatcagaaaaacgcggcgaatccaagcagctggccagggtgttcttcgcaactttttttttaacacgcgcttcgtatttttttttctactaggcctgtggaaagaaagagatgcaacgggccaaaatcagcccaaccaaacagctcctaagacagatcaaacaccaaatctttttttaaaacaaactaacactttgatcagccccaaaactaccacgaatcagtaccactaccaacgacgacatggcacacagggagttcatcctggaacggaaagaaagggatcgattattattcgtatgtacctgaagatagtaggcagtggctgtaccgtcgaaccctcccatgggttccacacggacgatcccatccatgaccacctcgccgaacagcgcgtagtacggcatggtgacgcgacggcggccggcggcgatggcactcatggcgagatgcttccaagaagagcgtgggctgcgtgacgtacgtgaccgtctcaaggcaagggctgttcttattttcaaagtttcgtggctatcaagtcgttggtcgagcagagggggtgaaaaggttacaaggaggttacatgttgtcagcggcggtcggcgacacgcatacagtgccacattaactgctttagagctcctttaacctgttaatcgcggctgttgttttttccctgcaatttggccttctcaacccagggtaaacccgttttcccttcaggaacgcgtcacgtgtttgaaacccaacttaattaacgtggaccggatggattagctcggtaataaaagaccggtaattaacgtgaatgcggttttgctgttcgggcaacgcnccgccccgcgtccagagtgttcgtccgcagccaacttcgggcacgcctcggcgtgagcgcgcgcgcgcgccaccggccgcaacgccgcgcgccttgatccatccgcccgcgaaaacgaataatccaccgctgaacccccgtatctgggcgcggcgccgcgtgcggcagccgatgcccgcgcgcgcgcctacgtatatgtttctgtcgccgccattgcagcgcagacgtgctcagagcagcgaagcgaggtgagattttgggcgagataggaggaggaacgtgatcggttgctcggctcggcatgaaggtggagcacgcggcggcggcgggtgctattcacggcttgcagcagcagccgccgagcgcggcgtcgctggccagggccagctctggagtagggccataaggacgatggcctagggccaagctaaaatggggggatcctgtatagatatttagcccaataggctagaattgatccttctcactgattagaattgatgatccaatccatcgatccttctcactgattagaattgatcggttcttctaatttattttttgttccccgttaaattaccaagattagggacttagggttctaccgttctgggttcaaccgttcaagagattatacaaccattcagtgcaccataagtccataagctaattaaattaaggtatatggtggatcagttttcattaggcctaggcccttgattatatacatttttccctcactgattttaggtcatagtactttgtttctactgtgtgttttttaagttatcaatcatactatcgatattatttatcgagaacaaattgttatattgcaacttgcaaactgtttgatttattatttaacatgttagaaatgtttatttctgttactatagtatagatgctttatagatattacaagttaaaaaatagccttaacttcttaacttctaaagggtctataatgtgaagttcgcctagggccctttaaaatgttgaaccggccctagtcgctgctctccgcggcggtgcagagatgctgatggttcacaatagcgataagaccatcaagaagccgccgcaggcgacgccggcgagctaaccgcgcgtagatgtaggaatgcagcgattgttcttagcttnnnnnnnnnnnnnnnnnnnnnnnnnnnnnnnnnnnnnnnnnnnnnnnnnnnnnnnnnnnnnnnnnacagagcgagtcattacaaannggnggccag

SEQ ID NO: 18523 - DNA, 30767 bp, Oryza sativa
  unsure (1)..(30767): unsure at all n locations
gnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaaggtgacaacactaatgaaaatgacttggaaaaacaaaaactcattaaaagtcgagctggattatagtactgacacatagcccaaaatgccattttctaaagcagctagcacagtactaattgttcaccgttaaccattgttttatcgtgatatacgtcaccatacttaatccaaatccaacatggtctaaaaatcgtccatcctaatatcctgtggacttgagatgatggtatcgcgcatcactgtgccgttatttcttgcaattttgaggagttcgatatgcacgattctgtagtgatatgggctgttagtaaaatatccaagtgaaagggcacccttttgctaatatagggtgtgttcagtttgatgccaaaactaaccccgccatttttttaatgccaacaattgataagatataactatacaacatgataaactaaagattattttaccaatgctacattgtaactcagaaacttctatcataataaaagtttgagaagagatcaacctaaatacatctaatgctactgtataatttggtaccagcaaaatatgctaaaacttggtattaccgaattctggtaaattttggtatcatatgacgtgttacagtatttgagacatgtttatgttgttacttacgaaaatttgggattgtcaatgccagagaaaatggatatttagccatgttcaaaacacggtttcgctagaatgccatcccgaaaatgcgattcgataaaatgccaatatgaagcgtgcgtctaccgccactttggcatttttgccattttattcattttcgaaaagattttctctcatctactaggtgatgagataaaattgccccttatcaactcagtcgaagctcgtcattgtcggggaaggtggcggcggtgggcaccggaggtcgcgccgttgcccgtgcccatcgtcgaagaagtggttggtagagggcgccgccgtccggctgtggatgcggctgcccaaggccgtggtggctctcagcggcggccttcctcactggctccaccgacgaagtcgtcaccaccggcccaatctcccactacctccacctcctccgctcccttcaagccgtccccaccgaccgccttcaccatgcggcgccaccgttacgttgcccactgccaccgcccgcggccccaatcttgtcgagctccggtgagttgcaagtggcggtggaccttgccatgcctatgctgcgcgttgtcgccgccgccgccgccatgctctcgctcgccgccttctttgctccggccacgtggacccaccatcgggacgccacctcgcactcctcgttcgtccgccttcaacgctcactcgcgcgatcccgccgcgtggacctcgtacaccgggcgctcctgcagcggccttcctctcggctctcctcgagggccgccagctgcacgcactcgccgccaagctcggcctcgccccgtcccacaccatcgtcgacgcccttgtcagcaacgaagaccacctcgccgcgctcgatctcgatcccctttcagccgacgagcaggggcaatttggtctcatcaagctgaattctagcgaaaatggaattgaaaatgacgaaaatagagaaaatgacaaagtggctatgattgcgtgtttcatattagcattttagtgaaacacgtttttaggatggcattccaactaagccgctttttgaacgtggccaaatatccattttctcgtcaatgccacggcatgtttgagttagcaaaaactgaacacgataaaaatagagcaatttgtacaaatgcgacaaatagaggtgtcgaaatgaaaatttcccttctagcgaagagaaggagaagcacgcacgcagcacgtgaacttccagctctaaacccttccccctctcttgttccaagcccctcctccccttacccccccgccgccgccgccggcggcgncttatcacccgaaaccctagccccattcgccgcggtcgccgcctcacccgaaaccctagccccattcgccgccggggtcgcggcctcaggagcggaggccatggaggacgtctgcgaggggaaggacttctccttccccgcggaggaggagcgcgtgctcaagctgtggtcggagctcgacgccttccacgagcagctccgccgcacgaagggcggcgaggagttcatcttttacgacgggcccccgttcgccaccgggcctcccgcactatggccacatcctcgcgggcacaatcaaggacgtggtcacccgccaccagtcgatgcgcggccgccacgtctcccgccgctttgggtgggactgccatggcctccccgtcgagttcgagatcgacaagcagctcggcatcaccaaccggcagcaggtgttcgacctcggtatcggcaagtacaacgagacctgccgcggcatcgtcaccaagtatgtcgccgaatgggaggccgtcgtcacgcgcacggggaggtggatcgacttcaaagacgactacaaaaccatggacataaatttcatggagtccgtttggtgggttttctcgcagctctgggagaaagacctcgtctacaagggtttcaaggttaaatttctgatctcacgcctgattaggttttgagtctcggggtttgctttgcatatttattatgatttagttgctacaaagtggacaagctgaggcggtagggaacctgaaattttatggtattcagaagtatgcaatggttaactgtattttttattagaatttggaatttatatgtgtggagaatggaattgttctggtatgtctcaatgagaagaatgaatagcagagtttaggttacatggaagtggcttttcattttgtagataatgctattgtgattacatgaaataattgattggtttttatctgttgtttctgttaatggatttatttttatgaggaatttcttgaaagttaaagtgtcctgggctcttgttcttgtcccaggtgatgccttacagtacaggatgcaagactgcactatcaaactttgaggccgcacttgactatagggttggttattgactttgttcatgtcgtagctcataaattttctatgcaatttgtagtaacttctttttatgatgccatagactgtcccagatccagcaatcatggtgtctttccctattatcggtgatgcggacaatgcagcacttgttgcatggactacaactccctggacacttccaagcaacttagccttgtgtgtcaatgccaatcttgtgtatgtcaaggttagtacttctcctttatttccttgggctatttttccattctttaactttagactatagctgtcaagtttacccactgttaacatcatacatacaaaacttgattttacaaggaacagaactttcactgatgatatattaagcaaaaaaaccagtgaaatactcttgaggaatcttctcgctagtaaatccaaaatgtgcagaagttttgaactctggatgttatgtaaactaatgcatacataatgctatacacaatagatcattggtttctgtgttatattgcattaagtggctgtcttgtttatcctataatcattttgctgcacatacatgatgcttgtccttattttagtggatatctcctgggatcttatagtagtttcccagttcccgcaaataatttaattgctgcatccggttaatccatatttatcagtatagagaaccatgtaccagtcaatctagcagctgcaactgccctgttcttactgtttgcgaaaaaacattttagaccctttttgtttaacttaatgatgcattcttgcattacttatttctttttttgtgataaatcgatcaaattgattgtagaagaaagacattatcgactattgtttcctattctgctccatgtctagaccaccccattcatttagtcagaaaaaaactatacaactgtcacccttctctgcttgtaagttgatgttttcttctgttgaggatgtgtactgtgttgcgaacaggttaaggacaagtcaactggagcagtgtatgttgttgctgaatctaggcttgggcaattgccagccaaggctaaatcatctggaaagaagcaagcaccttctaagggaggcactgctgaagttgttcagggtggattggatactgaagcatatgaattattggcaaagtttccaggatcatccttagtaggcctaaagtgagtgctctgtcttcctaatcatataatactttcatagtttattattagtttcccatgacattatgaaagttaaatgcatgttaacactatctgtgctaggaagcatttcactgaactagtgaacagtttctgaaagtagatatcggagttatgtgtgtgagatgatgcttttccttaagttgttaaccatgtttggttttgttggacttgcttttttctgggcagggctgaataatccacatcacttgttatttgaatttttcatgcaacgtttatatatctctatgcttttggagagatcattttggttgctactcaaacaatgtgtaccacttgtgtagtttagttttataattggtgaactttgttttgtgcggtaatatcagtaatgcttagttggtatacactagaggattggatccaaaatctgcaattttccttctttttttttttggcttttgtctgttgttatattaataaaatcttaaccacgggccctcccctgctgtttttcagttttaaaaaaaagcttagttgattactcctgatacttgttttctagatgttaatagaacaatacggaacatgccatactgccatagccaaatttggagtatatatctggggcgcttcctgtttttaactgttacttttcctacttgcagatacaaacctctgttcgattttttcttggagctccaagagactgcctttagggtgatagcggataactacgtaactgatgatagtggaactggtgttgtccattgtgctcctgcttttggtgaagatgaccaccgtgtttgtcttgctgctggtatcattgaggttggaaaaattctcctttactgtttgggtatttaaactaactatcatgctgccaagaccttggaggttgagacagttgacctatcaatctactaaatatgcatattctccatatttccattactttgtgttgtagtctagaatatgtacttttatatattttctgtgtcaagctttattaaattatctaagggcttttttggcaacaattgggaaagggagtgtgagtttagaggagggagtttatggtgggttagtcatgcggatttgtttttatttactccagtttttttcctgatgtctgtttcatatccaggccagtgggcttgttgtcgccgttgatgatgatggctgcttcattgaaaagatatctgagttcagtgggcgatatgtcaaagaggctgacagggatatcatcaactctgttaaggtaagctgttgtttcagtattccttggaccatttactgtatgtaacacatttacattttagttgcctacttgtttatgtggactattatctatagattttggatttgattaataaattagtgccgtaggacattgcattatatagattctcatgctagtatgtaccggaataatgtcaggacctgtatgtgcattttatgcattatcatgttaattgtctggatgaccttgaagtgggtgcacacaaaaggaaatcagatgtatagcataaagtttctcaatgtatgtctgcactctgtggattgcaccttcgtaaatcataactcataagcagttttggttgatattatagcagcatatttattgcatatgttggatagttttatatccctgaggatgtcattctgaagattataaactttgtgaacaggataaaggaagacttgtcagtaaagggagcattgaacactcttatccattttgctggcgctcgggcactcctcttatttaccgggctgtcccaagctggtaagcatctactgctgctaccatgcaaatttgttagtcggtgtcttctttaccctttgagttatatataattctctatccatctggttgtttagcacaaatggtaatgcagtccatcttatacttgtaacacatgtacatgatgtaccctccgccccaacatataacaacttctaacattcaaaatttgtcccaaaatataacaacttttgcacctacattatctttttaaatcaatcacaaccttccaccttttaatttctccacctacttcctttttttcaaccaatcacaaccttctctccatttaatttcacctgctttcttaatacccgtgtacaaccccaaaactcatattttgggacggagatagtagaagttacttcaatttaacttcatcatgttttaattccatctagatgaacgaatgtggctttcttttgaatctttgtggttcctatttgttggttttgttcatctgtcttttatggtcattgttgttttcctgttccattacctgtttttatttgagaaatgtatgcctgaaagagcttttctgtaggtttgtgaaggttgaaaagattagggaccagttgctggaatgtaacaagcagacctattgggttccagattatgttaaggtactctatcttttcttgtttgtcacacaaagtaattagctaatgctctattacaaaattggataaggtttgcactggtttttgttgcatatcacctagatttgccatcaatgacattgatagcttattttctatgatagttctgtttcatgtcttaccatttattgtttgcaatatttgcatcgaatgtctataattgaactggtaatatgaaacttgcagagtttacgttagcagctgttgcgagcgttgagtttacgttatcagctggtatatttaacttgatatatttgttaacaacaaatgtatgcaggaaaagcggttccataattggctagaaggtgctagggattgggctgttagcagaagtagattctgggggactccactaccgctgtggatcagccaagatggtgaagaaattgttgttatggattccattgagaaacttgaacggttatctggtgtcaaggttgatatctctactatgctatgatccactcttgcaaatattttttttagaaaacagtaattatattctcatatggttctcttttgcttggtcaacattgcttttggtcccttcaataatcaattgctatttctgcatgtcctgaacaaattattttctgaaattatatgaccaggttaatgatcttcaccgacactatgttgatggtatcacgattccctctagcagaggtccggagtatggggtgctcaaacgagttgaggatgtaagtcattgctttgtattttatacctacaactaggattcctactattgcagtaaatatcgtttctagtgacctctaaatatggatgcaatttggcagttatgttttagtactattcttgatttttcttatgaaataggattaaaccatattggtcgaagtccttgaaatattttttagggcttgtggcagtgcacacatttgtctaattgttgcccatttgagataatagacctgatggcatgtgagtgctactcctgcgtcactgttagtgatctctaatatgagtgaaatttgaaatatatcacagtttttgtcaccaatattctttagttatgtttgtaccagttaattccttgaattaccttttctttttaggatcagtgaaactgttttggtgagaaatccttgtgtctgattgcaccaatttgtcttattattggctaataaattgatgtagcattaaatagtaccttgtttttgcttaggttgtttctactctgtaggactcaagttcatttagaagtctttgagtttatgtacaaatagtccctccatttcaatttacttgtcgctctagcaaatctcacactaaactagaagctgtagcatattacattgctaccatcgttaattcttacatcctaatcatctttcccaaagcaagcattaaaattccttgtgaggagtgctagtactagtatgactgcattgatgaaaggtaggaagggaaagacgtatctaaaaatgctttggaatgtgagaacgacaagtattttgacaaaaaaaaaaagaatgctataatgaccaagtaaatggaaacaaagggagtagctaactgctgaatgccataaggtcactcgctatttctgcttgtttagttgcattgttatacatgtgatgtatgtgaacgtttttgcctctgaagtctgaactgctatagatatgaatgcttgtgtatatcagttcttttaaatgtttcttacttaacactgctgtgatgtcttcaggtttttgactgctggtttgagagtggttccatgccatatgcctacattcattatccatttgagaaccgtgaattgtttgagaagaactttcctggcaactttgtggcagagggattggatcaaacacgcggatggtttgtttcacttcatgaaatttcacagctgttttatacttgtgtctgttactaataattttagggtgcattttcttcttttgcagttcatttatgaccttggatgatatttcatgattatgtaccatgtattcttgtaacatacctatacagatcatgaatgatgaaagtggaacaattagttacacttaccttgaattcatttttgcttgttcagaaggcatgtgatgttattcatgaattattatggttgaccatggattgtctgtagtagttttgatagcagttttttctttcttcaataatattttacactttttgggagaaaaaacagtatcctatgctattttatgttttatctgggttaactggtagcaatgatctggtgttgattaaaagaattctgtaatgcttgtgcttttatcacgtttactttatgagattttggtgggcaaaaactaaattcagttcctgctaatgatattagtggaatccttgtgtattgtgttctaaaatgtgtatgatgctttgttatatgcatattcattaattatatctatcatatttatggtttgatgtcatcctgcaggttctatactttgatggtgttatcaacagctttatttgggaaacctgcatttaaaaatctgatatgcaatggtcttgtattagctgaggatggtaagaaaatgagcaagagtaaaaagaattacccttcacctgtagaagtcatcgatgaatacggagcggtatgtggcatatttttaaagatatgaatgctttattgtatattctgtatcattttctgtctgaagacacatgcaatgacttgaggcttgcaattgcatggtatgtctgagttagaatttgcaatttaatttattgttttcttttatttccaggatgctttgagactgtatttgataaattctccagttgtacgagcggagtctctacggttcaaaaggagtggtgtttttggtgttgtaagtgtcctttctcagtatattggatactatctgtctttctgaggaaaataacattgcttcaaatttgtgttgtttaaaattgaacaggtgaaagatgtcttcctgccgtggtataatgcgtatagatttcttgtacaaaatgccaagagacttgaaattgagggattctcagcattttctccaatagatcaagcctcacttctgaagtcatcaaatgttctagatcactggataaactctgcaactgaaagtctagtcagttttgttcaccaggagatggacgcatatcggctttacacggttgaatgtttaacagatctcttagaatatttgtttgctagatgtatcaatttttattttcatgttatggttacttgatgtaaagttttatcttatttacctctgcaggttgtgccatatttggttaaatacatcgacaatcttactaatatatatgtgcgtttcaaccgtaaacggttaaaaggacgtactggggaagaagactgcagagtatctctttcgacgctctaccatgtaagtatatattgtgcagtgcactgtttctacttaagtttgttttatggattgatgagaataaaaatatcaatgctgtatgtatctcaatatctcatgttcacattttcatgtcttcctgcctctgagaactccaaaaggagtcttcatcatcttttatgtacctcccctttatttctggacgtataatgcttatccagttggcagataatcttgttgctattaaacttctcttttttttttcttaattttgataagtgaaatagcttcaggctgagttggacgctaccctttcccaacttctactcccttttttttcacgtgcacaattcccgaactgttaaacggtgcgtttttttcaaatattttttatagggaagttgctttaaaaaaatcatataagtctattttcaagttttttagctaatacctaattaatcatgcgctaatgcgtcgccttggtatccacgcggggcggagaagttcccaactcctcctgaaatgatcttttcttgctccttagcatctattacgtaatattttgggggtactctatgcattaaaaaaatcctaattagattgtatgttttgctggtactttgtagtatttcacaaagacattttgttaatcatgaatgcaggcacttgtaacaacttgtgtggcgatggctccatttacacccttctttactgaaactctctatcaaaacctacgaaaggtgtcaactaaaccagaggatagtattcatttctgcagtttcccttccacaactggggaggtaattcttatctaaacctgtactatgctttattccacccgtattacttgtgacttcatgttgattttttttgcttcatgatcagagagatgagcgtgttgagcaaagtgtaaacagaatgatgaccatcattgatcttgcccgcaatattcgtgaacggcataacaaagccttgaaaacaccactgaagtatgttcatagtctcatgatttgtttcctaatgatttaatctagagatatttcgtttaggaaattgaaaatttcacgttgtataatatattgacatgtgatacacattttgttgtaatgaaatgataatcgatggccatgaaattttaggaatctttttggttgtcataacatcgaagtgttttaggtgtttagttcggttttacattctttcttcatctttttgtgtatatgggcgtaaaagtacgtatgctattttcaataattatgtttttaagatggttgaagttgaaaaccagatggtctttatatttttatatgtgttgtttctggtattccttttgcttcatgatataaaagcttgttctgtatattatcttcaattttgccatatggcttaaccaatctgagtttcagggagatggtgattgttcatcctgacaatgaatttcttgaagacataacgggaaagctaaaagaggtttgtttataagtacttgtcagcagtgcctataagtcatctgttatggaattatatgactgcatttgcaattagttgtaaccaaagtctcctgtacacttttatgttccatattcattgctttctcactgttggcatgtcccttcctgagatcaatatttgccaaggaatctgcttgcccatatttctaggagttgataatcttgattattgagcaatgagaatacgagattgatcaattcatcttcaatatttgccacttagtgtttattttataaatggacatgtttcttcagtgttgagtcttgacatactttactttccaatatacagtatgtcatggaagaaatgaatgttaagactgtcactccatgtaatgatcccatgttgtatgcttctctccgggcagaacccaattttaggtatgtgtacctaatagcgtgagaaactttgcatttttttttatctactgctcagcacttgtgttattttcttagtgtgctaggaaaaagactgggaaaggacatgggcaaagtgtcaaatgaagtgaagaaaatgacacaggaacagatcttagcctttgaacaaagtggagaaatttcattctttggtcattgcttgaagttagacgatattaaggtaacattccatgcttctgatggatgttaatttaaaggtttaaatgattgcttgcatgtcagttttgaagattaatatttggtaattgtgctagtatatgttctcagaatgatatgttagtaagattatattgatttgctttttacatatattgtaaaatacaaacacatcatttccaagttctgctttggcatttccagatcatatctgtctagcaaatggtttgcaagcacacctattctaaaaattagatttgacatttgttttattttgggggcattatttctgatcatcatgatgaatgacatgatgctacactttagtttgcacaggtttgcatttagtggacttatttttccaacctgctgcatctttaattctctgaaacattttaccctctaggtgatccggcaatttaaacgtcctgcaaatgtggcagagaatgaaattgatgctgcgggagatggtatgtcaaatatgtttccatatgagtagtttgtatgctatctgtctattttgtcatattatcattactttttttttcatgtaggtgatgtgttagtcgttttggatcttcgagctgatcaatcattgtttgaagctggagttgctcgagaggtaattaactatatgatttgtgtactcctgggtatgacaccctggagtactgagaattatgtgttagtagtatttttgcactggttgatgcctgaatttggtaatctttacctgacctatgtcatgtctgacttcatgttgctatgaacttccagcggctgtttgattgcatacgttttctctgttgtcagtcataagtttgatgttcatgatctgggctaataattcttgagcatttctgtccaggttgtgaacagaatccagaagttacgaaagacagcgcaacttgagccgacagacttagttgatgtatattacaaacctatggacgatggcaagaatactctagtagagattgtgcagtcacaggtcagctaaattggcataagtaattggttcttgtttcataaatcagaacatccttaatgaaagctactgtaattctgttcaggatcagtatataagggatgctcttggcaatccactaattccaaagatggcggcgccaccagatgcagtgagtttggatattctccctgtttcagtttactgttaactgacttttatctctatcaattggaggatttgatttttcttacatgaacaccaagttatatgcactatcatcaccaccaattggtgttgacacgagttgaaatggatataaaacatttaatctcattgtcatttgtctggtttggcaggtaatgatctgtgaggagtctcacaatgtacaagacatgtcgtttgtcatttacattgcaagggtttctccagtggtcacagatgatctccttgtccatgccgctggtaaatacaaccttatctgatagggtgtacttgtctattttcgttgttaatgtcttggcattctctttgttatattctgcatggtaacataagtgtctactttgatggaacaggcaaccgtgagcattttgatgcattaaaagtatatttactgtcaaggtctatttccagattgaagaatgaattccaggctgggaatggcaaggtaaatctacaacttctactgaacttttttcagaatacttgttcttcatgccttaaattgcctttgttcttacagattacggtggatttcattgaaggcttcccaccaattgatctccagctgggaaaacatgtttttcttagtacaggagatttctacctggctactcgttcttgatttttctttcaagcatcccaattttgagtgatttatctttttttttactgcaatcattttaccccgggccctattctatttgtgcccacaaagcaatgtatgtggtttcatctgccatgaaagaatgaaaggggtactatcatattgaatggtctaatcgaaaactcgtgtatgctgtactgaatactgatacacccgtgttcatgtggctacacaccgattatttaattgtgccaatagcggttaaagcattcagttaattgtctttactacaccaatatgagttgacgtgtgtgaagtgggaatattttggagaaattcatcgaacttgtccaaactatttcacctccgttttatgtcattctttgaagggaatcctgtgccgtctatgcctgtctgttgttaccaagctggatatatcctcgtaccctcgtggggcccttctctctgtcaagcattgacgtgactggccgttctgttggacagcatcataattcataaccgtcattttcagtagctttgccagtgatactggcctgccatttgaacatgcgctggctagagagcctgaccaagtaggcaatggtcagtggtcacccaacgattgtacccccaactgctgctatatttcgagctatactattttcttccaacagattggtgtcatccaagtccatgccatggcattttccctttttagtctaaaataatagcgcctttacatcgacggacatcattatataggagtactaacgatgtctgctgtgcaatgttaactggttaagaggggacaagcttatgcctttgtcggtcatcctgaagttctatttaagctcatgaggaacacaaatcatgcgaatgtttgttagacaagtccttgtaattcagcggttacttttcgcataatcttgcgatgaacaaacgttaacagccatgaatatgtaacgtaataaatcatgcatgtagcacattgcaggcttgcagccaattgccgggaacgagagagaattcatcagttgttaactttacttgatcgacagagatcctgccttgtgctaaaaaaaattgaaaaaataattcatagttatgcagtgggtattcgatcaatcgcgtacactaaattcctttgaccttcaattaatctcactcaaaacatttgcgctcgatattattatcgtctaaactcatggcaaatagacacgtacacattaccatcctaattaagctctcgcaccacaaagagagatgtaaaaattctctcacaaaaagctacacacaaactcgcgaattaatcaaattgcctcaactcaatcacgtcggcttcaggtcctggaacatggagtcccacttgatctcgacgtcggtgccgccgccgccgccgccgtcggagcaccgttcctcctcggcatcctcgtcgccgccctcggctccgtcgccgcaccgcgcttcctcctcgtggtcgtagtcgtcgtcctcctcctcgtagcagtcgtggaacatcaggctcgccttctgcgaccccgagaaccggccggcggcgaagccgacgccgcccctcgcggcggtggcgccgccgtcggtgatcatgagcaccatcttcttgacgctcctcctcctcctcgtcgccgccgcctgcactgcccccacgcggacggcgtcgtcgccgctgcatatcctcggcaccacggtcaccgacgaccccctcccttcaccgacaccccgcggtcgcgccagccgccgcgcgcaccgcgcgatgcacctcccggccttgcgcgcgatcagctgcgcgtacgacgacgacgaggagtcgccaccgcctgcgtcggcggcggaggaggagtccttcttggcgagcttgaggatctcgagacggtgcttggcgacggcgatgcccatgctcttgaggaggtcgtggtcgaagtgcgcggcgtcgccgcgctccagctcgttctggttgaagaggcggccgtactcgtacgccagcgccggcgccaacccggtcttcgccagccacgcgtaccaatccatctccacctctctcttcttgcaccttagctcacttgcagtttcacttgctcactactaccaaattatactactactactactgctcatcgtgtgtgcagctcagctgcatatatagcgaaggaggaagaagcatgcagctgcagctgcacggctcggctcacatgctatactactattactagtttattactgcacatcgttgcaatggcagctactaaataaattgggctcgtatttatatctttaaggcaaatcttgactttttttttatactatttggagtttcatggggcttggccggtttcttgacaagactacaagatccaacacaaccgtttgggtctttggaccggtttcggggagcctctgttaggtgcaggcctgcggcttcttacataatcagaaacttcaccaaacaatctaacttttcacgcagattttgacaaaaagaactacttactccgtttcacaatgtaagttattctagcatttttcacattcatattgacattaatgaatctaaacgtataaatctatatagatttactaacattaatatgaatgtgggaaatgctagaatgacttacattgtgaaacggagggagtagttactaacaagcaacttctcagaattttagactatcttaaataggtcatttaaactttgttacactgtaacctttctcaaataggccatttgaactctggtacactggacagcagcgatcgatcgaggtgtagaagtagtagatcttaagccaaaaggagacacaaaaacgccaaagctgtcagcctgatccgatgcaaatcgctcatcacatgcatgcccctgcaaaaaggggagtactatacgatatctgatggctttcgcttctaccgcgtatcagtgcagagatgtttgttagtaggagtatttgttaattaaatgagcacttgcattagttgcattggcctttatggttcaagttcgtgatggtttcatttaagacctaaattaatctcatctattcagttgagattttcttttcttttctttttggttgtaataatgtcactacttgagagtcgatatggaggcaggatgatggccgatgtgttatgtggaccacgcatggcatggtatggtcaggtagcatacgtaaatgctgaaaggacgcgaataaagcggtgacaaagtgtggcaggttcagaagatggtagggactgcatgtttgttactactgttgctgttactacacgttcacgtcggattggcagtaataaaatcacagagagaggccataaattacatgaaaggatgtagtattatttgctgatactactacagtattattataccatcctagtactactccctccgggttgataataattatcgttttggacaatggcatagtctcaaaaaaaaaaaacttcggccattattttctattataatatgtataaaaatattaacaaatatatgatcttattaaaatacattttaagactaatctatacatgtagtcaccatatttgaaagataaatattttaaaaatgattgataatcaaatattctaaagtttgacctcacccttattcaaaacgacaagtattatcagtccggagggagtatatctcaagagactgtatagactcatggttttaggatttgtcaaattcaacttaatttttttatattttgggatttatggagtagcatgtatagggggagaaatttaaactgagcaagtctttggaatctctccatgtggacctttttcttgtctgtcttgtagctatagctcggctatgagcgttcaaaaaggtcacaagattaggtcattaggcatgggtaaaagggcaattaagtgtgcagtaaacaaagtttgtgtgtggtggtaaacaaggagtggttggaatcttagggtgatcctagctgcgtcaaacaaatgctactaccgctctactgcaagcttgtttttgtatgcgtgatgtctgaaaaagatcttacctttctgagtttcataattctgaaaattgcgtagtactttgtactattttctcgaggctatatatactctaaacagaataataaaagatactagtagaattcgagagtcaaacagcaccctagtgctacgtactagtgttagtaaatgttaacaacacatataggttgcgacttttgtatgatcgtatattaaagggtagtggaatagctctggctttgcaatggactctttggccgttgatcgtagaaacttattggctggtggctattcacatgatcaaatcacaggaaaaggataaatcagacctggcttttcttgtccgagaggtgaaagacttgttagctggaaatagggagattagaattgtcaagggccatcgtaaccaaaatcgtgtaagccataccttatcaaataaggcacgatgtgagtctatgtctaaattttggcctaagaatagttgtaatttcatctcacacattgattgtgaggagtaatatattccctttttccccgcaaaaaaaaatagtggattccgtcattcatgtatttttcttcttttaaatccaatgtaaataatgttacaaacttaatttttttaaaagaagataatatagagtatagttgtatttagcactccactaaaaatcaagtttaaatttgacctacacattaagaaataaaaaaaatctgtgtatctcaacgtgtgagttgagtttgtactaaaatgctacgaactgatatgtacattttgtatgaatgttattaaggctgtgtttagttcctgaaaaaagttagaagtttggggaaagttgaaagtttaaaaaaaaaagttggaaatttatgtgtgtaggaaagttttggatgtgatgtgatgtgatgaaaagttgaaagttttaggtagttgggggtgaactaaagacggtctaatttttccttagaatttttcatgatagcagtacaagctctgaaggcccctcacttggcgcatgcagtcaagcgatgacgcgtgagatgaattaagcctactagcgtgcctgtcctgtcgtctcccacccacacacctaaggtccgtgcccgtggctagcttatagctgcaggtacgcgtcgcgcaccgtgagcccccgtgtttcgagtgatcgatcagcgccaaatcctgccacccatgcgcatctaccaacaacccgcgcgcgagcgagacttgcgtgccgcgagagtcgcgcgacgtacggcttcggcggcgtacgtgttgtattgtgcgtaggcgcgtcaaaattaaggcgggggcgtcgcgcgcggtggcttcccagaggatcattgcgcccgcgcacttgctgtcgcgaacgctggccggcggcccggccccggcccacacggctagcccaccggacgtacttcctccggttccataattgtttacgatttaaataaagttaagatacctttttataatttcaactatcaataactatctatctatctatatctatatctatctatctatctatctatctattatattattaaaacaactttgaaaggaggcaccacgttcgctgtaggggctagaaattcctacattaatcgaagaaaaagaaaaaaaaaagaaaaggaaagaccaagtagaaatacaatctaaaaatagctgaaattcaaaattaaaaataagcaatatttaaataagagtccatataagaacccaatacgagattaatcaaaattcaaaataaaaaataaaataaaatccgaaattagaaaaaaaaatagagtccaagtagaaatacagtttaaaaatagctgaaattcgaaattaaaaataagcaatattaaaagaagtttccatataagaaacccaatacgagagattaatcaaaattcgaaataaaaataaaataaaatctaaaattaaaaaaaaaaggatagtccaagtaggaatacaattttaaaatagctaaaattcggaattaaaaatatgaaatattaaaagaagagtccatataagaacacaatacgagattaattaaaattgggaataaaaataaaaataaaatccgaaattagcaaaaaaaaaaaagagttcaaataggagtacaatttaaaattagctgaaattcggaattaaaaaaaataatattgaaagaagaatccacataagaacccaatatgtgattaattaaaattcagaataaaaaataaataatatccaaaattagaaaaattaaaagagagttcaagtaggaatacaattttgaaacaactgaaatctgtactattaaaaattgaagatgtttttgccggtataaaaaaacagaaaaaaaggagaaaaagaacttctatgtaaaaaaaaacgtccgactccataaaaaaagtccgactatctgtggagaaaaaaaggcaagaaaaaataaaaaaaagagaaaaaaaaacttctaccgtataaaaaaataaaaaggtccgattcctgtacgattgcctcgaaaaaggactttttgtccgtaatcttctcttctcttctacttctactatttttttaaaagaaacctctactattataaaaaatttaagatgttcttttgtcggtattttggtatgtcatccgtgtatgagtcggtttataaatttgttcgcttttgaaaaaatatatatcctttgagttgatttttaagttcgtccgcttttggaaatataggagtcgtataaaaaaattcgcatgctgactttagacaaacagactcctaaccacagcttatgattttatagaaatatatagatccaagcgaattctcacagtgaattaagactaaaatagttgtcacccgttgcagcgcacgggcttttctcttgaaaataaaaaataaaaatattaaaagaacacaatacgatattaattaaaatttgaaaaaaaaattctaaaattacaaaatgaaaaataagttttcaatttggaatacaatttataaatagctaaagtttatgataaaaataaagactattgaaagaaaagaccatctaaaagacatgacgagataaattaagtaacaggcctataatagagtagagtggtggcggttgatacaacatataaaaactgttaataaaacaccaaatagaatactaataacgattaaaacaagggacggtagaaaggccgtgaagcaaacgaacaaggtgattgctgggacttctaaaaagtaaaaaaaaaaaccccaatgataatcatattcgatttttaaaatctcaatgataataaaaaggagaagcagtgggcggggtgtacaggagtatagttgcagagccgccaacggttgacgggacttctaggaaataaaaaatgaattccaacgatagttatgttcaatttttaaaatcacaatgacaataaagagtaggcggcatacgggccatagaggagcatagtggcatcgtgtgacgagacttctaaaaattataaaaaataaaacccaacaagacaatatactctaaaaactacaaggttcaatttttaaaggttcggaacttctaaaaagtaaaaaaaacaatgataatcatgtttgattttaaaatctcaatgataataaagaagggagacagcgggcgagccgtagagaaatacaatggcaaagccgctgacggtttggcgggacttctagaaagtaaaaatgaacccaaacaataattatgttcgatttttaaaatctcaatgacaataaagagaagagatagtggacggaccatagaggagtataatagcaacgtttgacgggacgcctaaaaattataaaaacgaaacccaacgtgacaaaaaaaactctaaaaactataagatccaatttttaaaggttccaagaagaatgaatagaaatagtggtagatcgaacaagcaaataaagaaggagatgtcataaggggtagcaactggtgtgacttttaaaaaactatataattagaaacacgggaatgataaggtttggtctttcaaactcttaagacaatgagatagctatttaataaattttaagtaaaatcatactaaaaatatatgattttgtttaggtgctagccgcgcaattgcgcgggccacacagctagtttagtttattaaaggcactaaaccaatatcatatatagatttatcatcttagggtaaactgcattttgaatcaccttttattacctaagttttattttggattaccctctatccaatcttttcacattaggcttggttattttacctttgttgtgctttagaccaccatttttttttgaatggttattttttttttacggtagaccaccctaacacttttgtatagcaacatcaaacctctcatttaataaagatgtgaattgcacgtaaatagggaatattgttgccatgagagtgtgtttgattctgttgttgtgctcgcgaagagagtttgcacagtccaaaatgaaaaatggtaaaaaaaataaaactagttcaaagtgagaagattagatagagggtgatccaaattaaatgaaacttaggtaaacaaaagtggcttaaagtacaattcactctttatcttatgagtattataataaaaataaaaacgtattaatttattatatatatattataatagaaaaatatatttaaacacatatttcgaagatcgtgttactatttaaagcgtcaagaagaattatggaacctggttactagtacaagtggccggtcttgtctcatgagatggagaaatatggagtgttatggtgtctgtggttgtggatatgttatatatactcctaacgtacagctgcatttccgtcaactattgagcgacacatgtattaatttatggtggaaggcccgtccctaattaaggtccctaatctggcctctagcattatcagattatccatgctcgctacatctcctggatatgggtgggggttggggttttcatttctttcatccacaaagggccctagctgctgctgctgcatgccgcctttgccgctatgatgcatcctgccgtccagtttacatgcgtgttgagcgtacattaccacgaatgttcgtttcccttccccctaaaaagcaatgcatttttttcttcttataaaatgctacggttgctacgcattttcaggcataccattaattaaaaggataaagaaatcgttatatctatcattattatattatgtaaagagaaagctactgaaaaaaaacggtattaccccgtccaagaatgtaagaatttttaaagttcgaaacggtcattaagaaagtagttagagttaaatgataaaagattatgattgattaagaagtggatgtaggtgaaaaattgaatggtgaagtgttataattggttgagaaaaaaatgttgacggagaagttattatattttggaacaaattatgttgttatattcgaagacaaagagaggagttgctaagagtctgacatgggaagggtctatttagcacaactccagctctagctcccaccttttctaagcgaaactgggtagagtgttatcataaaataagctagagagatagagtagagtatagacctgctccacaatttcactccaaaacccaactctcctgaaacaaaatttaggagttggagctcttaaaaaacaggcccgaatgtcacgggtttcccgtctttcgtcaacgagcccagcgttgtcccgtgatcacacgaacgcgaaaagggccaagtcctgccagctacggcccacgtctagattgatccaaagcaatagagcccacgccatttggcgagaacgccgaaaagctcgaggcccacaagtcagtcgagtccaaattttcgcacctccaccgccgccttcctcgatctggagaagctttccccttctcctccgccatctccatgggagcgcgcgaacgggggcggggttaggtttccggcggccgatcgagcgggctctccgtataggaccgcgcggcggtggcgatcggcgaagtgccgtcgccatgtgcgttcgattttgagctctctgcttctgtttgattctctttcgccatttttcgggtgcgagttggtctcgatcgatctcgacgcgtggtgtcccctgctgccggcgatagggttttgatgtgtgggtcctgcagtttctgaggccgtctccggcggccgccgccgccatgatccggtccaatcttccgcggcacgactgcgaggagaggacgcctttattttttattttttattttttaggtggagatcatttgccactatccatagttcacgtctgcattctttttattttttgttgctgattcccgtagtttttgcgatgttttgggctaatgattcaattctacgtgtgatccatggtgtgctgctttccgatcatcgcaatgggcgccagatcaatcggataccctgttgtgttttgttgtctagggctaatgaataggatcggcgaaatgttagaaaccaaagaggcagtgcttctcgacgtgggcgagcacgatattgcattttctcaaactacacacttctttcacgaaatcatttcaagctgtacaatgtataacctgtatggtcgatggagatcattaatcagtacaatataataatcatcgaagcactaaacacatcctaaactgctcaacacgcgtggcagcgtcccaaggtgttcgacactgtaccatccatccatccatccatggcgatgtcttcttctacctcgccatcctgccgctgtcgcctcgccggtacggccgccgggggctcttgagcagcgacttctcctcgatggggaacctgtacggcgacacctggaaccgcctcgtctcgctccgccgccgccgctcctgtgagtgcgccacccacgcggccacgggggccgccacggcgacggacacggcgagcagcgcctggtacaccctgccgctgtgccgccgcagccccgggcagtgcgccgccgtcaccggctggaacgcgcgccgcacgtacgagcagtcggcgaggtcggcgaggacgggcccgtactgggtcagcccggcgctggcgttggcggcggcgaccatctggtcgtacatcgtcggcgtgagccggccggtggtggcgcacacctccgacgacggcgccgcccccgtggcgcggcacacgtagccccgccacgcccgcggcgcgtcggcggcggcgacctcgccggcggcgcaggcgcggtcggagaggtcgccgttgtaggggttgcagaggagcggcacgggggtcccggactggcggtagctggccggcggcgacggcggcgacgacgcggggacgttggcgttggcgacggtggcgaggaggttgttgagcacggagacgatctggtagttgacctccttgctccggcggagcgcgtccgacgtcgcggcggcgtcgacgcaggggaggatgtcgtcgagcgccgtgtggccctgcgggtggagcacccactcgtccatggccacgcacgtgtcgcccaccgcgctgcgagcacgacgaagcagagcagagctcgtgttagtgtcttaatgattcagatttaactgatatctgctatcttaaaatatagtcgttctcctctcatcccaccgtcctaacgtgttcagtgcgtacgtgaaaagtaatactccccctacgtttcagaatataaatattttaaaagttagacgtagttattaagaaagttgatagaactaaatggagaagtgttgtgattggagaagaaatgaaggtatgtgggaaaattgaacggtggagtattgtgattggttgagaagagaatgttaatgaagaagttgttatattttgaaacgaattctaaaaactaaaagttactatattttagaaccgaaagagtatcatttatctctaattatatagacctagcctattaacacaccgacataccgactcctaatctacccctaattatatggggttgacccattataacatacaagcatgtaactagtcaatgtaaagactgagatgcaaagtgttccagtacgtctggttcatacaaaaaaattttaacttttcagaagcagaatattccacttcagtaaatttgtttttttttgccgactaaatttactcaatccattttagaatatcaaaatctcacctttttttcaaattatatttaatcaagcaatatatttaacaagacagtaacaagggagaacaacttacttgtgcaagagaagaaaagtgccggacagtatgaatgttgcagtaactagaatccatccaaaaatcaccaagctgcagaagaactgaaggttacaaacttgcagtaaaaaaaaattttgtactatatacaagtctatgtacgttctgtgatgttgtacttacgtgtatactagtgatttcagcccgcacagggagaacactgcaccaaaatcgaacaagaatttgtcaattatttactcgaatacagaaacaaacgaatttgacaaaattcaccaaaaccagcaaagaaatctttatgctcaccaagcccaagaaacgccaaggccagcatcacggcggcaacaacgatgaggattgtccttctgcgatcacgagaagaaggcaaacagaatgtcaaacgagatcttcttgatgatggaagtgacgaggtcatggcgtccaccaagaaaatctcacacatacatggtctccagcgcggtgcggatcttgcgggagttagtggtggtgcgcgcggcgaggtcgtcggcggaggcgtccacccggcgcacgacgtcgtcgaccttcccctggaggtcggcggggagggtggccttctccacggcggccgccttcgccgcctcgatgaaaccgctgaagccgcgcaggctcgccaccgcgccgtccgactggttgacgacgaaccgcagcgtcgccgtcgtgctcccgtggaacttcccctgcccgtcgtacagcacgatgcacccgattctgcacccacagcgacggcggcggcgtccaaaattagaaattactccgtccgtttcgtattataggtcgttttgattttatttatcaaacttatttaaatttaactaaatttataaaaagatatagtagcatttccacaaacaaatatattatcaaaatatatttagatttgactaaatttataaagagatatagtatcatttctaatgcaaaacaaatatatttaatgctagttttaatgaagcagatgttgctaaactttttgtataaatttgatcaaacttatactagaaaaaaaatctgaacagttttgtactttgtaatatgaaatggcttggagaggagaaatggttttacatggcgacggcggtaaagacgagtaggagcgcgaggaagacgccaaagatggcgcggaagtagaagtaaccgccgttgccgttgccgccgccggcgccagagcagcagcagcggcagcagcaggcgacgaacgcggcgagcgcgaggaaggcgaaccagacggccgcgacaacgaacaccggcgccgcgctgaacccgaccgactgcgcgcgcgcggcgacaagcatagcaaaactcgacggcgtcagcatcaagaaccaggcaggaagaacagtagaacaccaaggtgatcgcattgcgagctgaaatttatcacggaaatgaggagctcacggcgaggtagtgcttgtcgctgatgttccagccgccggtgtagtacctcagcccgcggagtggatccttccgccgcgtctgcgccgccgccagcacgaacgccgacgacgagttcgtccgcgacaccgccgctgcaaacacggcacgccaccatcgatcgatcgatcaatctccacgccttccatttcatcaaagaaacaaaactactcaagaaccctctcacctgcagcgctggcaaagaacgacgacgcgaagacgaacagcaggaggagagctcgccggcgaggcgacgacgacgacgacgacaccatggctgctccggcctacggagctcgagctcaagctcccgagcaaatgctttgtttgatcagggatgcggggtgacgtgagtagaacaggtcgcggactcgtggaattgtaatgttttggttgtcgcgtgcatagatatggtcaattggtcatatgctcgtgagatttaagcccaaggacttgccaggtcttcgtctactactgccattatttttttactaaaagcaagagaataaaattataaaaatggtttagtcgtgagcagccgcgtcccgcgttaagcggtgctcttttggagtagacaaatgcatgccagtttgctggttcgtactgctagatgctagtacacgttttagttgttttttgtactattatattagatgtgatctgaccatgcaaaaattgagtatctgggccattatgaaattggcttggactaagccgtcgttcgttgtcatgatcggacggtccagacagccctcgtacacttcaaagattttctttcagctaagagcatctggagcaggtgcttcagagctagggaattgttgtatagtttacttggcaggtcagcatcttaaaaattctatactctaaactcaactcctcttgagccatcagtacattcagcaagtaggagaaagggacttgattgtttaatggatgattacttgttgttctgttgctacaacatcacaaaccaaaaaccaaaggtatgaaactatgaactgcaccatccaatgatatcgttgagcggtgaatactcattcaaagcatgcaacatcaaatacatcatcatctggcagcaactcaaacaacttgtactgccggtacaccatctctcacgttacagttacaattacaggttttgacttcgcatagttgcatggtaagcctctaatcatgcaggatttgaagggaccttcaccaatcaggttagaccgggtacaacctttagcacatgctttgacgtgttgcacctttgactcatggttagatgccattcacataggatgtaatgctacaacatcagaatttgagacacccaaggccatggatatggacaaaaaattacatcgctacatttttacagcaagaggccaatagttacagtgggccctcaatgtctaacctagagtttgtgtacattccaactcccaactcccaataccaacaagaggcaaaatagttggaattggggatcccaggtataccatagccagagcctaaaatgaaaaattctacaggtgctcttcccccctcctacaggtcagcattacagcatctaagttagaatatagcaagatctaaatgccatatctggttagtgtgcactagtcctcgatcgcgtattccgcatcatctagcacatccgcgctttcctcaagaagataatcacacaactccaagagctcatcagcaagcggagggatgtggggatggcggttaagattgtatgtatgtgcattcagtgctatctgagccacatcatgcctaaaatcctccctatttttatactccatctttcgcaccttgtcccttatagtaccaagatccattggacgctcaattatgtcaaagtaatcaggagcctctttcttcgtcaccggtttacggaaaaggaatgaacagctcattgtccgcaagtggtcaactattttttccaatatgttggagagctcaacctgcatcagtatgcaaacaaataaattaagtttaaattcatagtcttgcaaaaaaaacaacaatggattatctgcattatccgacctatatctcacaaatgggtatcacatcccttgtagcaaaatgcgggtgtctatatgttaaaaaactaaagatgaacgtgccaaaagagaattaataaagatgatgatgttgacggggatgatcaaactgaatattgatcaaaacaaactattttgttgagaacgcacaacacaatgggacagtttagttgagaaaaactagtcccaactctctaaaggtgaataacaaaaccaagcacgacgctggttgaaaggctatcatacaattattttgccctttctcaatttctacaaacaataagttgcagaaacaggtatctctggtggcggaattacaaaaaggtctaacataccaacattgctaaaacaatgcataatcctattaaaacagggttgagaacaagtacctctcctcctctgtgccgcttagctggtggtgtgtattctgtcatatcagctggggtacgtctctttgccgctcgacctctttcaggtacccttctgtcatttttgtatggcctaggatcaagtaggtcatcatctcgaaattcatgttttttctttttcttgtttttcttctttgccttctggagctcatcctctctccttgcatcatatatcctagcttcaattagtctctgttcttgtctctctcgttgctcctcaaaagctctccaggattcactacttcccattattcctttgcttctttttcccaccagaccccaccccctatcatgtgaggaattgatctgaataggttgtccagaaaaaccattatcatcctctctgtctctcttctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaa

SEQ ID NO: 18524 - DNA, 747 bp, Oryza sativa
  unsure (1)..(747): unsure at all n locations
caggctcnnnttttgaattgacacgctcnnnnnnnnnnnnnnnnnnnnnnnnnnnnnnnnnnnnnnnnnnnnnnnnnnnnnnnnnnnnnnnnnnnnttaagtatctcagtaagtgtacaggaaggattgtaattctcagggataaccggcggtttcaccggtttgaggatggggtatgctcttgtggggatttctggtgatatatcttctgatgtacctcattctcattcatcatgtttttctggtcaggcattttagattatatttcttcaggaaatagatctttacaggttcagtggctggtatgaaacacaaatctattgccatgctgttttggcacagaaaaaaacatgccataaccttcaagctgaaacagctggactcagccatgggtctattaataaaacaagacatcggtcatgatatgttaaggctagattaataatctggataacaggttcactgcaccataagttgagactggtctgagcttccgtggtgcttgaagaaggaatggtggttctgagaaggtacatacaagtttcataccccacttgagagggccccataaacatcagcatgggtccggtaagcccggtacacttcaacatataaacctttcttttttattttgggattccttagtttatcaatttaaaaggatattctttgggctaaggcaaactttcctttttatgttgggcgtccttggttatcaatataaaaggataattgcttggcccaggg

SEQ ID NO: 18525 - DNA, 754 bp, Oryza sativa
  unsure (1)..(754): unsure at all n locations
gtaggcnnatggnnnnnnnnnnnnnnnnnnnnnnnnnnnnnnnnnnnnnnnnnnnnnnnnnnnnnnnnnnnnnnnnnnnnnnnnnttctcggtctcaatctcagtcttttcagttcggtctttttctgcacaactctagagtggataatgagcgactctccttgtcctaaccttaacagcagtaaaagtcttacttggctaggagttaacgagctactccctcctctggtttcataatttttaatgatttagataaggtttaatttaaatttttataacttaaaaatattcagtttaaagacaaatacagtattataataaaaataaacacacatttaggtatagtgaaagacatattttgaaaactatatctttgtctaaaacattaataattattgccgatgtttgagatcgtaactacgatattttgcatactgtagggatcgctgttaccagggtatatacgagattgaagtaaaagagacggagacaatgatttttatacagattcaggcctcttatctgataggtaatagcgttacttctgttggctgaagccggtgttgctcttattcatcataatcacactagtacaatatttggaataacacatctaaccgttgtcgacttggagacctgaaatgaaacttctatatatgtgttcttatcaaaacttctatatatgtgttcttatcaatctataagtaaagactgaaaaataaactttaataaaaaaactctgaaaatcaactct

SEQ ID NO: 18526 - DNA, 759 bp, Oryza sativa
  unsure (1)..(759): unsure at all n locations
cgtggcncattattgannnnnnnnnnnnnnnnnnnnnnnnnnnnnnnnnnnnnnnnnnnnnnnnnnnnnnnnnnnnnnnnnnnnnnnnnatatagaaacttctctgctgattttatgagggtttgccccaaaaatttatgaagccttgctggatttgtcaaatgaacatgtcataattatatagttcatgtgtgtatcccctataaagtttggatacagtagaagtaacattgaattttaggcaatgaaattgctgtgatacataattcagtagcaaaactgatattccaattacaagatagagttgaagtcagtagatgccaggtattatctggcttatttgatctattaattagttttctgtgatgtttctgtatacgacagatctttccatctggtagctataactttttcagaatggacacgaggacttgaggagcattttttctgttctgttttatgacgtgttcatgccttacttccatctcccatgcagatagcgaagaacattacaacaaacgagatggcaaattccatgagatacagttatctaagaggtccaggtggaagattcagaaacccatttgaccatggagcgcgcaagaactgctcagaattcttgttaaatggatacaatgaggacattgaacgtcttgatcatacgtcacacactgatgaggaaatgggaatgatacagatgacaaacgcagtctctcagaatggcgagggcccttcccaccatggtaaccgcactggccn

SEQ ID NO: 18527 - DNA, 740 bp, Oryza sativa
  unsure (1)..(740): unsure at all n locations
cgtgacattggtggagacattgnaccaccncaccactgatgatgttctattatcgagagaagaaaggtcctttcggatgtggatcaacagtcttggggttgactcttacgtgaacaatgtttttgaagatgttcgccatgggtatgagattattcgaatgagcatttgtgtctgtctccaaatgaattgggcacttacatcctttctcatgcagatgggtacttcttgaagtactggacaaagtttctccaggatctgtcaattggaagctggcctcgaaacctccaattaaactaccattcaggaaattggagaattgcaatcaagtggttaaaatcggaaaggagttaaagttttccttaataaatttagctgggaatgatattgttcaaggtaacaagaaattgattgttggtgagtgtgactgaatcaagtctttttagtggtttctgattgatgttatctgttcagcacacaattgaagccatatctgttgtttttcagcacttctgtcgcaattgatgagatttaatatgcttcaattgttgaatagactgagatcccactcccaaggatcccaaggaaaagaaattactgatgctgatatactaaaatgggcaaacagcaaagtgaaagcttcatgaagaacatctcaaatggaaaagcttcaaggtgttattaaatttcttgttaaattagtatttagtttgttggtaagatcacctacagctaatgaaatt

SEQ ID NO: 18528 - DNA, 792 bp, Oryza sativa
  unsure (1)..(792): unsure at all n locations
aaagtcagtgttatgtctgcacttctcttataatgtatctcagttgatctttacaatatccattattgtattccagcaatatgggaatatccgaacactttatactgcaacgaaacatagaggttttgtgatgatatcttattttgatatccgagctgcacgtggtgcgatgcgtggattgcagaacaagcctctgaggaggagaaagttggacattcatttctccatcccgaaggtttattatgttatggttcactttcaaatgcttagtccctttaccataaagtacttagcagtttgccatgttgattttgtaggagaatccatcagataaagatttaaaccagggaactctggttatttttaacttggatccctcagtttccaatgaagaagttcgccagatttttggaacatatggggaagtaaaggaggttaggatgttacttccaatttttccctttgaaatatgtttttgcttgaaaattgcatgttcttacgttcttcgtatactttgtttctgttttttggaattcaatctgatggtgttagtttctatccacagataagagagacaccaaataaaaagcatcataagtttattgagttctatgatgtaagagcagcagaagctgctcttcggtcactgaataaaagcgagatagctggaaaacgcataaagtaaaaaccaagtcgtcctggtggaacgcgcagaaagtatgattatgcgttttctttccctatccatttttctgtcntgtgcttggggtgcganctgcattcctacccgcg

SEQ ID NO: 18529 - DNA, 773 bp, Oryza sativa
  unsure (1)..(773): unsure at all n locations
catggcccaagtagagcagctccgtaccccggcgaagattcctcaccaaaagactagttgggagatccctgtcacggcctccatagcgcccacgaggacttgggctgcgggctcttctcctggattctcttggcggggatggaccataatcatagcctcttcccatagtgatctaagcttacaggaaaaaattgcccttagaggaaattcaaatgatgcgattgggtttcataagctactcgttccgctaaaaagaacaatgcccacagcaagtgaccttatcaacaagactcattctttcattcagctatttttagctaaaaaggttcggtagatgctggtagggaataaaacaagctacaacatttcagcattcgagaaaaatagacatcacaatatatttctatgcatcaaataattgccactcccaatttacatccatcaatggtaaatttaagtagtgccttgaacgcacacaaggcattcaagacttaagagtcgtcaacttaataatctataagaactattaactgtattgttaacaatggttgtgaatgaatacataacatcttccgtactgatgaaatgattagaagcgttcaatagcatactttatatatcaatcaagtttaagtataagaaataactgttgtgaatgaatgcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18530 - DNA, 2136 bp, Oryza sativa
  unsure (1)..(2136): unsure at all n locations
cgcggcttgattgctatctcagctttatgcccgcattcgactctagaggatccccttttttttcgctattccggcacgtataatgctggcttgtgcgtgcctttcttggtagtgcaaagactagcatatatctatgcatgctgatcaatttttttttctctgaagaaaagtcctaaaaggacaatgaatttctcagtttatgaggttacgagggaaaccgggtcgaaaaactttacaacgatacgcttataatcgaataaaaattggcaaaaaaaaaaaccagcacgaagagcagacaaaatcttgcggcagcactacttaaactcgtcataagtcatcattgccgatctcatcgtaaaaacgatccagcagctttagccttctatagctgtcttcacccctgtatacagggttggatgaagctctgaagtgacattttctgatttgcgcaagcatgaacaggatggtttagaagaatcaatcaagcagcatctttccattctagcctggggaaaaaaagaaaggaagggctctctttttatctccaatagggtcacatttgtagcgaagtgaacactcatgaaacggcaacacattaccatggaggcatggaacaccaagcaggtgacacgcactatacagatcagcctgccactgggtattcagtacccatccccatacccatacacattttatttgggtagggtatgggtaaaagaattaccaatttaaattttgaatatggggaagatattacccattttacccacttcatccgtacccatttgctatggtgtaaaattcggacctaaaatttttaaactcgaactcacattacaaaatcttatcaaatttgactggaatttggagggatgatttattatattaaagagcaactttgtacaaattttgatccatttctacatgtggagcccacatatgtctcttctcttatccattgggttacccataccattgggtaatacccacttaatttaggtatgggtcatattttttttagatggagacagataaaattaggtatggatatgggttacccaatacccttcccgtggtaggcctaactactgataaaaaaaactagctaccagtgtctctgaaatggcacccatgacgctttgaataacatcatgtcttctttattcgatcgatcgaggccaggcgccacgcaagtgcaagacatttgtctagttggtcctccaaaacagagtttggatctcagacagactaacaaccagaggatggccaaatggctccacatgcccactctattgtcagactcaggagacggcccttcgcctactagaaggatgtagatacatgagaagaatctgggaggagattgcacgatggatggactgcgaccatctaagcccgtcgctttgggagccggcctcgatggtacatgagtggtgggaggccacggttaatacaagagaagcgctgaaaaaagcactacatatgctaaccttgttggtcggatgggaaatttggaatgagaggaaccagaggatcttccaacacaaagagatgtcggccttaaatatactctccaagataaaaggaagaagcaaaaacgtggagcctcgcgggcacgagacaccttgccgcatggctgaaagtgtaaccttttttggccgctagggccgaggcctcaaaacttttaattacttactttttgtataattttcacttctctattcaatgaaaattagtagcttgccgatttcgttaaaaataaaaaaggatcgatcgaggccaggcctctcttggccaatcatcacatatacgtgcagagaagaaacgcgtgcttcttctcatcaccccatatgattgaggttcattatcagagacgcggtttaaattgaactgtctctctcgtacggtcacatttgtagtgaagtggacactcatgaagtgacaacaacaacaaccagctaaggaatgaaaagaaatggtctttaattaatacgtttagcactcatgttaagcatcatttaagccctgaaaagtattggtgttaccagtgtcttgcataatatcttcttggagctttatggtttatgcttagggacatgggccttgtttggatcctttcggctattaaatagcccn

SEQ ID NO: 18531 - DNA, 5014 bp, Oryza sativa
  unsure (1)..(5014): unsure at all n locations
cgcgtgttgttgacttgtanatcnnnnnnnnnnnnnnnnnnnnnnnnnnnnnnnnnnnnnnnnntgacaaaatcaattccataacccctaggctattttacgagacgaatctaacgaggtatattaatctatgattagcggatgattactgtagcataactgtagcaaatcatgaattaatatgcctcgttagattcgtctcacaaaatagcctaggggttataaaatgggttttgtcagtaatttacgtttaatactcctaaatagcaagattctggagagctatttaatagcctgaagcatccaaacagggccatggtttcctcctgcaatgaagagatgccagcaaagagccagaattaagacgtgtatgcattgcacagttggcttgcattatagatagatgatgggtggtagatgatggattaaagtgggtttatgacaattattcaacgataaagataaacaaatgaattaaatgatagacagttgaaaatttattaaaagtagagtccacgagaacactccctgattgtgaataattactcatcatcggagctcaagggtataaggattcctaccggtcatgaattgctacctaatatgattaaccgggaattcttgccaattgatgatgcatatacaatctaacttcccaggaaagttaatacaaataatctgagcacaaattagtagttaaagaaagtaaacatatgggaggcgtacgttgccgtttgctgcttcaagcagcatctgctagaggatgaagcagaagtgcaggagagagactaaacttggggctacatgtcataacagcatgtttagatatatagttaaaagttattatattttttttacggagatagtactattcttgagaaacagagaactcggtgtgttagaactcaaccataaactaagcatgcagagtagagaaacgaagtaggcagaaggctacatgcaagtgcaaattacaagtatgtgctgtttggatatttagctaatgtgaagagtccttgtgtaagagaattgaaaaaaaaacactatatgtcataaattcatcttccatctttttctagttcctttttacttttaatttctaattcaaaatattggtatcaaggatttgttaattcgttcaatttgttgatggatgagaaaatttatttccacacgttacggtgtacgggtataatgctagtaaaaaaataaaaatgagggggtaatggacacaatgagtatacaagatgagggtcatccagcaagaagcctttgtggtggctggactgcgaggcagcaacggcgaagcagaggtggtgccacatgaggcaaaggccgccggagaggaggcggtggccaagtgcatggtggaggctagcagcgaagaggcaacgtcacctgagatggaggggcccctaggagacgttatagtgcgactgtgcgaggtggaagccaccgagatagaaggcgctggagtgttgccttgtgttatcggcggaagagccagtttacatgtttgggcctgagtgagaaggttaagaatggaaagagatgggattttttttaatcggttaactgcacatgacattcagcccttgcaggagtaaaaagtctatatgacttaacgtcttagcatagcttttcttttaaaaccctgtataagtatagtattttccgttttattcaatgaaattagcatgctttgcactggttcattaaaaaaattgcacacatggcatgagtcccacattgtttggtgttagcaagcgatatcaaaccgaacatgtgagattttatactatttgctagctgcttcaataccacactgtcaaatggtgctctcctggtcgactttgatttttttttcccatcgagacaccacagccaatgctctcatgtcattttgaacacaatatactacatcactgtcacatcacatgagccctgtcgcaccgaacaaaaaataaccatgctacccctgcccttcatacgcagatcctcctaatccccatcgctgccttctcactctccataggtactctaacccaatcttcgacgatgacgacaatggtggcgagcagcgctagaagaacaaaaaccaccaacaagatggcagcggggttcgtggagcagttttcggcgaggagttcaggacttcgggggtaacacagtgctacctcaacatgcatactagcgctaccctagcctaccagatgatccaccaaaaggtgatggcaatgctgaggacatgtggtgcgaggtgaagatcatgcatgctacgtccccctcgtcatggtgctttgcgagagcagcaagatcacccctgcagcgtggggagggaaaagatgggcaacggtggggagatggaggaatagagcacctgaagtggaggcacagttgaggtggtcagggtagatctggcatcttcgagctcaatagcagactaatatgaagccctcgggctcgtcgcggctggctctggcaaggagaggcagccaactcgctatgtggtgctctgcgttggtggtggcagcggcgatggctcgtcatcagagaaggaggttggtgccgtcaccgtccattagttgttgccaattcgtctcctcccgcatgaactatgtccaaaaaagtggaaaaatgggcaagagagtcaatttccccgaattgcatacttatcatgctgtgttagaagaagtgataaaataaaaacaattcagagttcatgagtgtcaaataatcgaagtcactcaaagatggcactcgtagggttgacttctcctgcctggttcggttgccaacatcattgtgcattggtagagttgtgcatacataacttaactcatcatgattaaaatccgactatatccataaattgaattatatgctctcgcagagtctgtaagttatacctcttttgtgaaaagaaaaaataacctcgaaagcctaaagctacatcaatgtaagtcaaattagcatatagtcctgccaagccgatttgccatgcaacactacacaatggattaaaatttgcaccaaatttatcgagccagatccactcatgcaaatggtgatgatattacattgaaaataattgtcactctctgtctcccccatgtatctaaggcatatacaattataagagttttatttcaactcagtatcacaaaagatttgatagaaaatggctcttagagtatcaccttcccaaaactgattttgagggattttaggtgaaaattttgatcaaatcccctatagtccaacacacgttttggagttttttggagttctcttcccttatttctcgctccgttgatttaggggagagaaagcgctcccctccgactcgtctctcacatgtgagggaggagcgtgatctattctgcacgagaattctatttatagtttaacagaagggtccacttttagttttttttataaaatttaattaggtttctcttgaagatatcagtttatttatttctatttttagtttaggaaaccaaaaacaaatttttaggaggagattattcataatctcttggtaatgcccttagataaatgtgcaattgatgtctggtttgggccaactatatcaggtctactttacataccttaccaaaggttcgagtttcagttgcattcctcaaccgttatactaggtataacaatctctcatcttttaaaattagtataaatatagtctcaaggcattactgaggctgattttggttgatatcggcgttcacctgacgtattaactaagttctcgtcccatgaggaatttatgtggcacttatggttagaaaaaaaaatatggtaagatccacgtggggctcacctgtgaggggtcttcttcttcccctttcttcccatctctctctacatctcccctatcttcctctttgtctctaggaaggcaggcggcgaggataggggcgacacctagcaggagaggagcaaggcagcggcaaactcgcctccgtgggggtgggcaaggtagaaggagtgtgatcgattgcccatgtgggtcctatcgttatttttttttctaacggtaagtaccacgtaaacgctacatggcacaaagaactagtgaatacgtcacgtgagcgccgcgccagctaacaccaacctcaatattgccttaaaattatatttacacttgttgtaaagatgatagatgtgttgtattcggctttagagttgacaacgtgattgaaactcaacccttacacgacgaatgtaaagtggacttcttccttatggcaaacatgccacgagagcctctaaatacaggcccaacactgatctaacatggacatgctcagctcatgcaaatttacaggtgggctcccagaattaatgagaattttgttgcaggcatcatcgagggtgctggctcaatcattgtaaggggaggccggtgcggtgctctgctccgttggcttgtccatggcggtgctctgctcctaggtccaagcagtgcctcatgttcaacaccgtggttgccgctgaccatcatctacaacttcaagatgctcctcctgcactgaactctgaaccattttggacagagttcatctggaaaatatgaaacatggaagaaatacttgtactgtactatgtatttagtggaattttgagatgttatggaacatatattcaaatgcgggatcaattgtatatttgtatcgccaattcagtatcatgtaaagattgtttttttccagatccaactcaaccatgcgtgaggctagtggcatgtacatgtataaccattaactgacaggtcgaagaacagaaattgtcagcgactgactagcacatatttttttagataatgtccatgctgatcaagtatatatactatacatgcataattacatatatatatataaactcctaatttttcgtatgcataatttcaatccgccgcctacagagaccagcaatttctcagagcaacatcacaacgcatgattcccaatttacaccaatggaaccaactttg

SEQ ID NO: 18532 - DNA, 37921 bp, Oryza sativa
  unsure (1)..(37921): unsure at all n locations
cgtgtccaggtaagacgtcggtccccccgnnccagctatcctttaaacatttaacatttttatctttatgatactctagatcattttcaactcttttatcaatctatatccaatttattatatgctgaaaaatggtggttacatatagctattgaagttcattgacgaatatgaaatatcggcaataaaacatgtctaaagtaaaatttactctcgtatgaatgtaatatgtggctgatttgttcaagaatttccacatttgagctcactcaccttcctgtgaagacgcatgatcctgagcctgagagtattcaaaagaagaagaaaaaaattaaattcagcaaaaattcagtgaccgaggagggagtgaaatactccgtattacagaagaaatggagcttactgggatcggcggtggtggtggtggcggtgccattgaaggagcaggtggcgccggtggacgccatcttctggtagtagtcgttgtaggcgtaggacgccagcgccggcaggttgttctgcttgtagcacgcgccgccgggctggatcgccgcgcagtccgcctgcccgggcccgcacgcccagttcagccccgcctgcagcgccgccgcgttcgcgttctgcagcgccacgcagaacatccccgccgacgttgccagcgaccgtctttcgccgccgccgacgccggcggaggcctgcagcaggtagctgtggtacaccaccgtcgtcgcgccaccggcgaattcttctgtctccaccggcgccgcgatcaccgggatggcgcccccggggaaccccagcgcgcgcatcgcgccgtaggccgcgtcgaccatggtgtccgtggactccgacggccgggtcttgagaaacagcggcgcgccggtggcgttcaggaaccggaggaggccgcccgccacggcggcggcggcccacgccgggggagcctgcagcgcggcgccggacaccgcgctcgacaccttcacgcggccgtcgaggcgcgacgcggcgagcgcggcgtggaggttgtccatcgccgggaggagaaagtacgcgttccccggtgacctggccacaacgtcgtcgccggccaccacgtgcgtgatcctcgtcgccggaaggaaccgcgcgacgttggcggcgacccagagctcggcctcctccgggaactcggccatgtgctcgagctggtcgttgggcacggtgaggatcacctcctcgccggtgttcgccagcgatcgcagcgaccgatggtccccgccgccgatgaacacgcgcgcatgcttcgtctgcttagactgaacaatcttggcgaactccgacggcgagttctccggcgaagggatcgtgttggcgccaacataagtccctgctcatcattggagcagaaaatttagtgtagaacaggcaaacacaacaggtgatttctgaatttctgattagtgacgaagtgcagaaagataaaagttcagttggttcagtctagtctacttatcctgttaatccatgttagtaattgattggagcagaaaattttagtgtaagacaggcaaacacaacagatggttttgaattctgaatatctgattactgacgaagtgcagaaagatatgaaagtacagttggttcagactagtacttaatcctgttaatccatgttggtacttggttgtagtacatgatggttgtgcacttcatagttcatacaaataatgcatagaatgatagtactcttgttagattaagagtgttagatcatgaagccctggaatcatttgctgtcatcagggaaagaaaacatgacctgctgcatgaaagatcagaactggctacagttcaggtttcagagtgttcagtatttgaatgtttgttttctcacagctgactgatatgatttgggttgtatcaaacaaatcattggctaagtatatattattcgcaccattctactatttcttaagcatgagataactgataagtttctagatgtcacatgtatggcgtatgctttttgtgactgaagataaggcatgcaaagtggggaaaagcacaagcatatcagaaaactttgtactagcttaaaagtctcctataatgttctgcactttaggcatgtatgttcattttttttgtaaagaatctcagtgatgaaaaagaaagtgagaaaggaacctggttctgttgttaactgaaactgaagcaaaaactaacaagagaacaactgatacggagtactaattagtaaatgataatgctacttttgctactacagagtgcacatacctgatgcattgcagacaagacagatgagcaaaagtatggttccccgccatcttctgtccaacatcattgatgatagatggtgctacaggaagggcaacttcttgatgcacctcttggacctgttgaacctagcaataccatcagagaattccagaagattatagaaagtatttgcaattggacgcttgcatcattgcatgctcattttggagtcaggggaaaaatgacctgtttccagatcctcatgaactaaagcacaaaattcccaaaagaaaatggggcaatacccccttgcaaaaaagaagaagaatacccaaaagaaagtgcctcttgcaaagtgcaagcaaagctaaaggacttgcaaggaaaagactacaatataataaaatcctacaaaaaagttcctatcaaattctccatcattgttcacacaacccttagcaattacatgccaactctataagaacaatacatgtcaaccagccccatgcattgttttgatgattttctacttagtaatatagcaacctagtatcgaataggacatatacttcatagtacaacgaatctgaaaagaaagcatgtccggatatggaatttccagccgattcagcgagaagttccatgtcctctgaataagtccggtagttgggacgttgttggatcagaattcagaacagaacagaacaaacacagcaatattcataatacggatgctgcgttatctgaggtcggccgggccatacattgtagccttggagatgcttcgagagatggaaccgtatactcaccaaacaaccctactagtcctacatggcgacgtcatgaagaaattaagcagggaaaataattgagatgcgacacgacacacatcgaagaaagaagaagaagaagaagatggacttgaattcgccggacccagccggtgatctgatcgatcaccgctgcctggtgtcatcggcagagcgacacgaactaggctagtcttgaagccaagtgtccgcgtcttattgggttgaccatgaatgatccaaaacaatttcctaagctaaaacaattattagtagtaaataattttacggttattgagaatgtaacgtgaattactacaatttggtacattttgatacctaggtactatgagataccaaatctatctatctatctattatatactaaagttcattaaacttcctacaaacgctctcaagctaccacgtggcgctctaataaattagagaaaatcctagaaattctaagaaaaaagcaaaacatctacctcttgattttcacttaaattggtgggaccaatattatacaccgttagataaaattgatcttaaaacaaaccaaatactatggggtcccacctctcctcctcccgtgcatatgtacgtgggtatatatatatacacgtacataccatgtacatacacccttcttttcttttttttttctttttttcttcttttcccatttatataatatggatatatacctttttaaatattcataaaagtccattaaacttcctacaaatgctctcaagctgccacgtggcactctaataaataagagaaaatcctagaaattctaagaaaaaagcaaaacatctatcccttgattttcacttaaattggtgggtccaatattatacaccgttaaatgaaattaatcttaaaacaaaccaaatactatggggtcccacctctcctccttctcccgtgcatgtgtacgtgggtatatatatacgtacgtaccatgtatgtacacccttcttttcttttctttttttttcttcttttccatttatataatatggatatatacctttttaaataatcataaatttacaacacaaagaatctaccatcatacaactcactggtaactaaattagctctacaatttttgaaaataaaatttaaaccattatatgtgaccattaaattaataatgtaatatagtttccacttaaacatgtgtattcattattttgtactattattttcaaataatgcactattttaaaataaagtttacacaattatattgtgtacctatcaaataaacaatttaagatctatattaattgatttatacgtgcacttaaaccgatggacccattacttaaattatcggaactatttttttattacattggactattattctcaaataatgcatggtttcaaaataaagtctacaccattatattatgtacctattaaattaacaatttaaaatatatattaactaatgtacacttacactataaccggtggacccattatttaaatcatttgatatattatttgctaataaataaaacgtccgaagttctctttttttgcccgctgcacaatgcacatctgcacctttaccttttgcacgcatgacaaagcatcatgtctggcactaccgttttgccacatatcaaatcatatatggagatgattaattttgtcaataacatgaaaaaaaaattaaaggtgtgatgcagcgagagaagaattaagcactgtgggttgtgttttttttctaacacttagctttgtttaagctgaaaccgagagttgattacagaataattataacgtattgtgttatgtcgtatttggattttgcactatttgttcgtatagatgaaagaattcattatgttataaatgtgagcacaatattaatgaatatcaatagcactcttacaaagactagggtgttataaaggagtttaagatcctctttttttccctgatttcatagttggattttcgtttgcacgctttccaagtttctaaatggcgtctctttaaacaacattttaactttttataagtcaatttattcgtttataccctcaaatagctatcacataaataagataattcatcaatttcagctgtcctaaaccctaagtagtacatatttttttatgcgagtcatggtgatcagtaaattagggatcaactgataatcaaagtcgtaagatgaatatgtaagagctactatgaacaactgtaatcggtgtcaaaattaattgctactaattagacatctaatggcttgctagccacatcattaatttctctcaacatgtatataaacatgcacgaagctagaacaaatattaccatatgccctatacatatatatattaagcggttaatattcttattacatgtgttaagtcctttaaaatttcttaaaacgctctcaagctgccacgtattagaaattctaagggaaaaaaatcaaagtatccattacttgatttttcacttaatcggtacgtccaatattataaaccgttagattaaattgatcttaaaaaaacaaaatactataaggtctcacctctcgtcccgtgtcataggtatacacctacgtacatggttatgtacgcttcccctcccttttttcttttttcccttttttctttttttccatgcatacacttccctccctttcttactatatcatgcgccttcttgagacgatttaatcacaagaattttgagtatcttgctctcgcatttttcatttgtggccatactatacggtatatatatagatggactgtatgataattaactagcaatggtttcttatttactcgagaaaaaaatgatttaaaactcataccttaagaaaaagtttttgaatggttttttaagataccttaagaaaaatagaacccttaaattattataaaataacattatccgaactttagtttgcccttaatctataagacaaaatttttgaataaataataattttacctttcaataatataagtgccgcgcatacgcgcgggccactttcctaatttataatagaaaagtggtacctcatagtacctcctcaagtaccgtaaaatttatcttagtagtagcaccccaagattctgacttcaaatcttcatatgagcgaatttcagattgagttatttgagggctatattttctatttgataggttcctaatttaaaaatattgtctatatctggttggatgtagagcccgggtaaaaaatacccttctctaaaaaaaatcagtagtaatcaggattagcggattaagtgcttagctatccccatcaaaggatagatatgatatgataaaaaagaaacaacttttaaaagtactctacttaatcccgtagctctcgtatcttcatcaatttcagtagtattgctttaagcgtcaaggtcactgattgatgctcgagagtgaaatgaaataatcatcacaaaatttccagctagaaatatactacgagtttaaattggtggagtaacagtaatacggacaactcggattcaagtagcctattgggtatgcgagaatcccatgcaaagctctacgaggatttttacagtgaaaataaaatcgctccaaattaaacgctttgactgacagaatatgaatatcgcacatgaagtagccagctgattgataggagaaatgaagctcaataaatttgaaattgagaaaaggttagatcatactgataagaattaacaacgctagcataacgaggatgaactagtataattcagcagatagcaatacagaaaccgggcaacacgatcgattacccgacgatcgagaggaacagaaacaagaagcagaaacaacagagtaaatcaccatgaacgaacgaatgatttcatgctgcaacaactggaatttcactgatggctgtatgtacctgggagtagcagagagctctcccagctcgcagcctcggatctctcctcgtttcgcttcgcccggacgaaaagcctggcctcggaactgccgctaatttatgctaagcactctcctctgttactgtgttcttggagctgatgagccagccagcagatagcaactgaagctgaagctgcagctgcgaaccgagcagggaggagcagagtgatggcaaggcgactgccattttatacgcaagctaatctctccatcaaatattcaattagtacggtaatgacgcacgctaaacgacgctatcatcggtgacaaaggtggccccggaagatggctacgaggcgttggaccaaaaaaaaaagagagagagagagaggaagagaaaaggaaaccagaaaggagaagtagatgagcagcggcggcgtacacacgcagacacaccatccatgcagcgacatcttctgtttatctcgtcagtgaaactgaaacgtgtttggtttgcacttgggcgccggcctgcctgcctgcctgccactactgtagattgcatgctttgcttctttctgccggatagtataccgacggatcgagaattgtctgaccaagacggcatgctttgccttcgagcctgttcactttggtgccatttttaaccttagcaaattttaataaaattgttaaaaaagtggctacatttagtttgctgccaaattttggtaactatataagaaatcctgctaaaattttggcaagttgctaaaattttggtaatgctaaaatttggtaaggtttttttttcatcaaagtgaacaggcctttcatcttagtcttcagttaggtttgggatggattttacaatataaaattttggtacctacatacaaatattcagtctcatcgttctatttatgtttatatttgttagctaaaatttaaatttagagttgattttaggtttttttttcatcgtagtttatttttcagtctttatttttaagtcgttaagaacgtgtatatgaaaattttattcacaaactatttttcatttgtaaatatacgtgatggagctgattgctctttggcttgtactttgaagttatctaggctgatataaattcagagatgcaatttcttaacaacagtatatcatggatctcatgctgatgtgacatggcaatgccaaaaaggatcggagccattgcctgacaggtgtgattgggtgccaacccctaaccgaaacatcaagagaagcatctggtcaaaccggccggacagtaacatctggctacgacttgggagtttcggacttcaaaacaggtgatccatcttcagctgaacggcatatccattacagtactatcttccaaccaaacttaactgatactctttcatccggccgagtaattaaccttaagcaatcgattgattgattaattagtccctctctaatctttcttgaggcttcaaaagcaaaagagagtctaatttgccatgtcattagccgactgcttttttgctaatcacccaatgcatgataaggtagcatttcgttggtgccctgcttctgcttctgctttgcgccgatgagccgatctagttgcaccaaaaaggggcaactaaaagagacgcaatgtggaatttgctttgtgctgcattggggacggataagcctcgacaagtagtcgacagagagtgcttgatgcgtcgcgctttggacctgctgacggggtttctcacatgcgctgatgcacggcacacaaaaaccgactagatttcgccgttcttttatccggctatatcctgcaacctgcattagaaaatcgtcatcattctaagggtccaagattaccacccatttttattctgatacactgcacgttcccaatacattatactcctgcgtaaaagttaagggtctcattggttgtcctatcgcttataagtcagagccaaaatttaaattttaaaacttgattttcaatttgattttgatgttctttaacatagtttttttttcaattttagcttttaagtcgctaagaacatattatatatatatatatatatatatatatatatatatatatatatatatatatatatatatatatatatataggtaaattaactggtgctacatggagtatgggctccaagattcaaattgagtatatacccaatttaaatgagtatgaaatttttttaaatgtttagatatgaacatcaacttctttactaacaagttcaaacaagtttgaactttttttttgttagattttggttctaggtatataacatccaaacatataattcgttaggtatgtaataatgaattgtgaaataaagttgagtttgagttgttttgttgttaggtatttgtatgaatcaaattcatatacctaggtatatactcacaatttaaaaattttaaaaaatttgagagaatttgtgtgttttatatcttggagcccgagcaccatggagtcccatatgtgtatcatatatatatatatatatatatatatatatatatatatatatatatatatatatatatatatatatatatatatatatacacacacagaaattttactcatgtattttttttaatcgttaatagctcgttatggcttataagtcataagcaactgatggggataatctaatttattttaaaacggatgaagtatcaaacaaacaaaagtatcaacgttatatatggccattggaaactcgatgacacactttggccgaaaagaacatagttgtacatcaccggatcacccctgcgacaccatacgtggattcaaatgcagtcgcactcatcagcacggagcacgtaattaagtaaaacattatcttgtgacaaggaaaaaggagccggcacacgttgcatcatcatatgtattgttgatatacacttcttcaattcgttggcttttctgcagagatccatcaatcatagcttaggaacaaaggaaactttggctcaatctctccctagcctctatgtacacatgggtcgttgcattctgcacacatcgatgcacatggctcgattgctttgcttgggttggttctcgacctgctggccggtgatggacaaatggcggtgtggcgcccggtagccgtgtctcgactgttctctctctaaaactttagttttgtggtggataagtgtaaagttaaggtttcgttattttcggcctcatcttttcacttaaattttaaattttcaacatttaatttgaagctgatgttgggattttttttatcgaagtttatttctaacctttacttttagatcgctaagaacacgtatataaaagtttttgttggaaatttggtcataattcggcatattttaatccaaaatattaagacaataaacatgacatttgcaatatgagtagatctagtgacagtgatagatgtatacagcttgagtatgcttaatatgaaataagcatcaacatttacatagtaacacaatactgccattgcgaagagtattaacaaagaaacatctaatagaatcgggagaatgaaagtataccccgaaaacatcccaccgctggattttgaagcaggattgcctccgttgatgtcgttcatcatcttgtctccaatctccgtcgacatcttggtgaaggcgtcgatgcagcagcagtagccgtgaagaacaagagcagtcgcgcttgaagcgttacccaaaaacttgatcgcccgcctacccatacaggttctcaagcggacggagtttcggaggcacctgctcatcccgtacacctgagcgcgcaggtgaacagaaccggggaaggattctacagctcaagaacagaggaggaggaactcgaagtgcaagagaggtcgggaagaacttctttcgtccttctagtcgctgtggagtatatatatacgagcgtgggagtaacgttcggaatcatcaaccacggtgtttaatttcgtaaccgacgcgctcgttaatacggaatcaattcacgacgtttaattccgtaaccgacggaatcaattcacgacatttaattccgtaaccaatgtgttcattgatacgaaatcaattctccgtgtgtttaattccgtaaccgacggaatcaattcacgatgtttaattccgtaatcgacacgttcattgatacgaaatcaattctccgtgtttattatcgtcaattcatgacatttaattccgtaaccaacgcgttcattgatacgaaatcaattctccgtgtgtttaattcgcgttcattgatacgaaatcaattctccgtgtttattaccgtccgttacaaaacgagagagcgcagcaatagctatctgcctcaccccgcctggttgtccgcgcaccatcaatagagactctccactagctctgtatttaagttgagacctcttcacttatatttctaaggtggtattattacccatagcacttaatgtgggccaatggaatttattaggatttaattgggcctaacccattaatctaacagttttattaaaaaattactctttgttgcaaatatgccgtttggcttatgatgggaacctttgttttctattttctgctagtgtgtttagaccattttcagcaaacgtaagagttttagcgaaatgaggttaaccccctgtaggagctgagaaaattcatttgttacaaagaaggcgttgtaaaacgagaaaaaggaacaatactgattgagaggatggaaaaggcagaaatgggaaaaaaaaagaatatggtatgaaacaaagaaaagaggggagaaagtcaaagaaagaaaacataccaaactttttcatgaggggaaaaatatgccaaacttttcctgagaaggaaaaatttatacttctaccaaactcgaaagacaaaaaaagagaagagaaaatgaaccagaccgaaatgggaaagcaagaaagtagtcgaaactggaaagcgagaaaacataccgtcatgggccaaatttctctacagatcaaagcccaacaagagcccgtttgtgtacagcccatcttacccgtcacggcgtcacctcccgcatccaccgtccaatccccgcccccccggatccaacggtccacgcgacatctctcccctcattaaagccaaaggcggcacgcacgcacccctccccctccgcgctccttctttccctccccctccgcgcaacatccggaagcttctggaaatctggaggcgacgaacccaggagcggcgaagcgcctccaagccctaggcgggaaaggtaatcatcatccgattcgcgagtcgagattcctatccccccgttccccttctcctccttctccttcgccggtgaggagatttctaggtttggatttgtattggtcgcgggatttgatgcggtttgatggttgattcgtgcgcgcgcgtgttacatacacgtcgttgtgtgccgcgcgccatcggggaaaccctagctcgctccaccgcgcggtgtggttgcggtgtgatgccgcccgttaggctgcagcgtttgcttggagggtggtggtgtctttgaggccggttttgtgagcggcgggccgattcgagggggttgcgtcgcctgatttggttatgttttgcggtttgcgtgggatttccttttcgctagggtttgggtgttcttggcggtgtgaaggatggagtgtttgctggtgggattgaatggcaatgatcgacagctgtgtggattggcggcgtgctcatattcttttctaactcttgatttagatgccataggaagatgttatgcattcattcacaacagttatttcttatacttaaacttgattgatatataaagtatgctattgaacgcttctaatcatttcatcagtacggaagatgttatgtattcattcacaaccattgttaacaatacagttaatagttcttatagattattaagttgacgactcttaagtcttgaatgccttgtgtgcgttcaaggcactacttaaatttaccattgatggatgtaaattgggagtggcaattatttgatgcatagaaatatattgtgatgtctatttttctcgaatgctgaaatgttgtagcttgttttattccctaccagcatctaccgaacctttttagctaaaaatagctgaatggaagaatgagtcttgttgataaggtcacttgctgttggcattgttctttttagcggaacgagtagcttatgaaacacaatcgcatcatttgaatttcctctaatggcaatttttttcctgtaagcttagatcactatgggaagaggctatgattatggtccatcaccgccaagagaatacaggagaagagcccgcagcccaagtcctcgtgggcgctatggaggccgtgacagggatctcccaactagtcttttggtgaggaatcttcgccgtgactgtaggtaagtttctttgcaccttggtcagtaactgaatgagtgttttcttgttaagtaacacatgcaatcacacattccggttacactagttgtagttgagttggtgcaattcatcatcatttgggccaagataatgtctctttataaaattataatactactgatgtgcattttttaaatccgtaaattatttttcatcttgagcttctattgcatacagctcatgagcttggtttgcaatgccaaaattcatttagtcatcacttataaaccaaagaagcattgctttggcgcaaaacagattggagtgtaaatctaaacattgttcttctgttgtaatgacataaggcaaatgagtaaatgtttgttgttttcctaaggattttttttgtaacctgtgttattattgtcatctgttggatattatatatttgatttacagaagttcgtaactgtaaggatttctcgccttttcatgtcttttaatttcaatgctattttaccactttctccatgttgcatgtctttaccttagacataattatgaatacaggcctgatgatctacgaagaccatttggaaaatttggtcgtgtcaaagatatatatcttccaagagattattacactgggtaaggcacctcaactcaaatagagccagtgttcattttcaactggaggcctacatgctgtttagggatcaaaccatgagatgtttaggatgctgtgatattttttcaatccagtaatatgctatttttggattcatttgcaattggcttaaacatgtgctttggaaatgtttgtttgtgctttagtacatttggtacacctaaattgaatgatttttgcccacctcttaagattaactgtgaaaataattttttgaagacacaagccttaagagtactctgttgaagagaagggaagaaatagagtataagagatatgcaagttatgaagagtttcaagtctatctttaaactctgatgagtacaaggtcagcagcctagtgcttgctttatctgttgaaaaatttgtgtatcaacatccagggaaaggaatcaaggttcaaggatatgaataatcaattgttcctttacttgactaaagtcaagtatccttttcaggattttcttgtatactgttcagaattgtgcaattaattaaagctaaatcttgttatctgtaacagggagcctcgaggatttgggttcatccaatattatgatcctgaggatgctgctgatgcaaaataccacatggatgggcaaattcttcttggcagggaagttactgttgtatttgctgaggagaacagaaagaaaccatctgagatgagggctagggaaagagtcgggtattgcactgctctctttcatcctttttctctaatgttttttgttttgttaaagtattatctcttttgtggcatatgtaaccagtttgttcatcttctgcagtagcagggaccgttcttatgatcgcaggtcgcgctctcctagatactcccgctcaaggtcacctgtgtactctccaagatcacggtcccgtagtcgaagctactcacctgcacctaagagaaagcactattcaaggtttgacttcagtatcctccatggacgtttatattagtttattcacaacaaaatcattcacatgttttaccatcttagcaggtctcctgcccgtcgggagagatctctgtcgcgctcaccagcggacagcagatcacgaagtagaagcctctctgatgaccgccgcagcaagtcacctgacagggagaggtctctttctgttagccggtgaggagcttaggacccaaatgccaacggggcactgggttgaaccatgtttcgatgatgactgcttcttgttactaggttgaaccatgtttcggaatttttaggccatcctgatcttctaggaatgttaatgatgtgtggtcttctaggatttccttttcattgttggatcctgaagataaaaagtcgaagcatcgaacaacttatcatattctttgacctcgtgcccattttaagtgactggttattgccttttgtggtcctgtaacgttaccaatgatttccccattggcgagcaggcattgttaatgtaagaactcaagtcaggattactagttgtctcaattctgcttttcatactcatcatctggaggttattttgttggttaataagaacagttttttttctctgatacaaacaatgtacctggagttaaaatcggtatatactcgagagatgtgacatgtggcaatcttcccttcttttggtgccctttagatctggaatttctttaaggaaccaagatcattgcctcacaaaattagacctcacaaaactctgctattcacatgatctcctggtttgtggcggcactgattttgttttgttcctcgcttagacgcgtagtcgtagctttcgcaaacgtagctgaggatttggatcgttcgcaggccgaaaccaggagacgatgaacgacgatgcaaatgccaattggacggcccggcgctgatgcagttatgcttatgcaacatatgaatgtgatgagcgcaaaatgatccactgctaaaaggaaatttatacagatgttgaaaggtcaattgagaagctggaaccgaccatgaccgcgcatggtccagtacaatatagaaatagtagcacatcaatgggttttgaagaaagaaaaaaaaaagaactgggatcagtaataggcttataggcgtgccaactcacctcaccttcaatcaagtactctacagaaaaatggtacttcaaccagcaaccagtgtagtaaaatggtcggtaaagataatgtggcccagcaaccagtgtatatgtaggagcagcttggagttggcgaggatttggtcggcaaaaggaggccaactgccggtttgaccacggagtaataagcactgcattgccttctggttgatctcccggtccttacgagtcaagcagtaaactaatcttttaatcagccggcagcttggccacggttaaatgtcctgcaaatttcggtcgcacgtaggagtagctgcctagaaagagcgtgttgactctccaggaaaggcaacaattaattaagaagaaaaaaccgaattaattgccggacgaggtttccggtcagtttcatcgatatcccaatccaggacaccatgcaatgcaactaacttctccagcagtcagcagcactgcgttgggtcgggtcgtccatgtgacgcctcattcccgatagtcatagacagagatatcatatccacttacacttgattagctgtaggatctgaacaagaacatactaggtaaacagttaacagtcctgaccacctctgttcatgccccagaagaagaaacattgttcagaattttattttctgtacttgatgaaagcaggttacagtgtaatcttccttttttatatagaaaattttgacaacaaattaatccatgatcacacgtatatgcacaccataatctcttcttggttaggtcatgcccaattgtccatcgacactaactcattgcatccacaaacgaatgatgcacatggattactgcttgctggctgcctactgttctacttcagctgttttgctggtgacaccgacaagttcatgattctctgcaggaaatcagtgagaatgccgatcgaagcacaatccatgacatgacatggcatatacgagcctgattgattaccatctagaaaatatgtagttatcatacaaatatatgcggcttgggtctctttaattacgatctgtaactacggtttcatatagcagcagggaaagggcaatgcgtatcatgtcagggttatcagccacccatcaaaatcaagccagccatgtataattgtatatgaagtgtatttctttcaaaataataataataaaatgtatatggagtatatatatacatgcatacatgtccgcatcttgatcgatcggtgcctgtgattaattcaagatcacagaaaaaaaaagataatgcacagtgtcagcacagctggaatagttgttggccaagctggattcctgtcaggtccagtttacatcatctctgacaccctttttaatcgatcaataattaatgttacttagtactccctccattccaaattaatctacatatagttttttttgaagttattcctaaatgatctacatatttgtgttcattcattaagtctattcgttatttgtacattggagtaaatggacattgatgcatgcatccatgcatacaagtatttataacccacatgtaatatcttgatttgctattggctaggaaatagtgagaatggtgtatgcatcgagtttgttgctagagtaaatatagtatgagagatttattagtttttcttggtcttgatataccatgaaatatgtatatcaatttggaatgaagggagtagtaccacttaactgaggaggaggagcgtgtaatgctgcttaattatatagagcagctgatgcatgtgaatatattgatgtttttgtttccgagcggatatattagatgatttgactctctaatccaatccattaattttgctcagatatccaattaattcatgtttctttcatcaggtcaagctaattaagtattctctctatatctcaaccatgtcagtatggttccaagtagttgtggtactaaacaaatggacggtgatggcatcagtttatttttttaagctaaaaatcttaaatgtaaattttaagaacttttttgacactccttccattctaaaatataagcatttctaaagtttcatgtgaaaattaggaaagcaagtggatataaattgtaatggttgtggtgggttgagatgagaaagaagattgattgagatttaacatgttatattctgaaatgagtattaaatgttcgtatttgttccccgcaaaaaaaatattcgaatttgttatattttaagatggtgtaatatatttggactaattatctacttatacatatctaacctgcactaattgaataaataagtgaccaagatctactagattttatctcgatcctacgcgatatagaaaaacatgagtttaattagtttggatgtcaattttttcccttagaatcataggaacaagaaagctttctactccatccgagccctaaatataagagattttagttggacgtgacacatcttattataataaatctggatataatcatgtccaaatacattgtactaagatgtgtcacatcaaaccaaaatctcttatatttaaagataaagggagtatatttttcttttcctcattctttcgaatcaaatgcatgaacgggaacctttcctagtactcctcccgtcccacaaaggaggtcattctgctcgcaagcaaatgtcccatattttttgacattgtacgctgtacttccccaacagcacacagttacgaacttctagaaaaacatccataaaaatgttttgaattgattggaccggttacattagtttaatccattaagtagtagatgtggtagttcattttcactcaaaactaatttggctcaatcattctagaacgtccagcattttgagacggagggagtatatgatttcaattgctctttttttcctctactttttgtccaattcaaatggtttaaaagggggtgtgtttagtgagaataaccatggtttatatgcaaataatttaaaacgggaagtacatcttgaaaagtgtcacgcgtactagtagatgaacactacagcgtccatgtcagctggccgccggcgcacgtgggagtttgccctagcggtgtgacccgtacaagcgtacgtacggacgcacgagtgcgtcctagctacacgcaggctagcagctggctgattaattgggcctttaaatgcagtaacctacgaactgtacccatctttgaccagaaatccccgaacattattactccattatcttcaaattttccaacaacagtagtaagaatgcaagaccgacagtagtcaaacgaatatgcagtacagcaagcatagacgacttcaggtctctttaatttaacgaaataggtagcacgttttctttaaacgattccaatcactcattttgccattcctaaaacagcatgattattaatgtgtaaaattaagtttatcaatatgttctttccagcttcctcttaaaaaaacttcctccgtcccaaaatataagcatttttagaataatgtaaagacgaagatttttaactttaactattagtagaaaaaagtaaaaaaaaacatcaatcatgtaaaattgatgttactagatgtatcattcaataaagtatcataatatacaactcattttatttaaaacgtcttatttttatagatattgttgatcaatgtagcatctcaaaaactgtgtcgaaatctaaaaatacttatatttgggacagagggagtatcttctttttagctatttactatttttcaaatatacaaagttgttaccttttgaacatcattgttgcacaatcgtcttattaaaaataattatgtaaggatcatctattttgttttgaattgttttataattaaagttattttaagcatgatttatattttttaaatattcacactaaattttgaataaaatgaatggttaaacattatgttcaaaagttaataatattatgcatttaaaaacataaggagtgatatatatattctacaaagtaggaaatgaacatactatatcatcatgatgccatcaagctagctaattataacatgtaagtaatcattaatttgcaccataggactattgttgacacgctttattttatcattaagttcgtacgtaaccggcggatcgacgtagactcaattcaaaccttcattaaatttaaaaaggttatatatccccgttttctctccctaatccagtctgtcatgtgcttgctacttcttgatacaatcgttcgtaaagtgcaagtttagaagatcctccccacttaaattaattattatatcatgccgaaagaacttaattagcagggcacacgttgtttctaggcaagatcagcagcatttcataatatatatgtgcatgcatgcatatatgtagatatgtcagtgtcatgacactgaggaagctagaaactctcacttataattccaccacacaccaaaaccatttgtctcatcgatcagtcccctacgccatattaattgttaaaatgactttttgacctaaatttgtggtccaatataacacacattatatgaatacaaaaaacagaaataatgctgtttttaaaataaaatgttggcagaaaaacatgaaaataaattaacaatgggattataggatatttcttagatccttcatgtgtctaaaaccctagtcgtcgccacagcccacaggaaaaacaagctaggcctaacaacagcaacactagtgctgtacatatataattatatatttattcatgctgccaaattaaactagatgcatgtacattagctaggttgtgcgtgtcggagcccataaatccctctgcccttcgcgtgatccaggtagattagatttgccttgctgctgtctctcatgtgcaccgaccccctgtctgattaattaatttattactaatctataatataaaatacttctcaatttatataatattataaaatcgagtatcctgaactaattaattcgtccaaaatggaagcttccacggaagtttcttctgtgttcttctctccttggacgtactcgaccccatgcgattctacgctagcagctgggagatcgagagtatagcagtttttgctacgtcatcgatgaccatgcattaggctaactaataatcaagccatgcattggttagctgattaatttcaacgcatgattaaattagcgtcaagaacaccctggcatttcggactagaaaactgcatatcatgttgctggttaaggtatatatcatcatgctcccaacggagagtacggagagatgagcgattagatcaattaaacagggtgctttcggtgtcttcttcttggataatcttggcacttttctgcataattaattgttagtgcatatatgtatatgtatttgtgtctgtattttgtgatatgtttttgggctcggaggttgtgtgccgtcgggctggtcagcaattgcgttcagagggcaacgtcttagggctttctttttcgatgaataatttatctaggtattaatataattccttctgtcttgtgcctgtttaattccaagagacatttagcatttgttgtttgttcctgctgctagctttaattactctgcatcattaatacggtcccagttttgttggcaacactggtattaatacgcatctctgtactctatgattctctctatctttgcactgggattaattatgagagcatttcctgtggtctaggggctgagtataaactctcagcaaaatgtcatgaatttaggagggaaaagaatgtaacgaaggctttcatccactagtcatcataaacttcagcaaaaacaaaagaaaaagttcccctaagaaattaacccgatatgaaatgggaaaaattttaactgcagtttaatttacagcctcatcgtttgggataagccaaatggcatatttgtaaacgaaaaaaaatttatgaataaaaattttatatatgtgtttttaacgatctaaaatcaaaggttgaaaaaataaactacgatgaaaaaacccccccaaaatcaactttaaatttaaggttgaaaatttaaattttaactgatgagcatataagcataagcgaaaagatgaggctgttattgattttccttgcacaagtcatgaatatacatttgatttgattttttttcctggagttatagatgtcgcaattatgcattttaccaaaattttgattactcgctgtaaggtatttttatggttaatttagtaccctgttgaccatgcttagttacaatcttgttgcagatctgctctatgatgtgctaacctaagtaggatgcacccacatttgggtttttgcttggagacctagcaacattgaaggaaaacaaaattgtggcagtgtccaatttctcaactcatggcccatggtgtccacgtagacaaagaaatatataaaggctgtgtttagattcaaagtttggatcgaaacttcagtcatttttcatcatatcagcctatcatacccacataatttttcagtcacatcatctttaattttaaccaaaatctaaactttgcgctgaactaaacacagccgcaccgtccaaatttctcgacaaatttggagttttggactgtcagtccatcccatttttgagtctcacacggcatgggcgaaagtaaccgaccgaccagcagcgctcaagtcaatttaagcaaaaacaagacaaactgtagccatcaggccatggcgtgccacgtgccacctagaatggcaaccacgtcatcaacgtatatgcagtgacgtgtccatatacagttgatttgcacgataagagtctcatatacaagcaaaactaacgaatatgtttgtttgcgtaaacatcatacactgaccatttctattaggcgtaaaccaaaatcaacttccgtgtacactgatgaagagaaaatggaatcaaaatctagcaatgtggagtacgtacggtaaatagatcaaattcaaggacaaattctttcgtatactagaaaaatgtccgtgcgttgcaatggatgaatgttattttaattttattattgttatacggtttaggtagaatgaaatttactgtgttaaattcgcttggatagaaaatcatgagctgcaactaggagtccgatcgtctcaagttagcatgcgaatttttttaatgagatttcttatgcgactccttttgtatttacaaaagtgaacgaacttaaaatccgactcaaatatggatctgtgttttcaaaagcgaatgaatttacaaaccgattcatccacatatgacgtaccaaagtaccaataaaaatatcttcaatttttataatagcagagattcgtatatatagttcctatgataggctatttggttggtgtttatagattcttcttttataatcctaccaatctagcctagaagtaaaatttactactccttccgtttcatattatgaggtgtttgactttttttagtcaaacttctttaagttgtctaagtttgtagaaaaatatactgatattttcaatacaaaacaaacatattttcaaaatgtattcaatattaaatttaataaaactagtttggtattgtagatgttgctattttttttctataatcttggtcaaatttaaagaactttgtataaaaaaaagtcaaacagcttataatattaatcggagggaatagttaagattgtttatgaagtaaacatgccatctttgggcaatgcacaacacgaactaagtgaatcctaaccatctagaagtaaaattgattaaattcaaaattgctcaagtaaatatgtcatctttggacgaagcacaatacaaactgaatcgtacccttctagaagtaaaagaatttactaatccagattgcttaccaagcaaacatgtcatcctcagatgatgcacaaagtacaaactaaatggatcggataaactgtaccttttgaatccgtccataattaacgtatcacctgtcgctgccatcgtctctccttgtcgctgcaattgactttcagcatccttcctaacgaataaccatgcatggttacaagaaattgccgcgtgtatgtcattacctttagctaattaagtcccttcataagctttggtaaattatggtgaaaaggtccagcactctgaaaaattccatcaagaacatcagtaaacagcatttgaatacttaaaactgaaatatgggctacattcacactcgatttaactatgttgacggagattaagtcagctgataagttttgccagtcaaagcgcaaatatttcgagacgaaaatgactcatgactataaataatcactccacaagcagagtagtagtagtagtaacattatttgaccaaaccgaccgacctatatgctgattcagattgcttgtgtttgtcattttcctcgttgctctgaacttctacgtgtaaaatccatcggcattgccatttcactttcagtgcattgtagaggaaaaacaaaatcaatccaactttaaaacaggtcctgcctgaaaacgtcaagaatttgcaaagaatgtgtaagcagtaactgtacagaggcaaatattcagacattccaagcagaggctcttttgctgtacaagcaataaccgtataccagatcagtagaaattcagacattccaaacaagctagtatttgcagtaactaagaattttcagaagaaagaaatagtagtaaaaaacacgagcagatccatggctagagaagaggagacaggagagaagaggacaccacctacccaaacagcgtcgtcgcgtggtttgatacacgctctcacctcatctcatctcgtcgccattgacagactagcgccggcctgtccagtgccgatgccgagtgacacacctgcctgacaacacgtacgtacgtggaaatcataaacctttttttttattttatttagtttcttctcgccaccgctcgccttcgccgagctccctatatatcgccgtcgtctcgcactgcctccatcggatatccagctcctgcagccaagaaacactcacacgcacgcacaaagcgatcaggcaccttttgttttgttgctttagaggttaattacaaacaggaggagaagatcctagttgtctagttgaaagtgaggtgagttcttgtcgttttgagtttttgatccaatcttgttagtgaagtcgtgagcttgttgtttgtttggtggtgtttgttgctattcttgttcttgaaatctgaaggtgttgtgtttggttggattaggtggtagagaaagagagagatccgggctgcaagcaaatgggcgtcctcttctcgtgccccgtcgatgactacgacgcattggaggagagcgccgcggcggcggcggcggcgtcgtcggagtcgaactccggcggcggcaagccggcggcgatcctgaaggcgttgggatccgggaagctgctcatcgaagggtcgctcagcttcaagcgtgaccagcagatgagccccacctccctcctccaggtggagaccgagatctccatcaagcctgccgccgccgacattgccgccgcgccaagggcgaggttcgccgccgacggcggcgcggcggcggcggagagcccaaagcacgaggcggcggcggtgaagctgcagaaggtgtacaagagcttccggacgcggcggcagctcgcggactgcgccgtgctggtggagcagagctggtggaagctcctcgacttcgccctcctcaagcggagctccgtctccttcttcgacatcgagaagcaggagacggccgtctccagatggtccagagcaagaacccgagctgccaaggtaacaacactgccttttctttttctttttctttttctttttttaccacctgcagtttgtgtctctgagtaatttgatctgaacatctttttgcaaaatttggctgaatttcaggtcgggaagggattgtccaaggatgaaaaggcacagaaactcgcattacagcactggctcgaagcggtgagtactgagttacaagttgaatgtgtgcaaattattcagtttttttttttttaccgctgtgttatcgttcaatgagctaatgttgcaaatgttcagattgacccgcgccaccggtatggtcacaaccttcactactactatgatacctggctccactgcgagagcaagcagcctttcttctactggtcagtatacttgtcactcagatatcacagtttcagactgaatagaaatgttagttcatggatcatgatcctgatttgattatgtaatgcaggcttgatgtgggagaagggaaagagatcaatcttgagggcaagtgctccaggtcgaagcttttgagccaatgcatcaagtaccttggtcctgtaagtggttgcaaacatgatgctaagaattgctagagttagaacatcacgaagttgtaaagtggctaacatgaaaaaactgaaattattttgtgcagaaagaaagagaggactatgaagttatacttgaggatggcaagttcttgtacaagaaaagccggcaaatcctcgatacctcttgtgggccaagagatgcaaagtggatctttgttcttagcacatcaaagagcttgtatgttggccaggtaattttcacatatcttgtgtcatattggctaaaactattgccagccttagaaatgtccgttcattgtgtaattttgtttttgtaatctcaaatgcagaagaagaaaggcaaatttcaacattcaagcttccttgctggaggggcgacttctgctgccgggcgattggtggttgaaaatggaaccttaaaggtatgtattgtttatagtcagtccattgaacaacttgttcatcctttacaaagaactgggtcatgtgttgagttctagttgcagacaaaatgctgacacaatcatgtttcctctttgtctgacaggctatttggccacatagtggacactaccgcccaactgaggagaacttcgaggagttcaagagcttcctgaacgacaactctgtcgatctcaccgatgttaaggtaagcaagcacatcatgtaaattcagacagaaactgaaaaagaaaaattctcaatgctgcagttatcctgtaaattttcaagcaaactgaaaactccattcagctgtgaatttgtaatctgacatccttttgaattggtgcagatgagcccagcagaggaggacgaggaattctggggtagcctgaaaaggatcagttcagagagctaccccaagaacactgccactgacaactctgaagaccaagccgctgaagctgaagaaaccggcaattcccagatgcctcgagtctctgacgaaccaacctgtgcagagatcgacggctgcgacgaaccggcggcgacgaggagggtagattcgtcgtcagctgttgctgctgctgctgagaacactgaagccgaggaggaggatcaagaaggcggcggcgagcaggcgccggtgccgagggagaagatcctggagaggatcaactccaagaaggggatgaggtcgtatcagctcgggaagcagctctccttccggtggacgaccggcgccgggccgcggatcgggtgcgtgcgcgactacccgtcggagctgcagctgcgggcgctggagcaggtcaacctgtcgccgaggagcgccgccgccgcgtccgcgtcctcccggttctcgtcgccgcagcgccggagcttcaacggcgcggcggcgcccgccacgccgaggtaggcgctccggccgtcgcccctgcagcatgggctggtagccaccgtcgctgcggctgactgatcatggacggccttcgccgtggaagaagaaaaaaaagatgaaacttttgccgagtaatttgtataattgcatactaatttaatttttagtgtagatcttgtagaacaggtaatatacattaattacatatacattgatatagtactagcaaagttgtttgacatagtgtatatatacaagtttttttcattcttggaagaagttgaccacaagtgcacgaattgatatgatatatgttccaaaaatacgaatgtatttacatgcccatatgttaattaaattttgatatccccgcaaaaaaaataattaaaatttgacatagaaatagcgatttctgaattgaaattgaaagaaattaaagaactgctttgaagtctatatagatacaatatgaaaattttaactgcaaatttcaaatatatagagaaaaatgtttaaatttatttgtggggacctcctcaaaagagtcggttccctccaaaaattagcgtatgctgctaattgcggcgcgcacacggtattctttagtaaaaggcgaaagaatagttcgctctgtgctcaccgcgcagctgcgtgagttcaagcgttggcaccagacccctatatatagcagagctccctaaggcctccgacttggttaggcgaggtgggactaaacgagcagagagcactctactgtctaactgttcgccctgcgacagccaatgcggcccagatgcaaacgggaggcctacatgagccgcccaacctgtaggcccaaaagcgaaggcatcatgctgaaactggaggaaacaagaacagtaatggtcctttattatgttatttttttgtatacaaagcatgagaagagatctcgtgagaaatgatcacggccaattccaataacagaagagatctcctgtttttgtataaaccatgggaaatggtcacggccaattccaaatccaagtgctacggcagtaccatttcccatggcacagtatattctcgtcgcaaaatgaagatatctgtatatttgccaaagaaaaggaacaaagggagaaaagaatcgacattttcacgaaggtgaagcatgcagacatgctagtacacttgctgcaagatcacctagtacagacagacaccagcaatcactagtcagttgacatgccagtgctatcctctacattcccaacccaacagaagccagacgaaaacctctagccaacaacagtgcacgcaatgaatcaacaaccttagttagggcgtgtatttgagttagacaggtgcattcaccttatgcaattagcctacctacactacacctcttcttccgctggagaaaagcagacgagagatgaatatcctactttctcagtttctccctttctgaagcagccgtatgtactttgtccctgtagaacaacgccgtcatacaacatcatccaatggtacaggccgtgatggggagcgctcttgatggggattcttgtggccagtagatatgccatactcttctgttaaaataccttccgactcttttatgtcattcagagctctcttggcgtacaccgtgaaggcgaccgtgaggacaacagcgatgacgaacgagatggcgttgtatgttatctccaccggtgtcatcttgtagttgccatacttcatgtcagccaatgtgcgtatcaaccgcccgctgcaccaaaacatagaaagatgaacaatcaaaagcgcatcactgaacaccatacctagtgcacttagtaactcctgaaagaaaattgcatgtgtcggtgacctgcattagttgattaactgcaagtgtatacactactgaattgctaaagttattgtaaagatagttatcctgcacagataacttttcctatataatataaatttactcttttataataagttatcaatcacaaaccttctgacatgttttcatgtatatatagcttgcaaaactagtatatccaataccgttttactggtgagcttatgcttgaaagagcgattcattaaaaatcagtgactaggtgcactattgttgacaacatgataaataaacagcaatggaatacagtgagtgaggacatataggtagcaaaattggatgtctgcagattggagaggtatgtaaccaacctataaatatagatgaacgcctcgggtatcatcccagcaattgaaccacatagataagggttgaacttgatttctgtcacagttacagcgtagttaaaaattgtatatggaaatggcgagattctgaatagtgcaacaactctaaactgctggaaccaatttccttccccagcaagttttattagagctatctgctgaggccatctttttaaccatgcctgcattaaaaaatgtagagggaagaagagagcagaaaattagggcaaagctccttcaaaaaagatgcaggtcctaaaatagacatcacaagaacatgcagttcagaatttttacatgcagacgttcgcggaacaatgagccaatccaatatggaaccaccatgcctatagtagtcccaaccataataatcaagaaaccccaaccatagccaaagatcattccagctagccacatggaaggtccagaagggactaaagtaactgggaagagggctaaagatgcaacgagaacaacagccaaaactggacgcccaaaggcacttgcttcccattgcatgattggcaagagaacctacaacaaacagatcttccaacataagtccaaacaattttctggaaaatgaatatgattaaaatgttactcctatctggcacaacatggtacaaaaacaagagataattgaaaattttgtaaacttgaaattaaattgcattgtgacagccgtgcatccattaaccatacattcatctagcattccaactggtgtgcataaactagggtatacatgggaacatatggactagtcaaactatcaatcaacagtttgaaatttcataagcagaaacctccactaatgcatggtagtggaggtttcataagcagaaacctctgccgacaaaccataaaaagaactcaagtcaagatttcagtacttggtcaacctatgaacctatgacaaatattacccttgatgctcaccttctcgaaggcaaaggggactccccatttcacgaagacataagatactaatataagaaggaagcagccaagcagaactttcatccaccaaatggaccttgaggtaggttcttcaggtaggactaccgtgttatcatcagctattacactatgagctggtctgaccagcctttcatattcatcatcctttgtgttttgctcaggttgttcgattccgttgcctgatgccactgcggaagagcttggcatgtctgtaactacctcttcacgtctgtttacaaaccaagcagattagaataagaagttactcaaaacatgtaacaaattttatcaatttatctcattgaagtaaagatgccatgtgcttgttttgttttgtgtactggaaaagcatggaaattagttgtatggattaaatctaaccaagatgtgcaacaaaaattaatctgatatgctcacattcacaagcatggctcatatctttgtcatttgatctcacattctgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcatggtatcagagccgaccggccggcggcaggcgacggctgaaccctagctggccggaggcgtggaggcttgagcagggtagagagtgcgcatcagcagcggcgcggaagagcggggccagcgcggcgcgtcgaggaggaagaagccgagcagctgcaggtgcggagctgctgctgctgcttggggctgagctcgcaggtgcagagctgctttgggctgaggcaagaaagaaagtgctggtaaacagctggtgttggtgctcctcaggaagaagtggctcttgctctgtagtggcggggtcacagcacagtgaagactttgcatctcttgtgggtgtgtgattggcaaggaaaccgagataaaagcacagctactgcttttgtgatattgactatttgagcaatctataggaagggaaaggtagaacagggggctcagatctgctagttgggtttctactggtttgcagtttcagaatttgcattatggcagaaaatcaaggaatagaacaagtgatgggtaaattggtggacatgctagcgaaaaaatttagtgaggcctcaactacaagcaatgcaattatccctcatactgaatcaatactgaagattgagttaatgcaaaacgaaatcaagttggagggtgtcaaaaattatttgagttggtcaaggagggcattactaatactaaaaacaaaggggttagaaggatatgtcacaggagaagtgaaggagcctgagaacacatcaagtgtagaatggaagacttggagcactaccaactctttagtggtggcatggttgttgacttcattaatcccagctattgctacaactgttgagactatctctagtgcgagtgagatgtggaaaactcttactaaactatactcaggagaaggtaatgtgatgctaatggtggaggcacaagagaagataagtgctttgagacagggggagcgctctgtggcagaatatgtcgcagagttgaagagtttgtggtccgatttagatcattatgatcctcttggattagagcactctgattgcatagcaaaaatgaaaaaatgggttgagcgtagaagggttattgagttcttgaagggtctaaatccagagttcgaaggaagaagagatgcaatgtttcaccaaaccactcttcctaccttagatgaggccattgcagctatggcacaggaggagcttaagaagaaagtattgcctagtgccgcaccatgttcaccaagtcccacctatgcaattgtacaaggtaaagagactagagagtgcttcaattgtggtgaaatgggacaccttatgcgtgattgtcatgctccacgcaagcctacttatgggagaggaagaggtgttgatagaggtggaacaagaggtggaagaggctatgctggtaggagcaatagaggaagaggttatggatatagaggtgattacaaggctaatgcagttactctagaagagggttcttccgggactacacctgacaatgttgccaactttgctcattctacttcaggtagttttaatcaagcatttatgtctatgaacacttctcattcaagttggatattagactcaggtgcatccaggcatgtcactggcatgagtggagaatttacatcatataaaccatattcatttgcacataaagagaccattcaaactgctgatggcacatcatgtcaggttaagggggagggcatagtgcaatgtactccatccattactttgtcatcagtgttatatgtccattcttttccagtgaatttaatttcaataagttctcttgttgataatatggattgtcgggtttcccttgatcgtgagaattgtttaattcaggagagaagaacagggaagaaacttgggattggtatcaggcgtgatggactttggtacttggacagaagagggacaaatgaggatgtgtgtgcactaatggcttcaacaagtaaagaagtgactgaggtattacttttgcattgtcgactaggacatatatcttttgaaattatgagtaaaatgttcccggtagagtttagtaaagtggataaacatatgctgatatgtgatgcatgtgagtatgggaagcatactacaacatcatatgtgagtagaggacttcgcagtattttgccctttatgctaatccactcaaatgtgtggacgtcgcctgtggtttctatgagtggaatgaaatattttgtcacctttattgattgctattcccgcatgacatggttatatctcatgagacataaggatgaagtgcttaaatgcttccaaaacttttatgcatatattaaaaatcattttaatgctcgggttcagtttattagaactgataatggaggggagtatatgaatagtgaattcggtcactttctttctttggaaggaatattacatcagacttcttgtcctgatactcctccacagaatggagtggctgaaagaaaaaatcgccatcttttggagatagctcggtcactaatgtatactatgaatgtacctaaatttctatggagtgaggcagtaatgacggcagcttatctcatcaaccgcacaccatcaagaatacttggaatgaagacaccatatgagatgatatttgggaagaatgaatttgtggttccaccgagggtgtttggctgcacttgttttgttagagatcatagaccatctattgggaaacttgatcctcgagctgttaaatgcatctttataggctattcatccagccagaaggggtataagtgttggagtccatcagaacggcggacatttgtaagtatggatgttacgtttagggaatctgttccattctatggtgagaaaacagatataagctctttatttgttgatcttgatgatttaactagaggtgaccatgatcaacaaaaggaaggtgaaatcttgggtctcaaggagaatgaacaatcaaagggaaagattgtggttggtgaaattccatgtgctataggtgatcctgtacaagaacaagaatggagaaagccacatgaagaggaaaatcttcaagtttacacaaggagaatgagacttccaacaactcaacaagttgaagttgatgatcaagtatcagatgatcttactcatgtgcaagtgtcttcggagtcagggggagaacaaatagaaattagagaagaagaatcaaacttgccaattgccataagaaaggggatgagaagcaatgcaggcaaacctccacaaagatatggttttgaaattggagatgaaagtggtgatgagaatgatatagccaattatgtatcttacacttccttgtcatcgacatacagggcctttgtggcatctctaaattcagctataattcctaaggattggaaagaggcaaagcaagacccaaggtggcatcaagcaatgctagatgaactagaagctcttgagaagaacaaaacatgggatcttgtatcctatcccaatggaaagaaagtggtaaactgtaagtgggtatatgcagtgaaacaaaatccggatggaaaagtggagaggtacaaagcaagacttgtggctaagggatatagccagacatatggaattgattatgatgaaacgtttgcaccggttgcaaaaatgagtacggtaagaactataatatcttgtgcagttaactttgattggccattacatcaattggatgtcaagaatgcttttctacatggcgatcttcaagaggaggtatatatggaaattccacctggatttgctactttgcaaactaaaggtaaagtattgagactgaagaaatccttatatggtctcaaacagtcgccaagagcatggtttgatcgatttaggcgtgcaatgtgtgctatgggctataaacaatgtaatggagatcacacagttttctatcatcatagtggagatcatataaccattcttgctgtttatgttgatgatatgattatcactggaaatgattgctcggagataactaggctgaaacaaaatctaagcaaagaatttgaagttaaggacctaggccagttgaaatattttctgggtattgaaattgcaagatctcctagagggatagttctttcacagcgaaaatatgcattggacttgctcagtgacacaggtatgcttggatgtcgcccagcctctacaccagttgatcaaaatcataagttatgtgcagagtctggaaatccagtgaataaggaaagataccaaaggctggttgggagactgatatatttatgtcatacacgacctgacataacttatgctgtcagtatggtgagtcgatatatgcatgatccaaggagtgggcatatggatcctgtctataggatcttgagatatttgaaagaaagcccaggtaaaggcctatggtttaagaaaaatggacacttggaggttgaaggctattgtgatgcagattgggcaagttgtcctgatgatagaagatcaacttcaggctattgtgtgtttgttggtggcaatctagtatcttggaggagcaagaagcaaccggtggtgtctcgctcaaccgctgaggcagaatatcgggcaatgtcagtgagtttgagtgagttgttatggctaacgaatcttctttctgagttgatgttgccggtggatactccaatgaaattgtggtgtgacaacaagtcagcaatcagcattgctaacaacccagttcaacatgatcgaacaaagcatgtggagttggatcgtttctttatcaaggaaaaactggatgagggagttttggaattagaatttgtaatgtctggtggacaagttgctgattgtttcacaaagggtttatgtgttaaagagtgtaatagttcatgtgacaagatgggtatgatagatatctatcacccatcttgagggggagtgttgggctgtaaatacaacagtatgtgtgtgttttatgtgctggcccatctgctagagggcccatctagtcatgtatatgtaaataaggatagcaatacagagaaggtgaagcttccagagaaaattggctgccaaaaaacttcacattctaggccatgataatctacatggcttttccatacagaacctggtaaaatgaggacgacgataaaatgaagtgctagatttcatgaccgaacagagaatgtacatcgatctatagctcaatcaatagatgccatcggggtgctacatttggacaataaagtgcagtaatccctaaaactaatgcaataactgcatatctattctactgaaatacaggtcatctttctcacaccacagcaatgtggcatgaactagacaaaacatttgacatgtgacaatccttgatctaaaatttgaataaccaggtcaaatgttccagttcgtatttttctatttgtttaacacaatacaacaagtatacttaatttacatatctagtcaaactgccagcggccaatttcttcccagtttatctgcagtactcaacaccctacaacattggtttcgtaaagagcaacagacagcactcaatcatgacactccatctttccatgcgaaatactgctataactagaatttcagatatgggtttaagctgtaacagtaaaaaaaaccgatgttataaacatggttaagcaagatttcccaaaatagctcccgcttgagttgcaacgattttgaaagaatcccaaatggatcactccatgctcgctgcccttcttgctcgttcatgtgccacattggcctccaaaaaacggggcgtaggtgaagaaacagttaacaacaccccgtgagtcttgtgtccgtgtccgtgcatggtactgctgcgaggggaacattaacccgtgcccattacacattacagcgcccgtgaccaaaaggttaatgggctctctaatggcggattagcggcaacgaagaacaaagtgcacgccacagcacgcataaatgccacttttggtttcctcttggagtacggaaaattgaaaagaccgaataagcccaaaccacacgccatgacgcaatgctattgcactttggtgggagaacgcaancgacctcgaggcttaaaaccaacaaccacacccgcaatctttggcatacaaaaattcttcaaaattttggccgacaaaaattctattttgatttgtaaaagacagataacaaaggaagcctccaacaaacccacctggatgcatcgtcggttccactaaac

SEQ ID NO: 18533 - DNA, 28843 bp, Oryza sativa
  unsure (1)..(28843): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctctaatggcggataagcggcaacgaagaacaaagtgcacgccacagcacgcataaatgccacttttgttttcctcttggagtacggaaaattgaaagaaccgaataagcccaaaccacacgccatgacgcaatgctattgcactttggtgggagaacgcaaccgacctcgaggcttaaaaccaacaaccacacccgcaatctttggcatacaaaaaattctccaaaattttcggccgacaaaaattctattttgaatttgtaaaagaacagattaacaagaagcctcccaaacaaaccaccttggatgcatcgtcggctccaactaaacccaaactccttttttctcctactaagaaaatcgccaacacaccaccaaacttcccctttttttcgaaggaaaaaaataactccaacaatctgaacgcgatgaacaagcaaacaaacagattgcagcgagagctcggggaaggaagaatacctgggcatggccatctcccccgcctcgatgctgagggggaggacgcgtgccatggagagacgaataccaaagagagacgcgtggtttgcctttgcctttggcttttccacctcctttctcctcccctttctttctggaagctttgcagcagcggaggggggaggagagacgaaagcagcagcagcagccgcgcggcgcacacgaaacgagagagaaaaacaaaaggcggtagtagtagcagccgcggacccggcgaatttaccgggatgcccctgggtggaggcgaggtgggcgcgacgccgtgagtgaggcggacggaagacggaactggccctgctcgcacgcccgggggaagggggaatattcgtcggcgcgcgcgggggcgtggagtcgctgacgaggtgggcccaccggcgggggggcgggggtcgaggtctcggtctcggtgcgttgccgcgtggtgacgcgtgtcggggggtggctgccgggtggggcccggccgggattgcttccgtgtgggttgtggttggttgctgggtagttgcgcggttgctgctcctgctagtactggtcagggttcataatttccacgaaaactgatggagttttacgaaatttggatacagcttgaaattaagtttcgattaaaattttaaaagttaaacagtatatttggtcgaatttcagttgaaatttatcaaaaaccgattaaaatttatcaaaaatcgtgatatcaataggactcgaaatttagtagtcagtcggtaatgttaatgtaaatcctggtactagtttccccatacttcgaagggaagcagagtagttaaatatggagtcaagttaattaatgggtcgtcattttgtcttggtcaaaccatgctagctgctgctgttgtcgtcgttaaggttttgctttgagaattcttcgcttctagagcagcaagatgtgttgttggacggcttctagaattgacctgatcattttggctggattgctgcttggttttattctaaagtaaaagtgtatgcatggctaggggttgacttttgttaaccatgatgtatggggtgattatactagtggtatagtgggccgtgcttatggtgctcttaaagccacagtagtgcaggatacgccctaaaacctttagcgaggtgtcacgtgctacgtaggccaagacactgaagtctggtttagtttccaaaatttttttcccaaaacatcaaattgaatctttggacacatgcatgaagtattaaatatagattaaaaaattaattgcacagttaggagggaaatcgtgagataaatcttttcagtctaattagtccataattagctgtaagtgctacagcaacccacatatgctaatgatggattaattaggttcaaaagattcgtctcgcggtttacatgcgagttatgaaattattttttcattcatgtccgaaaatcccttccaacatccggtcaaacgtatgatgtgacactcaaaaattttatttttgcgaactaaacacaccttgaatggacacaggtttcatgttgtatgtggtctcaagggtctatacataggctccacaacaaatctcatgtcacggtctatctctgatgagctcaggaacacgtacctcagctcctcacatagagttaggggtgggcagaataagaccgaaccgatgagccgaaccgaaaagactaagaccgagatcgagaaatttggttagtagttcggtctcagccatcgaaagaccggatttttttggtaattcggttataggcttcggttaaccgaattaaccgagaaaaccgaattgtggcccaataggcctaggaagcccaataaacccagtacatacagcaaaccctagaggaggacagccgagtaaagtcaagcacgccctcaccgcctcacatccatcgcgctgcctccaaaccaatccccaccctagcgcaccgtcacgcctccacctcgcgtttcctccgacccccgcctcgtgtcgcctccgccctccgcctccagcgccggcgccaccttcgcctgggggccgcgccgccacctccgccctccgcctccagcgacctgcgttggcgccgcctccgcctccatcgcgccttttatttgtgacttgtgagctctagtgttgtattgtcaactgttgctgttgtgaagtttagacttgagacctatcttgtgatatattttttggtgtttgatgttgcctattatttggtatttttgtgatatatatgactgtgataaaatgtctgaaaagaggggaagtgctgtcaatttttttcatttcaaacttatctcctgaaaattcggtcagaccgagaccgaatttgccggtcctgagtttccaaagaccgaactaaccgaaaaaccgaagaccgagaccgaattttttagtctaaccaaacgcccacccctacatggagtacaccgagcgcaaatatggaggatgaacaacacatcaacacaatttctgttgtggatggtctcattgtaataagagaacatttttatttatccacatgtctggttatgatatgcagtgaatgatatattgtgcttcacttattaaaaatgaagtatataaatccacaagtaaatagaaatattatttatccataaagatattccatttgtgcataattctgcacacatgattggcactgatgtggatggttttctaatagtaactcattgtttttcatttcatcgttgagcaaaacgcataggtaggagttaacatttcttaaccttaacataagttaaaatcaaacgcggcgataaattcaaacaaataggatcataaaaaaattgtggcgaacaaactatggttttctttagtttatttttctttttaatgttaatcttcctccacacaaaccatcacatctacctcactcttttgtatttttcaatctgttctacttcaaccatttgttcaattggtggtgtataggtttatcggattgaacttttagcatttgagccaaaccatatcatatggaaggtatcatatggcatgttcgattgctttcgctggccttgtgctcatatcttgggtacacagagcgatttgtttggttacgtggttatgcgctccacctaaatagaatatgtataaaatgcatcccggtcctaaacgagagttgtgagctttgctgtgagatagggatggataatgcaggcagacagctttccctacgcacatatttgtgtagcctcgtactcacgctcacgatctttatcaatagaatcactatttcacactcgacaacaacttcatttgtagatatttttaaggtctcatcccctttattttaagtatatgccatcaaaatatggtacttttaggtactactatcctacctttaaatgctatttcaaaaattaaactaatggtcatcaaatgcatggtcatgcgaggactgattactggaggcaggggcataagagtagtttacaattaattacgcaaactccgttttgagttccaactttgaacggtagagacagaacgaaaattttgattcaaactcgatggctgctggacagctggaaattcaaaacaccccacacgcgtccgcccactgtccttttggacccagatcgcagcgaagaagcggactaagcggtccagacccggttcaactgtccgccaatgaaccgggttcatcccgaccgcccgacccggcccgctgccttgagtcggaggcggcggcggcgaattcgttccgatttggggaaaaaaaaaataaaaaattcgaaccaaacctatccaaaatccccatctcgccaccatctgcaaactcgccgccggccaccccgccgtcgacgaaccccacccaaacctcgccggggaaccagtccaagctccgtccaaccatgcggaagaacttccgcaagcggaacctcgaggcggacgccgccgccgaccactccgacgacgacgacgcccgccggtacccctcccctctccccgctcccgccgccgcgcctctcgcttgggttttggtagggatctctcgctgactgacgcctctctccctctccccccctcgcagcgtcgccctggaggagatcaagtacatgcagaagctccgggagaggaagctgggcatccccgccgccgccgccgcagcgggcgcgtcgtcagcggcttctgccgacggggcctccccccgcggaagaggcggcggcggaggtgggttagcggccggaggggatgccgagaaggaggacctcgtcctccaggacaccttcgcgcaggagaccgccgtcaccatcgaggatcccaacatgtgcgtttttaacttcgcgtgtgattgttcttgccaatctgttgttttcattcatctttgatgatgcggaattgaagcggagcgtatgtgcgtgcgtgggtctgatgtttgaaggctgaggtatgtggagaacgagctgttgaagaagaggggcaagaaggttgatgtgaaggacaaggaggagaaagaccaggtcgatgagctctacactgtgccagaccacctcaaggttggtagccgaacagagcttcgatgcactcctgaaaggatatttcatggttttgatatgtgtgcattgtaatgatggtgccaatcaattttttgcttataggttaggaagaagaactcggaagagagctcaacgcagtggaccactggcattgctgaagttcagctgcctattgagtaagttcttgtgccccttcgtttgttcttgtttataaaaggttcatttgttcatgtttataaaaggttgttaaggtagtcttccatattatgttgtaattcaaaggggaaggtgcccaaaatactgcaatgcatcataaggagatgtgcatatgggcttgttaataaggatatttattaattgactagctgaatgcctgtgcattgcaacagaattttggaaaagaagaaattcattatacacattttaaataccctaaacaaatttgccacattatttttctctaatcatctagatagatgctttcgccatcaccttcacacgggaatttagaagacacatgttactacgccctaacaacaagtagcccacctatcagggagtgggtggtggtgggcggcaaattcaccactcagcaccaccattggagtcttttaaaatggtatagataactgaacctacaaaactccctacaagtatgcactggtcttatggacatctctggttgtacttctattaaaaaagtacaacttttcttctatcatacatgggaatgatgtgataatccaattgagactttttaggacagcatgatagttagataagataaatggtccagtgggatggacaaacctgtaactgttattttcaatctaaagttctaaactgatctatgcatacaatggtgtgctcgaattataattcctgatttcgaaggtctctgaagggtcaacaactcaacattgtactgtcagcattgtgggttcaatataacctaaaaggttcctgttcctcgttaatattctcaaggttcttggtgctatatatgtatattaatctattattctggtactagagtcatgcactcatgcgtttctttagaactgggcctgcagctatatacagattcatgttaccatcttcttgattgttgcaggtacaaattaagaaacattgaagagaccgaggcagctaaaaagatgctacaagagaaaaggcttgccggtaaaacaaaatcagatgctaacattccgtcgagctataatgctgactttttccatcgcggaaaagattacaccgaaaagttgagaagaggtttgtacatatacctttcagttttcaggttatcataactagttttacacttgtagtgtcatcaccagaaactatcgagtcttaagtctatctgatattgtaaggcacataatgctcccagaggagtttaccagtctaataaacagaaacgccttcaaaaagtactatatgtttctaattgtggtttctaggaacgaataatttgtaaaagtacaactttttttaattttatatttacctcgcacataaagttaaataacaggtcaagtctatcagaaatgtagaattgtagacaggcataaattttgtcactagtacactgccgtagtgctgcaccagttcttcaaataaatatatattctattttttatttaaaaagccaaaacaactatcttccaatctaaaactaagtaaaacatgttttcttgtaatctacatatgcacatgtgtaaacgatgaaattggttaaaaaaggatcatgcaaatgagtaattcatatgcataaatacatggatgatcaatgtaaagcacacgaacaccattatcgattcctcttttttttttcatgagtaagagagagatgcaaggtatgcgcacaccagtcttatcagatgccagctttatgtaacaactgatgattggcacttgatctaagccatgaacagagctttcgaatgataatttgcatatcagatattcctcttgattcacttcaatcacctgggcctgctgccagcttttgaccagttgcagagcaacacttcaatcacaacaacttattttcagttttagcataccgaatataactttattcttaagatatccctttttattaagaacaatttgctatataaagaaaacagaggtacccaatggacctacagcagaagtattcaggttttatataagagttttgatcttcagctgtctttaatacagatcaattgttcccctcaatagacctgaattttaaattaacattgaaggaatccactaatcgttacataatacaaattgcaaatagcctgtgaaacaatctatgctgcatcaaaatccacgaatatgggaaatgtgatggtagcaataccatttttgaacttctgttttagaaacaatagctgtggcatatcattgatataatttatcgtttaagtgctaaactgttccattttccttgcagagcatcctgaactgtacaaagatcaaggttcacaggctaatggaactggaggtaaatcaatgggtggtaaccatccagatggtgctggtgcagggcggagagaagctgctactgatgagttgttgcttgagcgtttccgcaagcgtgaaaaattccgtgtcatgcgcagataacatgaaatggaataggatgctaacttatgctatttcctttaaagggcaagcgtgtcagtgtgaccacatgatggccctctatacatcggttgattttggcttttgcttctaaagccagtgtccatggctcatcatgttataggcgtatcttcgaagcatttgggaaaattggacaggtcttcatgaaactgatcaatattgttctgtactgagcagcaatccaggatctcgtttctctcttttctttaaaactgctggttcaaccatggataaattgccaatgatctcagatatgcctttccatcccgatcctgaggcttaccttccatgcttatcatttctgctgcttacacaaccaccttgcggcttgcaccttattactgaaaatttcctggatataagcaagcactggcaatgtaccttatgttatattttcatcagaaacactcagctttgttgatgttgcccttctgaaacaaggaaaagctgtcagtaaagaagttgttaatttctgctccgtgcattgatgtgaccttgcataattttttgagccatcatttgtttggtacattatgattatcgctgtattaatgttgaccggctattttgcatctataactggattggatggcgtaatgcttgtagtgtgcaagctgttagtacatatgttaggttaagagaatgtgggtttgtcacagttcagaaatattatgtcattttagcatggttgcatgtcgtatttgagaccgtactgaagttgagttggtgaatcatccattctgtaatctcaacctgtgtactgaggctgtttatttggaaatattgtgcatgctcatactgggtgagtcttctgcccctcggattgatgagattttggtccatgtgtaccttttcagccgtctgattttctgctcaatgtttcgattttctgctcaaaaggctttctggaaattttttccattgcttgttggaatatttggaagcagagaaatgccttcatttttcagagtgtggatccacatccttctgattggttggttaagttcaagcatgaaattcgatttcatagttgtaggatgaaagaacctctcttatcttcggttattagagattgtttagatcccaaaaaattttggccaaaaacgtcacatcaaatgtttggacatatgcatggggcattaaatgtagggaaaaaacaatttcacaagtttgtatgtaaattgcgagatgaaccttttgagcttaattacgtcatgatttgacaatgtgatgttacagtaaacatttgctaatgacggattaattaggcttaataaattcatctcgcagtttacaagcggaatctgtaatttgttttgttattagtctacgtttaatacttcaaatgtgtgttcatatacttcaaaaactttacacccaaagaattaaacacacccttaagggtgtgttctctattcccggctgggaacttggaaaattaaacacacccttaagggtgtgttctctattcccggctgggaacttggaatagtacgtacggaaaacggaacggtccattagcgcgtgactaattaagtattagttttttttttcaaaaatggattaatttgatttttttaagcaactttcatatagaaattttttgcaaaaaaagtatcgtttggcagtttgaaatgcgtgcgagtggaaaacgagggagatgggttggaaaaagggagtgccgaacacaccctaattagttggttgcaagctttgtaatcatggattttttgtaaattctgtatatctttacctattataaaagttcaaggtgtttttgccagaattttggtacgtcatccgtgtttgaaacgattttagttttatgttttgattttaatctatacctctacttaaaaaattcccgtcttatatacataaaaaaagaaagaaaagtccgaatcaaaaaggtaaataaagaaagaaaagaaagtccgacttaacgagctattaaaaaaaaagcttccgtcgtcgttagtaaaaaaaaaatatctcttgtctgactctatagagaaaggaaaaaaatctcccagtaaaaaacaaaaaatctgtttgattttgttggcaccggtattttttttccttttttctttgcacgcagagttttttttccttttttctttgcacgtagaagagttttttatgcggctaaagcttttgtttttttttatctttttttaatccgatctattcaccgtgcatctcttgggtgcttatagttttttcgtcaatattttttgtcaccggttttttctcccgtgtgctttttgtttgtctcatccggttttataatcccatctattcgctgcacacctcccgaggtgaaccctagcgccacgctgctgccatatcgatagtgtgttttctcctccaatttaattataaaaatcgattccctactcctctctcaccattttctcaatgatttccccttcgatttagctttaattgctggatttaatctctgttctaaagttgccgattttgacggcgatcttccccggtcatttttatcccgaattttacgctctgattttggggaaaacggaaagagtagatcgagtggatcaaaaaccttgaacaattttggttacccaagaaagattcggccggatttgatggggagatttgctttggcaaacgtacgggcacgagattatcttcgggcacgggattatcttcgggagtcttcgggaggttgaagatggtagtcatattcggaaagttaaagatggtagggtcaaagagaagcagaccaaatggagggaggtagcgggctagcctagggctgaaaaggaaggaagtcttttggctaaaaacctaggaaatattttcattaatttttttaattataatctatagcgatcccaatgttaagatttttattaacttttttaattatagtgtatagtgatcccaatatttcaatttattacttagctcttgatatatcactgtaaaaagtctttacccgttgcaacgtacgggtatcttttctagtattaatataatttaaactactgggcgaaccccggtagtctttctctctcttaaaaaaaaagatgatgaaaacaaaaatccgcaaaattttgtttctgccatttgctgcgcaatccaaaattcgttacgcaccaaatcaacacgatggaacaaaactgtaaaatgttggaacaaaaatggaagctagaggcggtagcaacactggccccaggcgtgcagcgaccgggagcgcgagagcacgcgcgacgccgccccgaagctcacctcgtgcggcaatggcaggacgccgtgctcgtgcctcaccatcgacacgtgcaccttgccggcgaccgaccgggcgacgtcgttggcgccccgccacctccctcgccggaggctgtacgcgttcacctggccgcgggtgtggacgaacaccttgtcaccctcctcctccgcgccttgcaccgcctccacttgcttcaacgccggccacaggttgcgccgccagcgccacccgcgctcgtccctgagcaggtcgatcctcctcttgagctgccagctccggcggtggtcgccgtggtagtcgtcgagcacccacatgctcaccgtcgtgccgcgatcctccacggcgaagacgcacagcttcccggcggcggcgggcagcacgctgatccgcgccgtctctaggtccatcgccgccatgcgctccggcgtctccttcagccggagcttctcccgggacatgtcgaacgccaggagcttcagcttccggacggccggccagcggccgcccgactgcaccagccagtggagcttgccgtgcagggcggcggagcgagcggcggcgtgtcccgtcgtcgccatggtgatcttgggtggcggcgcggggcccacgcgccaggcggcgtcgccgatcgtctggacccggaagacggccggcgccagctgcttccggtagtagtagtggccgacggtcttgccggaggcgtgcaggatgtgaaagcgccccgtcgccgggtgcgcgtaggcgccgacgaactgtcggcggcggccggcgcggagacggtggcgcaggcgttggtgagagggttccagagcacgtacacgtcggcgccctggccacccgtcgtcatggccatgcacagcacgccgtcccatgagccgagcaccagcgacgagatgctgtacttgtccgtcgtcgccgcggcgccgagcgagaggacgcgccggtacgncggcacggccgcgccgtcgacgttccagtggctgcggaacaactcgaaccggacgatggtgtcgccggcgcgggtagtgttgatcttcacggtgacctttgcggcgacaggccgtgcccgtgggacgtaggcgcggtagaattccggccggaaggtgaggcggcgccaggccttgcacgcggcgcggcagccggtgacgatgctgcgcggcggcaagcgagagatgatcttctcgacgatgtcgtccggcagctcggcggcggcggcggcggacatggtcgttggagttggaaaataatcgattgaagaggaaaatagatcaattaacgcacatatctagggcagctagggctggcctgcctccgaagcttaaattttgttgattcaccatgtatatttttcaaaaaactaatactactccattagtcaaggtctatcttagcttagtcttgtataatttctactccgccactgcatatcatgtttacgtcagattttgttttacttatccatcgaataagtaaaaatcctagttgacagtttcagccgttggatgcggccatgtaggcaatttttttttaacgctaagctagatataagggcatagacattaaacataaaaaggaaacgtatatttggttataggcttatagccatcctgccctattttattccgctaactcctccggtccaggactgctatacgaaagatattttttaaaataaaaattactcaaatgtaattataatgcaattaaactgtaattataatgtgattacagtgtaccataattataattacaatgtaattacaatgatacattatatttacactataattatattgttcgtgtgcttattaaaacaaaatcgatacctacctcatctggtaatggctgcattgcatgttctccaccatgagatcctggatcattctcaccccttatgctagccattcttttttttttccaccagctaatacgtgaatcattgggattgctatacacaaatggagctgcacgcccacttgtattggatcaaactaaatggacgggcatgacggcctatatatatatatatgcaatgggaccttaaaaaggctagtacatgaattattaggatcactatacacaagtgaagccacacgcccacttatactggatcaaacaaatggacggcctacatatatgcaagggtaccttaaaaagactagaggggtgaattgtgtgatttttgtatatatttcgaggatgctacgtctctgtcaaaggctcctgatcagttatcggttgccagctgatgcggattggggagttccatgcaagcctatagcacaacattgacatggcatagttgaccgggaacctatcctatgcacacaaactttccatgcacagtactccgtgcacgtacaccaactagcaaatattacagaaaattcaaaaaaaaaatggacacatacttacaatagtattacatctacacgtgaaatcttatcttcaaattcattatattttagctgtaacaaaaaaagataaaattctgatagatttttaccctttaaactgtcagatttttcacttttttgctacggccaaatataatgaatttgaatatggaacttggcagataagtgtagtacaattaggagtaaatgtctaatttttttatagaattttttgtgatattttgctagttagtgtgtacgggaagtttgtgtgcgtaggatatgttcccctctatagttttgtttcagtgtttatgacactgactgcaacggggaggtgtcatactgtcatttgatgatatcttgagcatcttgcgagatctgactggttcttctctgactgagcagcagagagccataagaatttgtataattgcacgtaattgtagtttgtagattattgctcatgttgttacaactacatgctgcggctaaaatgggtacctcacatgtcgctctgatcaagctgatagttatgaagtggtcataaactgttgaacgaccctaaatgccatgcgctggactacttttttttttccatgatcacattgttagtcttgctggctggagtaattgttggaatcaatagagattaatttctacctgcgagtcttttttttttcatgaacgcgcgaaaaaattgcacatcagtatattaaaaaaaatagagttttagttacacaacgcaatcgaccagaccggtcgttgccgggtataaggaaaaggactgcgagaacgagaaaaaaaaggaaaaagagtaatagtaatagtaatgtatttttggtggggctaacactcgtggagaagtgatcttttcccgtggcacccaaagtcataattgtcccgattagattaagaaccgatactaaagatgcttcaaggcccttgaaacatttttagtccgggtttaccaaccgggactaaaaattgttctttagtcccgattggtactaagacaaatttttagtccaagttggtgttatcaactgggactaaaaatacctctaggattagttcaaaaggaaaacatctttattcaagttagatgtgtgtagtgtgtacaaggtgggatggttacgcgcgtgagggatcttgagttcgaatcccacatcccatatatatattttatttgctatgtaactttagtacaagttttctgtagttccgatttactcgtcctgttgctataaccaggagtaaaaaccgtttctccaacagtatacactactacaaaaaccatttttcgtggcggccattttgggttttcgctgacggaaattggagccgccacaaagcaaaggccagtgaaaatcaatgattttcgctggcggttacgatctgtttgcaacaatagatttttcccttgtggacaattaggaggaccgccagcgaaaatctatttgcgcaagcggctaattaggtggactgccagcaaaaatctatttgtgcaggcggcaccactaagaggatcaccagcgatatctttttgcaaaaacaataaaaataataattcacattcagaagaagcattgttgcattttcaaatttcaaatccacatcaggagatcatattcaaatccaatccagattcacatcaatatccaagatcactacatcgatttctcagtattttcaacatgcaaacatcaacacattgaaatgaaaataacatgcaatcatcaacacgtcgtcatcgttggcgaccttgttgctattgccaccaccgaagcaactgtcgccgtctccctatggcaagagggaggagacccgggaggggagggagggcgtcgccgtccctaaccatcttgccaccggatccgcacccgtcgccatcgccatcgccgccacgaccgccgttgtctggaggggaggggaaggcaaggtcgccaccgctggatctgagagaggaagggaaggggaaagtagggtggccgccaccggatctgagagagggagagcagggtcgctaactcaccgtggccctctcgctacccaatccgccgtccgtgcccgtcccgcggccggatatgccgcctgcggccctgcagcggccggatccaccactagctcctgtgccctgcgcagtccgccggggtcgccgccgtcgccgtcgctggtccgccgttgtcacgcgcccgtctcgcggccggatccatcgtctgcgaccctgcagtagtcggatccaccgttcccgcgcccatctcgggcggggattcatagcccgagcccctcgcaggccgtcgtggtcactgtcgtctccgtcgccgatccgccgaggtcacgccgatcgatgccgagaggaggaggagaaggtgtggacgccgagagtaggaggagaagctttggcctgtggaaggagaggttggggaaggtaggggaaaggtgggagatgaggaggaagtgaggtgagaggagaagataagatcgtcggtgggagtggaaagagataacatccgtgcgattttaatatagggaatttcttttcgcagtcggtgcttgttggcggctgttaaatgctgattctataccgccaacatctgcctaaagttcagataataaaacatccaatatagtgataggtgcttaatcttacatattccatagtgttggtgtatatttgtatgcaggtgataaaccccaatgttgggaggaaatctagactaaagggagaagaaacatgtatctatacaaggaggggttgtgaacttcatcaaaatatcagtaaatcaacccaaaactccgagaaatggatagaggaaggtccagggagtccaccgaccgaaagccaggccaggagggcccagctcaggttcggccgaacccccctgatcaccgttgatcctggggtttggcgtggtggcgctccagatgaattcccaatgacggttgcggggcagttcgaacatttccccttctcagaaccgtcataacttacctataaaaggacctcacttcattcactctcacacacacttccaagcttgagctgaattataagaggctctattgtactatattgtatactagaataggaagagagtagagtagaagaagttggaagaattccggagctgtcggtaatcttctcctatttcttttattctgtttattactttgaattcaatataatattcttcttgagtaatttagatttatcttgtgagaattatctcttggttagttcctaaatagcatacgggattattgttcactataatcaactaaaatatagtgattgctttggtgagttataaacactaaagtagatagtaattgcttagacgtggtgtttaggtaattgttatctagtaattgctgcatatcccatagtatgtttgaggtaggtgtagaggtggttacagccctcgagatcacttaagtcctccctgtccgggtacgtagtagagcaacatctgggaacaacgggttgccttggtcttcctcttcctaccggcatcggctggttctcttatttgcccttggagtaggcttgaggtcctgggggcataacagccgatgacagggggagctagaccacctccatttagtagaaggcctggagcatattctatgtctttgccgctattgcttttgcgatgaggagaggattctattgtctgcaagacagaagaagaggttagtcaaaatacaaatcggctgacagtcattttacatgattgacaaagtaaggatttacctgagggataacatctgggaatagatctgtcatgtacatggaagccgattggtggaacaagtgctgcttccattcaccccaccatttgtcaaagttcgtgctcctgaaccttgctagttctacattatcgatgctgcccaaagggggtcctgggatgttgagcagtcgatccatcatcaatgttgatgagattttgcctctgcattgaattttatcggcaaaatagaagccgattggcagctgtcccatcccaaactgcctagccgagctcatgggatggtagaactcataagatacttgtatgtttctcccttgatggatgccaacaggaagaatacatggactgatagcagccgagaagacttctctagacttatcatattttttagaattgatttcttcaaatatgaagtctgatggcagttcaaagctcattgagtcttcatatgcaaaccaaactcgggcatctttctgaaaaccatcatagaaactgaagaaccagtccctcagtagctcagccgataacttggatccagaatcggctggtgtggatgcagcctctccatatgacatgcatcggcggtgggtgagttcttctccatcatcatttgtaatcggttctagccttggaaattcagcatatgtcaaagatgaccgattcacagccttcatggcaacaaggttaagccatgtttgcaacaaccaccaagggccaccagcaccgactactgatccactggttatcttaaccgatgcattgtttaacatctgatacagatagccgaggaggatttttcctaaagggatttgtttcttcgcttcaaggctttcggctaagaactaccaattggtagtagggccacaactcgaatcgtagaataggaatttttcaagccacatcagtaggaaggctacatgttctcggggagtaacagatcctttgcccatgtatgcagcaatatagctggaccagcaacctatggttttagtcttgaatcaaactgattcttggagttcaagctcatagggttggccgatgcggtgatgtctaagccagtaatcatgatgacatctagcagagtaggggtcatcggcccttggttaaatataaaggcattgagggtgttggaccaaaagtatgttgcagaagccatcaggggttcatccttagctgaatttactaaagtaagagcaagggcttggctgattcctagttcgtcccaatgaacctgcttgctagccgatacacgcttgtaccatacgggccagcttttctcaggagaacttttctcaagggaaggccaagatttgaaagtatttttccagtgacctagatttgggttggccaatctaaagggtatcctgttggtttcggtgctaatgaactcagtggggtcggaatagccgatcggaccaaggaaatactgatgctcatgagatagactgggaattgcaaccagattggaaagatgctaaaaatgcaaaaaagaatagagaggaagaaaacaagatgagataaggaaaaaccaatctactgcacaaaggagaggatctagccgatgggtagttacctctgcgtattcggctgatggcgcggcaaacgggctggtggaagtcgacatctccgcaggcggaagcttggccaaaggaagagtcgcctcgagatcgccttgcgcaccgaggggatcgccggagagagagagagagagagagaagcgaagttggcttgagcggtgaaaacggaagtaacggtgtgaaatttctcaggggtgacggttagtatttaaagtgctgtggtaacggtcgaaaaaacggtaatgagcgatattcctggagaagtagatatggcaaatccgaaacattaccaaatattccggacttgggggggcatgtgttaataaccaaatctggtaatttcagtatcggagatgaagataaaaccgaagcggaatccaaggatggatcgttccggaaacagagcaagaatcgactgaagttcgaatcggctgcgactagaatcggcagaatttgagtcggacaaggttagccgattaagccgattctgacaatacgacgcagtacacgtcatcgggttaggttgaagtgcttcatgtgggttgccatgcatggattgagtcctggaaagacaattgtatctattacttaggatgttttatataatttccttagagataagtttaggcaaaagtctgtcgtaaagacttatggtatcttagagtttgttagagataagagtcgtgtccgacgaggacatattttgtatctcgggtataaatatcacccgaaaccatgtaatcaaacaacacacgttcaatacaatatcggtgcatcgctacccttttactttcgtttgatctcgacgagttcttactttcgggttgagctgcatcgtttcgatcttcaactagaggtaaacttgtcatggcgacttgcgttctcaggattagtgcttccatctttatgacactctaatattgtttatgtaagttgttgagttagaatatatcctatataatctctggcaatattgttatttaatcctcagtcggccaacatctataactagaaggcagccgatcaggttaaataccgacattgacttagattatataaggtatccacaattctatgaaacatcgaacagcttgattgtctaggtattgttattcttttcatacttatagctgcatcagttgagtttgatattataagtcgtgattagaatctcaatctctagcctgcttttgattgccgattagggtagtatcggggttttagccaatcttatctgatttaactactttatatcctatatgcgtgattgatatgttaaatctgctctttatgttaagatcttgttgcatttaggtatattaaacttcatgtctgatatattctgcttgctttaatatcttaatgtagagtggtaccggagtattagccgatacatgctagatctatctgatcggctatgttatgaacggttataatctttatgttaatgtatatttcgatctaagtgatttatactgtctcggcatgacaaccgatctatcccaatcacttgatttaaatatacatcgacagaaggattatatatcattaatatctacagccgatcgaatagatttagttctttcttgcttacttatgactgccgatcgattagaatatgacatcggctcaaagataaatgatatgtcatcggcgactggccgatcggctatcgtttatggatttaactgctatttttctgtctttgtttcttgttgattgcaggatcaaatcaactggcattctcatgaatctaaaggtaagatttttggacctgcactggagttaagtagatctcccaggcctcgtgtttttcgcatcggcaccttgcgtacctcgtgcagcaactcgacatgcttctggaacttccgaacttgctgatggcggctttgatcaatgtatgccaggcttttcagctcggcggcgccgatgagcacgagggttctcggcactttcggtgctagctctctccactccttcatttccatcgatcgagctagctctcccccgacgcagaatcgtccaggcgtcgaagaacctgggagtgaccaacaccagcgccctgggtgttctggccagggccttgtcggccggtgatgcggatggcgtcccggtagtgggtgtccctgctggtgcacggcggcttgacaactcgtgctggatgccgatcgacaagcccggcgtagcgcacaacgatgtggtcggccatcgcgtggcgagcggtgccccgcgagagtcatggtggggcagactccaacgaaggccgggtcgccgaagaggctcatggcaatggccgccggcatcccgaagcgtatgttgcgcatcaaagcagcgcgctcttggatcttcctgacggctcgcatcccggagctgagttgcatgagcgtccattgtcgccgatcgagctcttcctctccctctcgctctttctcgcttcggtttgggattgggatctgagcgtcttctgtgtgtgtggcaatttggatggagacgaagaggagtacaaaatttatagataagcgctgtgtgaagagtggaaatgggaaaaaaaatttggtgcataccggatgtaaatctcaccccgtgcatacccagcttagatacgcgacacgtggacgaggcgtccatctgacggccggcctgcactgcgcgcgcgcaggcgcacggccatgcctcgtactcggctgggcttgcgcgagcgatctccacgctcgcctacgcggctcgtactcgctcatctcggctcgatctaaatccgcttcgcttgtagcggtaggctcccaaaagtatttcctccccgccgttcccctctacgataccgccgccgccagccgcctctctcatccggaacccgtctgccgctgctaccctcttctacgcgtgggagggcgccgtgccgctgtctgcctgctggccgcccctcctcgtccaactgcccgaggtaactgccgccgctttcttcctccacggcaccacctgggtagccggcgccgcccacagccgctgacatattcctcctcacgcaagagggccactgatgtggtgctgtcgtccgtcgtgactcgtgaaggtggctgcttaccatcttgagtggttatgctattgactgtttgtttataaacaataattattttttcatatacagtcatttacagtcagttgcaagcatgctcacaaatcgatatgcttagtcatgttggctgattcttagtgatgggagctgattccaaatacttcctccgtttcacaatataagactttctagcattgctcaatgtaagactttctagcattgctcacatatatatagatgttaatgaatctaaacacattaacatctaaatgaatgtgggcaatgttagaaagtcttacattgtgaaacggatgaagtagtaaattactcactacatttttacatacaacatctttgcaggggagacagacataaggggtgaagcttggctgatgattcaacattagaagactgcaatgaacaagaggccacttaagaaatgccatagaacaatcaacgacagaaaaatatggactgaaggaaattattctgggagctgatgtgtgaaagtagttagttttgcctcatgtctgtagcctttctttgtaagatgcactaaagtagctgggtagtctgtatatagttaagagtttgcagggacagtagtcatagatgctacaaatttgaacccccttttggttcaaatagcaaagaaactcatatctgtacaatatatttcttttatcacctggcgtgttggatgttatgaaatctgcaaagtgattgatttgttaaaaaacttgtggttgtttctctgattccttgcgaaaataagatctgcaatattgtgtaatctgaaatcgtgatgttcaaatctggaatgtggggcctgttcactttgatgccattttcaaccttaccaaaatttggtaacgttgccaaaaaagtggctacatttagtttgctgccaaattttggtaactacataagaaattctgccaaaattttggcaagttaccaaaattttggcaatgctgaaatttggtaaggttttttagcatcaaagtaaacaggcccgtgatgtctagaagctgactttcttaaacaatattagatgatttcacatctcatacataactggggcctcatcgtttgccctatagcttataagccaaagccaaaatttgaatttaaaaacttgaatttgaatttgattctttttcaacatagttgtcacagcccaaaccggcaccgccgtacaatggcacctgataggagcgtgtcgtaggaaaaacggcgcgaaccgcttcatacgaaaccgcgatctcagtaccagtcccaggacatagcgctggtacccacggtgacaattatgaatcattgcaatccttaaataaatagaggacttatttaccttaacttaggttgcagcttagacagcccgagaatgcaaccgacgacacggacgaggcaaacaccaccaacagcagcagcagcagcagcagaaccaacggtctaacacccaacaccacaggcaacagcagggaactaggacaaaaccctaatcttcacttcacttcaacttcatcttcagagcgggcagaactatatttatatagagcaagggtgattacttacgtactcagcaagccaggggaacttaggtggttaatgcaagcttcaaagataaggctgttatttttcaatcggtttaatttgcaagttttcaataatctaagtgtgtgctttccactaccagagcgagacaagtctcaactcggccggggcgagaagtaacaaatttatgtatcaagatttgcacaactcccggagttggcttcgaatatggtttttcccaaccaaaccaattttccaaacttcccgataatagtggtccccaaacgaccaatcacttccagggactcccggtcccgctatcccccggacagctaaatgcttcccaagcattaggtttcccaaaccttaacatcttttcataaaatagggtaaaacaaaaactacactaaggaatcacctcacatccgcccatgaccgtgggcacggctgttcgaacagtttgttaacctctgcagagggggtacactttacccagacgacattactaacccgggtcacccagcccgtgcagaatagccacgtctggtgactttggggctttcatgacaaggcatttcgaaagccgacacaggattgccatatgccaacgagaggggtcccagaccaacaacaagtttggtcccagaccatactgtgccaggaagcccggggattctccccgacaccaccccgttgaatccacatgtctcttggcatcaaggctcccctgattagctatttactcagccaggggcgtcccattccacccatgtggtcgcactattgtatgcttggatgtaattccataggaatcggtccttagatgcgaccgcacaagtattccgcccaggaatggccttgtgtcgcgagtttcatttttaaaactcattttctttcacaaggcaccgatccaagcgtcgggttttccaaagcttttgtaaaccaagttttacccaagaagttactcagattttaagtttgaaggtgaccgtcgatactcgcacagagtgcatgaatatcgaggcacaactagatggttacaagggaacatgatataacaattaacaatggaaggatcagatgcaacaagttaggtaggcccaccggtctacctcgtagacggggcaaacagattaagtgcaatcctatcaatgcataatattttacaagcaatataatcccttcttcctatatagttggtaccaactacaacattagctcctataaaggaagcaccaggttaagccacgtcattgagactttagagccgtagagccgtctgatcaatctattgtcagatgccaaacaccgttagatcttattctcggctggacacagaaatcaggcccaagttggttagcaggccctgtcaagcccgtccgaactcctgcaaacctctgctggacacactccgcgaagccacgcattgacggggatttcgatcggcttgcttcctggtcctggaccgtgcaatcctcacatacttgggagacggagcgacagaggccgttcatatcctgcgctccacccatcctttcctcttcatcaatcactgccaattaaactagaaaaaacagccgctatcaattgcctacttcaactataactgcgtcgatttaccaacactcgcagggtctcttcttactcatatcatcaccacgacgctggtattctcaagcatggcaccggattaatctactctgctttcagtttggtcacatcttcagcagttctgcatgcgagaaaactgtgagttagctcaatccatgtaatttgcttgctttggatggatctaccgagcacaacagttggccgcattctcctcctgcactaaagatggtagaccatacatctctggccactgccgtagaagtacttctgtgcagaaggtatctatctccacttcttttctggttggttaattcagttaatggaaattgtttacagactatattcaaggtgaaattgcactactgcaggttataaatctttccatttgcaacagtccatgttctatctcaatgatattcatacgttcctcttcaatgtcatgccctcatgcatgcaaaaacaaaaaagggtcttcgatctcagctttaaaagggtagcacaaaattttttattggaatattgaaagttcaggaatcaaagaatcatctccatgggcacaggtaactaaacaggtaaatataagctacatatatagaatatttgcttaatttatatttttgttgatctctttattaattatctttttccgacagtagtccattaggattacactttttgaatgcaaattcctatttcaggattattattatccctgcctaatccatgtataagatttccccctattttctgaaaccaatgtagcatttgcctctccatgaactccggcagaagacagtcacactacaattaaatataaactacatgtactccagcagaaggtagtcgcctttacaacaagaatcaattaatgtcaattgccagcagcataaaaaatctcaaaatgtgttatttcttttttttttttcgaacggtcaggcagttgccgacgttttatattaagaagaagatatcccattttaaggagaaaacgggaccaaaccttacaatgctcagttaatgttatagccatatagtggctgtaaacccgtaactaatcaccccatattaatccctcacacaccatatggtactttagacatgaaaattaagtttctacctcccttattggaatacatatttaaaaccaatttgttcaaattggttttaaatatgtagattgtagagtgcagtgtcaactccctttcgaataattcatttgtcatttttgtaatctacagtatgttgtgtgccgtggtagtatcaagtatgtgtataatcaaacattttcctggactactataatgaaatccaatttacaccgatttgttattttgaattcagtatgtaccataaaccaggaggctttaacatataaatgcacatgagtctctttgacaccacactgaaagtaataaaaagcatacattttggttcacagtttcacactaactttttatgtttgaaataacttattaagcccgcagcaacgcgtggggattcaactagttaagttcaaatataggctcaatatgttcaaaggtggcttgccttgctcagagtcttcacgaagcttcacaaatcttcgagaaatccgcttgaagaaaaatatccggtaaccacaactaggcgcaaacaatcaaaaacctaaacaaagaccaaataaaatatcctatttaggctaattaatagtgccattagatagatcacaatttaatggaattattgaaagtggaacggggtaaatcggagttacggatcaagagatatgaattttggaagtttaaataaattttctggacaagaagatgatttgtcagaattttctggaatacgaaaaatggtttatggaatttatagaaataatattctcaagaatattattgatagtcactgacatgcgggaccgagggaatgaattattggaatcccggaataggataaaggactttatggaattttggaaaaagaaaggaaatacttgtggaatattggaaaaaatattctcaagaatatctttgactcattgaagagtggggccaacaagaaggtcgagtgagagagaggagcaattggaggtagcaattgtggacttttagctcttgggtgtgtgggcactggacttggaggagggagtaaaagtgaactttctatgttttgttaggccgaggaggaaggctggccaatgggccaagcccacgagccagaggagagaggggtggctgacttggcgctgtggactgggtcaaatgccacgtgggctgccacgtaagcgcaagaaaaaaggagagggaggcagagctcgcccggatcggacggcttacggcggcgcaacggcgccggcgagcggcagcgagccaaagggaggggacggcgccggaggcaaaaggaggaggattggatcccttccaccggcgcggattagggcgccggggtcgaagaagggccagcgacggcgtccggcggcggcggcgggagcggcacggcgcgggcgcagagggcgaagctagcgactgcggcggcgcttcggggaggtccgagggggcacggggataatggtggcgccgggaatcaaggagaggagggaggccaacggcggtgcgcaaccgtgtgcacggcggcggcggaaaggacggcacggcgcaggggcaaaagagaaggccggcgggcggagcgacggtttggggtggtttgttagagctcaaggtgggtggcggcgaaaggattcggcgcgggaccgaccggcggcggcggtgaaacagagcgacggcgacgagaaggggaagagaaccgacagcgaggagaggatggccgatggcggcgcgtggttgcccccggcggcaagaacagcagcacggcgcgggaggggaaaagaacggtgcgaccgtggcgataagagcagggaggaggcgagtagctcaccgacgggcgaggcgagacggcgttggtgatgagggctcgaaagcgagaaaggggatgccggcggcaaggatgtcctggcgggtttgacgccgaggcgggctgatggagttgtccgcccgtggcgagatgatcaccgcgacgggagcggcacggcgccaagacggcgtggccggggaagaagaggggagcgcgaggatggggcggcccagtggcggcgaagagacgttcttggtcgcggcggcgacggccagcgacgaaggagtcggcggtgctccgttcctaggagcatgagaccaaggggatggattggggctcaaggggtggtatttataggcgaggaccgaggagggcgcatgcgagctggcgctcggctagcgaccgcaagcagcatcgacgctttcgtgggtgacgcgaaaacggcgacggcgtgaatgcgttggacggcgaagccggtggatcggccggagcgaattgaacccggggcgcggaagggttggcacgggcgagcgggcgcggtcaaggtgggggcggcaaggtgctgcagcggcgtcagcggctctgcctcttgagcaagaagccaaggagttgaggcagggagctcgctacccgggaagggaaaaagcgaaaggaggaggaaagggagctttgctccttccgttttgggaggnnnnnnnnnnnnnnnnnnnnnnnnnnnnnnnnnnngcatagctaatctaaggcgcgg

SEQ ID NO: 18534 - DNA, 15090 bp, Oryza sativa
  unsure (1)..(15090): unsure at all n locations
ggggtgagacgcagaagtctctggagtgagtgaagagaggtgtaacctcagttaaaagagttagaagggatggatgactaggtataggtcgacgggcgatagtttaagggagttggtttgttatcttcagatttagaatgttgaaggaatgttctgaaccatttttttttcccaggtattgatgggcgctaattatcctacgcacgggaaattatggtgggttacagtgaggggttggaagtctcccgggccagaatatcgcattaatttttgggggtgcgggaaaatcattaggaagttgggcccacaacatgtttgtatggtagcctaataaaggacttccccgtaccatcttaagtgtgttcaatgtgtggtagaccgttttattaaaaataattttcggattagaatttttattgtttttaggtgataaacataaatagtacttgatatgtgacttatttttttatatttttttttcaaataatacaaatggtccaacggttgggcgcaaaaaaaacccatggggccgagtggggtgatttattggcccatattggtccggtaccgaattttattggggggaggaaacatgccaaaagaggagagttgggccggggaaggaggaatcagcccaaaagatcgacggaggtataatagactgtttacccagaaaatttctttaaggaatatgaggagcatttgacgctggatttgaattcaaattggatatttgaactcaacaaaatatggagaaaccaaggaggggattcaaagagtgaattcgatactttcggtaatgggaaggaatttcgatgaggcgtgattttcgatgtcgatgggtggttgaagttcaaagcgagaattgatattttagggatatgtttgtatttggcagctcaaggattatttgagagggaaacaaaaggagaaatcaatgttcgggggtgaaacaaaggatgtggcggtagaatgcaatagatagatagatagatagatagatagatagatagatagatagatagatagatagagcgatggagacgaggagagggagaagcttggatgttagagctagctcaaggagggaatttgatcggaggggctttagggttggagtctggttttggattccggaattaggcgatatttgtggttagggtttctggattgaaatccgaatagaagcattcgaacttcgagattattttggagcggaaattttgaggaggcgatcattgatatcagggtattgagacaagggagggattttaaattgagatctttggcacaacttagactcaacactcaaagaacggaattttcgcaattaggatttttgtaaattagctttttaacgccacgcgaaaagcggagcgttacaataggttttttttaactttggcttttcaatcactaagaacatatatacaaaagttttactcacatatcatgttttaatcgcaaataagccgttatggcttataataagcctagaccaaccgatgggggcccaaattcaggttttagacataactaccaaattcaggtttcacatctcatacatataactaccaaattcatcttaatgtttgattatgatcagcatcttattgtttgccgaatccaggctaagaacatgcaagagaatgtgcattttttagagttaattgcactttggtccaccttttattactaaagtttcactttgggccaccctctaactaatattttcactttagactaggtaagattacctttgttgcggtttggaccaccccaagttacttttctagttgtatctaccctctaatcttgcgaagaatagtctacatgtaaatcgggaagattatcggtttatgggtgccgatgtggttaaaatcatttatgtgctcgaaaaagtttttgggtggttcaaagtgaaacaaaggcaaattaatcttcttttttttgcggggaaaaggcaaattaatctagtccaaagtgaaaaggttttaagggtagtccaaagtgaaacttttgtgataaaaggtggccctaaacgcaatttactttttttttccgtggaaatgtggcttgctggataagaacacgggaaattaccgtctcactgacaagcagctttgcgcccacccgcccgctgtttcaaatttttaacagcgagtatttacattttttcactcaccccacccgaggtgagaaatccgttacagtcgtgggccccacgtctcttccaggctggccgcttgctaatatttcataccaaccggaaccacgccacgccacgccttgactcgaaatccttccagaaacaaattgttgaacacccagcgagcgagcgagcgagcgagcgagatggcggcggaggtgtggaaggcgcagttcgggaggcttgtggaggaggcggcgatccgcgtcgatggcgtgcgtgagagcctccacgccttgctgccgcaactgacgtcgtcgtcgtcgtcgatggtcgcgggcgatgcgaacaccgtgcgagatacgatccagctcgcgctggacgcgctcggcctcggggatgagagctcgtgcagcaatctcgcctccgcgatttccttcacggtggcggccaggctcctcgctctccgcggcgacggcatcaaccctgctgtctgtgcgtcttctcagggtgaactacctcgcggagcagagcgccgcaatcaagctcagctacgccgagagtgacgcccggaaggcgtacgcccttgtggacgggtgccgcggccacctcgacgcggccctccttctgctggaccatgtaggtcgtctaccagacgtgcagggcatgatcaacgccgagcgcctcgccgccgtcgccgacctcgaggccgcgatagtggccgttcagcggagcgccgagatggccaccgccgcccggcaggacgtgtccggcgccagttgattccgttgagtcttcgtatgcttgatacgtacctcgttcatctgtccatctctttttcgcgcttgccgttcgacctgctcctgctttgttactgttcgtgtgatcgtgtcgtctgatcgatgaattctgaaacattgtttgaaaattttggttgcttttgtgcacttgtgctagctctatgtcgatcctcacctggattgttatgtggatttttgataatgaggtactagtgttttctcggatatatacatgccttcttaatccgacgacgcgagattttctacctgtattgctagcttgttaattgttgatttgtcaagatgttcttacaaaaaaaattatgtcatgtcatctttggggattcagatttaagaacaagtctagctgcggctggttgatatgggcaacttgttctgtatcttttgggattcgagtaatactccataaataaccgagattttcatttattcacaaattagagatttgggacttgatctggttgagtttttttgtggaaacagagtagtactagtgccattgtgtccatctgtttcttctgaagcagttgcctatgtttgttcatctgcgtgcagtttttccttttcccaatcaaaattctacctgcattatgtatgatctgttctgcctattggtattagcgagaataagatactagctctgacctctgaccattttaagtgctagtgcttattcagaacccttttttggactttatttaactcaatatggagtgatcaaattttcttttatctttatgttttattctcgctgtaattactctgtcccttgcactcgaattttcttaatatcatataacaggtcaagtttttatctgtgtgtacactaccagtaaatgtgcataaatattttgggcattttcatgcagctagtgaaaactgcaaattctgacattaaacatgttgcatgtgttgtcacgttattcaaggcattattcgcgactgtcgagggtagccacaacaatatataccatgtaaaaaccataaaattcctattgagaaaaggaaaataaccacgataaattcttgaggggggaaaaaagggaactggtgaaagcatccaactcaaactagagctcagtactagttgtacaaaattttgaattctaacaaattctagggcccgcttaccggagcatctttcctccggcttcgactcttagtccttctggtctcttggcaactgtggaaggagcggaactgttttcgactctgcactctcttcagtctccatgctttttgagtccatccgctcggaaggccatctgtgagcttccgtaggcattgccgcttttggggatctcctgggagtgtagtgcggctccacctcctctctcttgtttgttggagtagtttttcttcgtagtggttttttttttccttttctgttttggtcattttattattgttcctccaacataggtctgtctggccgattgcgttgtgtaacaaaacctttttttcttctaatatattgacatgcaattattttgcacgtttacgataggaaaaaaaaagaattctaacaaatagcatacccagtatcgattgattaatccatatgtactatctgtctgcactctactttttttattggcgtccactcgaacgttgtaaaatcttgcatatgagcaccatggtagcaaaatgcccactttccttccttattaagtggaatgctatgtagaaattcttcgcattctttcgcacatatttgtaagctctgggatagcataaaggctgatatgaatgctactatcatcttcttcaaggccggtgcgcttgcatgtaagaatttcaggagcctagcttcgtactgtcgtttgtaagcgctggtaatctttatatcctgaagatgctctaacgagatgatatgatgatccctctgattttgggtaccgatacctgtaggtcttttgcaatattctgcctatggaaaaccatcatcaattcgatgaattaaatcgatgtaagttattaaactactgatcagttaataaacaacggagtagcagcttaccatcgaacaatattttatgttaagttcgagatgtttgagaaatttgcaccgagtaagaagacataacacactagcaatatcataaacctgtgcaaaaacctgtaatgataaagatgtagcgtgaggaagttgtggtatatcttttatcagctcaacctctgcactatcgtgaccgtctttctgcacaaattaaaggatcattgttagcttattaataatcctaaagttgaagacatgacgaatatttgtaccatactttatttctgttatgtctcacatgcatgcactgcatcatggtgctcgggcaccaagattcaaattaagtatatactcaattcaattgagtatgaaaatttttaaaatatttaggtataaacattaacttctttactaactagttcaaacaagtttgaactgaatttgaactcataatttcaaaaaatttaaaaatttaagtgaatttatgtatttgataccttggtgctctatataagtgtcctatatagtaaaattatggagtataacaaaagaaaactcagtattatgttataaataatatatgcgagtgaaactaaagctaatcacagtctgaaaaaaattgtaacatgtataattttatcatccatccttgaaaagtaccaggaattaccaccctttctagtgtaaaatttaatatctctgggtactaagtacctcgaggtaaaaaaaaaatttagtgtaaaattttggtatctcgaggcactttttcaaggactatgaaatttctctagctcgtatatacaacacgtacgtacctgggtaatagttaggtgtaacgtgagaaattgaaggaatttgcagcatcgtaggagccgaatcctagtttgatttacgtggtcattacattcgggtcgtcgtagtgaactcatctcagtctcaaagatccgcacgcacggcatatcctcgacttggacaatggaagccaccctcgtgtagaagaacgtcaactcctctagcctcggcgctgatatcaccaaccttcctatggacgcgttcctcgtgtggaaaacacggagcctgggagtcctgagctccaacaccaaagcacggctccagatccaatccaacgacacctttaaaagctcgttggactccagatgcaacgactgatctgtcgttgtcgccggactcacagtttgcttgtgcaagcatagcttccgcagagaagggcagcgtgctgttgacaagagctgattgagatcatcaacatcctcgagcgtgagatgtacaagcgaatcgagcgtcacgttcgtgggaaggcggcggagacacgctttgttcaacgacaagaccatgctctccaacctcgtcgcgccgccgccgcaggtaatcataagcttattactacccaaaacctgcatgcagccgttgctgctattgctgttgtgcaagttcaatggcagcatgtagttaagttgtagggtgaaagacttggatacatgctgcataccatactgaatccacgcgtcgacttgggcaacatccactgatggcacgacgcgtttgctgccgccactcatgcaacggctattgaacaacttaaaggagatctcgagctcctctactacagtagtactagtgccatcatcggcgcgcctggcaaggatattgttaacgaaggcgatgaaccggtcgagcttctcctgctcgctgaagtcgtgatcgaggcagaagaatctgaggacggggacacgcgccccaagatggcgccatcgccgcgagaccgcgcacgcgcgcatcacgtccgtcatgctgggtagggaggcgaggatgtgcgccaggatgtcatcgctgaggtgactgatcaggtcgttgcctccgcctccgccgctgtcgtggtgatcagatggatttcgccgcagcagtttcgcctcgcgcgtggtggtggtggactccatggaaaaaaggcaactaatttgattgcctagttgttgttacgggcgttagggcttctatatatcatcaaaagtgaaaaaacaataatgcttctatttgtatctatatatgcggttacagttaggaacagcacgcgtttctgcgtctgagttctgaacgtacatgttcacaactctgcgctctttaattggggcttgatgggcctattaagtttttggggaaattcgggacgttaatttgtcccaagtggcataatgaaccgtaatgggctgttcctcgtcttcgtctccattcaaaccgcgcccatgtaaaaatttcagagttgtgacgcatttactagtgtggttgatcaaatttggaacactgccgctagcaaatggaatgcgaatctgctgctgaatctcagattgtgatgaacatcatctacttatgtgtttgcacacgaattcgcatgattggtagttcggtacgcacgcgccagaggaaattgcaagcgatttcagtgatctatcgaccaaacaaatggagccctacgaaagcaagatgcggcgagcagcgcgaccattgtgccattgtacaacaaaggcacagattaaaccaaatcaacttctagtctcctacagtcctagttctggaattaatggatagcccagttcatgctagttgatattccgaaaagaaacagaacaaaatccccagtgcaaaccacccacagctaaacttgttcttaaatctcaatctccaaacatgacacaaaagaacaagcgctccaagatgttctatctcaactatccctgctgcattatccaacaggtgcatattgataattgtgcaattaacaagctagcaatccatgaggaaaatctcatatcatttgattaagagggcactcatatatccaagaaagaactactgcattctcaaaaattgacagaacccacatgtaggagaaagaaaaaaaaaagacttttactgacatgcagtcacagtgatggctaaccttgagcagaaagtgcccaaaacatttttactcattacctgtttgtttacacacaaatactacagaatttacctgttacacgtaagagattaaaaaaaattgaggagcaaggaacagagtagcggcaggcataaaacatgaagatataaaagagcttgatcgctccatactctgtttcctatacagccacaaactcaatcaaatcaagttccaatgctctaattcgtgaatgaaataatctcagtttatcacttggaaccccaaaagatactgaacaaactgcctgtattaaccacccacggccaaacttgttcttaaatctgaatccccaaacatggcagcaaaaaaatttcagaacatcttgacaattgaacaattaacaacctagtaatcgaggtagaaactctcacgtcatcggattaaaaaggcatggatatgtccgagaaaacactacttcattatcaaaaatccacataatccgcgtcaaaaaaaaaaaatccacagaatccaggtgaggatcgagtcgtacagctagcaaaagtgcacaaatgcaaccaaaatgttcaaccaatgtttcagaattcatcgatcagacagacgacacgaacaggtaacaaagcaggagcaggtcaaatggcaaacacgaaaaagagatggacagaagaacgaggtatcaaacatacgaagactcgacggaatcagttggcgccggatacatccccccgggcgcccaaggccctctcgttgcccaactccgcgctccctatcgcggccaggaggtaaccatcggcggcggcgcgctccacctagatcaagccgtcgacgccagggagattcggatggtccagcatgaggaggatcgcatccaggtcctccccggcttcatcacggagcttagtcacaggcgttccgctccgcgaggtacatactgggcgccaaggtggttgatcccgcccagaagcgtcgacggccgggttgacactgccgccgtggaggtggagcgcgaggagatcggccgccttcatgagggacttcgctgaggcgagatctctggacgcgtccacgagctctcccatcgcgcgcaagctgtggatcctggtgcgcgcggcggccgcgccttctcctcgccgctcgcgagcatgagatatgaaatagccagcctggaagatacgtggggcccacggttgtaaggttaaaaaaattgaaactgcgggtgcaggagttgtcagtgacacagagattcccgtgtctgtcttcaccggcaagccacatttcccctcctccctccagcagcgcctctctataaattgcgtcctcgtcttcgtctccatccaaaccgcccaagccgaagctagaaacttagaaagagcggagagggagagggagaaggagagagctcgatcggcggcaatggacgagtgggaggagcttgcgtggagagtgcccgagacgctcatgctagtcagctgcgagatggaagccaccaggttgatcgaagtcgcccacagcaatctacaagtgcgcggaactttgttccgccggatacacttgggcatgccggcggccatcgccatgaacctcttcggcgacccggccgccgaaggagtcatccccaccgagatcctcgaggaggcccgccgcgagatctcgcagagcggcgctcgccacgggaagaccaggcacgtcttcgctcgctacgtcgtcgcgcacctcggcgtccagcaagatgacccggcgtaccgcagctgggaggtccaccaccaggacgccatccgcttcaccgataaggcgctggagaaggttagcgaagccgcgtcgcatgccgaggcggccaaggacgccgtcgacatcgccgagaccctcctctcccagccccagcccccgctccagctgtgggcagagtggacgtcggcggccgagaagctcgtggaccaggccgctttggaggccaccctggcgctggacgaggtgctccgggcgcgccaatctgttgctctcgagttcttcgacgccgtagcgattctgcgtcgcggaagagctccaccggcggcggtggacaagtggtggcaagagattgagaggacactccctggagccttcctgctcgtcgccaccggcgggctgaaagcgctcaggttgatccgagatgcccatggcaagctccaggaacgcgtcgctatgctgcgcgtgaacttacgccaggagacgccggcggcggccgtccccgtcgaaggaaattctgcctaccagctggatcccgagggaatctgccccaccgtggcccttgaggacgcccgccgcgagatctcgcagagcaccgttctccacgcgaagacaaggcacgtcctcgctcgctacgtcgcgcacctcggcgcccagcaggatgacccggcgtaccgcagctgggacgtccaccaccaggaagccgttgaccacatcagcaaggcgctgaagagggtgatcgatacggtgtcaaacgccgaggcgggcaaggtcgccctcgtcatcatgggtagcgttgcctacgggtgcccgctgtgggatgtgtgggcatcggaggccgaaaaattcacggcagtcgctgccctcgaggccactatggcaacgaatgagatgcgctgcgctcaggaagccgttgctcaggagttgtccgatgcctggacgattctgttgtcaaggcgaagaaactgaactagctgcaccggcgcatggtgaacatacggctcagatttgctactgatctccacttttgctgttctctttcagctgaaatgaagtcctatactccttttttctactggaaatgggaaggacgactttggtcctttgattcttcaagagttctagttgtagcaatacattaagacttagtaccaatttgctttagagttctgtttgttactacgtcgccaaggcgctggcgcacgtgacgtcaccgatgcacgcggggggacgaggaggaggcggccgccgcgcgcaccaggatccatccagcttgcgatgggagagctcgggggacgcgtccagaaatctctcctccgcgatgtccctcatgaaggtggggtggccgagctcctcgcgctccacgacggcagcgtcaacccatcgacgcgtctgggcgagatcggcctccttggtacctcgcggagtggaacgctagaaccaaagctccatgaagccggcaaggacgtcagtgttgacgggtgccgcagcaacctggatgcgatcctccctctgctggaccatccgcgcgtgtccctggcgtcgaggaggagctcttcgccgccgatgataacctccagggcgcgatcgggaatgcgaagttgggcaccgagagggccgtcggcgcccggcaggatgtatccggcgccaactgattccgtcgagacttcttatgcttgattcctcgttggtctgtctatctcttactcgtgtttgccattcgatcaacctgttcctgatttatgacctgttcgtgacgtttgaccgatgaattctgaaacattggttgaacattttggtaaattttgagcagttgtgctacctctatgtcgatcctcacctgaattctgtggattttttttataatgaagtagtgttttctcagatataaccatgcgacttccggtcaaaaaaaaaagatataaccatgcgaccatgccttcttaatctgatgatgtgtgattttctaccaagattgctagcgcttgttaattgttcaattgtcaagatgttcttaaatatttttttctgtcatgtttggggattcaaatttaggaataagtttagccatgggtggttaatacgggtagtttgttctgtatcttttgaggattcaagtaataaactgagattattttactcatgaattagagcactggaattttatctggttgagtttgtggttcattggctgtataggaaacagagtagtgtcattttgtatctatctagttaatttcgagggaaaaaagcatctgaatgtaggtttataggagtttgtttacactgatgttgctgacattgctgtaagttgcatcatctgcattcaggttttccttcccccaatgaaaattctgcctgaattatgtatgatcggttctgcctgttggtattagtaagctagttctgatctctgacattttaagtgctactgcatattcagagctcctttggactttatttaactgaacatggagtgatcaagttctcttttatattcatgtttatgcttgctgctactctgttccttgctcctcaatttttgttaatctcatatgtataacaggtcaattctgtagtatttgtgtgtgtaaacaaccagcatggagtatacattttttggccctttctgctttaaggttagcaatctctctggctgcatgtcagtaaaagccttttttgctttgtggtacatctggattttgtgaatttattaatataatgcagtagttggatacatgcacgccttcttaatccaatgatctgagattttctacatggattgctagcttgttaattgttcaattatcaagattcacctgttggctgatgcaacatggatagttggcatagaacatcttgatgagcttttttttgtcatgtttcgagattgagttttaacaacaagtttagttgtgggtggttaatactggcactttgatctgtatttattttttttgggaagctatcccttttctccagaattaggacactatagaagttgatctggtttagtcttgtctgtgttgttgcacaatggcacgagaccactactgcaagtatgaaacacaagtagtgtatatcagtttggttcagaaaataaacgctgaatatctacatgtagcatgttgaaaataagggattgagtgcgctaggagtttgtttgcactgaatttgcattgcagtatgttggttcatctgattgcagttttttttccattccctaaatgatttattttaagcactctctaaagattcagaactcttaatctgtatggagatcttttctggtactgctgtaaatgataaatgtgatgatatatgacgtataacagagacctcatgcttataacaggtcaattgtgtgtacatagccagccaatgtgcataatcattttccttcaaacaaaacaaaataatgaatcaatttatttgggccctttttgaagaggaggtaccgaatcctgaccatccatcacacaagatctaacagctggaaggggttagtacttgctagtaccagatgcacctaatggtactcgaaacctgcaaggttggcttccaaaaatctgtagaagaaagaagagtaaattgcacccacggtacaacttggcaggtgggtgcgatatagtgcaagaacttgagaaatgagcgtccaagtgtaacaacttgacaggtaggtgcgttctactacaagaacttgacaatttgtattttggtgcatcaatttggctaggcatatgctaggtgagtttttttcccgatatcaataatgccattacatagcaatcctacagatattaccttagatattaaatttaatctttagtaattatattgcatatacagtttacatccaattaccttaaaattttttttcgttttctttaccttctcaaatatcaaccgaaatataataatttttacatccagtttaattgacttcaagttattaattattataataaaaatataaatatgcttatacaaatccacactagtatattgtcaaaataattacttaaattgaatctatgtagaaaatgctccaaataattaagttgtcgcataatttcttagtttattgtatcaaaatcgtacctaccttgcaagttgttatatttatacgatcacttataaagttctcatactaaggtcctgtttgtttcagcttaagattattgtaatctagattattaaatcagattactctaagctagattataataagctgacatagaataagctgcgagctgtttgtttctctgaattattggaggcatctaaggtgatccaggacatcctggcccgcctgccgccgcgcaccatcgtgcgctgcctcgccgtctgcaaggcctggcgctccgccgtctctgccccgacctttcaccgcgccctcgccggccaccgcccggccgctgtcgtcaaggtcacctccgaattggcatattttggcaagccatggcgctactgcaaggccttgcttctcgacacgttccgcggccgctggtaccgcggcaacgtccacacaccacgccgtcgtccccgccttcagctcgcgaccatggcggcaccacgccctcacctgggtcgtcggctcctgggacggcgtcgtctgcgtcgacgtcgagtacacttctcggttcttcaggttcgggcccgacctagacaacacgcagccggagcggcgggagcgggagttcgtgctctggaacccgctcacccgggcctgcgctaccgtccctcccccggcgcccggcggcgaccgcggcgtcatcatcggcgcctacgcccacccggccaccatgcgcttccacctcctgcacgccgccggcgaggcggaacgtggcctgttcgccgcgacggccatccgtgtccggcgagtcggagacggcggcgcctggcgcgaggttcccctcctggaacagcaggaagaagaagacggccacgacgacgcaaacatgcaaaattgcagcggagaaggagaaccataatctttctcaggatgcaggcatctcaatccgtcagcttgcacgggaacctgcattggatggtgcagcgtggctcgggctcgaccgcgcggttgaacgtgctcgtgttcgacacagcgcgcgagaggttccggctgatggaggcgccgccgtgggacgacagccgtggcggggggggggggggggggggggataatattttatgtattttntatttaaattgtattaggggttagaaaaacaaaataaatggtggtggattgaagtggttggctcatttgattaaagggggtatctaagttttgttatgtagattaagaaaattttttaaaaggagggtgaagtttccacatataattggtctgccaaaaacatccatggcttcaaacaccctatcggcccggcattagggcgcttggttgaactccaatcctgaaacggaagcggtggcg

SEQ ID NO: 18535 - DNA, 21720 bp, Oryza sativa
  unsure (1)..(21720): unsure at all n locations
acaagcgcgacctgtcgagggctttctcgtcgccnacgcaggtgtcagcggtgcagggcnacgcgaaggcgagnnaggtgatcctccacaacgacggcaaacatcgacgcgtatgccggcccagggcgtggtcgacggtgtccgtctcccgcttcgccacgctgctgccgcagcgtcgtgcggcacgacgtgagcttcggcgaggcgtcgcggctgttggcccaaaaccggaagacgttggcccaaccgggagaaagccttgctacacctcaaaagctagttcaagtggtgaggggctctcccacttttaagttggtttaactccccctaaattagcaatgtgggactattcccaacaatttcccccgtcacacattggtaccccttagccctgatcagccccacacacaggcacatacgggcctcacacccgtggtccactgatcggcctcacacccgctgtccactgggctttgggtttacaccaccctgagtgtgcacaagcaatagagattatgggtttgtctctgataccaacttgttggcccaaaatcgggagacgttggcccaattgggagaaagccttgctacatcccaaaagctaggtcaagaggtaaggggctccccccacttttaagttggttcaactccccctagattagtaatgtgggactattcccaacagtggcggcttcagctcatcgtcgacgaccatggccagcatctctactccctataaaaatattttctccccctccgtgccactcagtaaggcgcgaccatatttaattcaactctttaaatcaataaatagttaaataattaattgtaaactaaattttatttgctaaaaataatattattggattaccatttaaattttcttttcgaaatatctatttggacctatactttaccatagcatgttgttaaatatatgtagaatctatgcgggttatcgttcagtattcgaaatcgaagttatttgttcagtcgattcttttatcttcaggatctatatgggttggcgaaacctactacaggctccaaatcaatctatagttaacttaatatccaattcatacaatagttatctataaacatatgctacaaaatcaatatctggcccacctgtcatacacaaatgcgtcttggagtccgtgctgtagctggctacaaatctatagcccactgctcttatctctcctcttttatctcattaaaatatgtttatagctggcttatagtctgctattgtatctacacttatagcccactgctcttatctctcttcttttatcttcttaaaatatgtttataactggcttatagtctctcgtagacaacttatgtttgtttctgaaagattaaagtcctcgatacgcatcacatttctcacttatttgctttagaggaaactttattcatcctagtttgagaacttttcccgataatgctatgaaacctgaagtgatgtgatgaacgatttacaacaaatacggagatgatggcaactatactttaattagatcattatcagcttattcaaaataaaatcaatcaaataacagacaagatataatcgttctagaacatctagctgattcacggaaaatcaatcaaatgtgtatgctcctgatacactggtgcagaaaatatttgtatgttgaggttaaagagatccaagggaataaagtactagattggagcttaatttcataaagtctggtagagtaaaatgtgaatcttttgtatagccagcttcttctaaaacatggatcaaaactttctgaaaatacatgagaaatagcctacgtaagtaaagcagaaaaggactacagtatacaaataccatgaaatattagtttccgtgaaaaattacaaatgacgtcatttttttaagaagtcaacttagaggtatttaatacctactattatactggtcccgcggaagcacggaccagacggaagaaaaaaaaatattctgcaggaagagctatcacaactacaaaatcgatttttcatggcggtaccatattattttcactggcggctttttgtgaaatccacctacaaaattataacgaggggtgaggggctaagaacctattttcgctggcagcccacttaaacaaccgctggtaaaaaattgattttagctggcggtagataaggagcaccgactgtgaaaagaaattccctatatcaaaatcgcacggatgttatctctttccactcccaccgacgatcttgtcttctcctctcacctcacctcctcctcatttcctacctctcccctacctcccccaacctctcctcccacaggccacagcttctcctcctactctcggcgtccacatcttctcctcctcctctcggcatcgatcggtgtgacctcggcggaccggcgacggagacggcagtgaccacgacgacctgcgaggggctcgggccacaaatccccgcccgggatgggcgtgggaacggtggatccggctgctgcagggtcgcagacgacggatccggccgtgggacgggcgcgtgacaacggcggaccgccaatggcgacggcggcgaccccggcggactgcgaggggcgcgggagctagcggtggatccgaccgctgcacaccatatatgtattcctatgtctaaaattgcggtagtatgtaatgtgtagttttacttcttaactgcaattttattgttatatgtggcttcacttcatttttttttatctaagtttgcatcattttcatgtaattttgtaaattttattaattatagatttatttcttgtaaattttgtatgtttaagtatgtaggtcaaccttttaaaaaggggtgaaaaagagaagcaacgaggatcattggattgccatcaaagggacgagaaaaatgactaaaattattgacaatttcaatcatctgaaatctagagttccctatgtatatgaattttaaaacacctatctgggtgtgtgtggagagtcaagcatgcgttactgagtaagatatctgtatcgagatggattctaatcactcgagtggacgtccacccgtttattgcatgtcaacttaaatggttatgaaaaaattcaaaaaaatgacaaaatatattaatatgtaatattactccacaaacatgcaatttcaaattcaacttctacaaattgtaacaaaaataacaaatttagctgcaattatacaaatagtaattaacgttttgtttgttatttttgtagaagtcgaattttaacttatatgtttgtggagtgatattttacatattaaactatcttatcatatcaattattttcataaccgtttagatgacatgtaataaacgggtggtaattaaaacagtttcccgtatcgattcgcccaatgaaggcgcatgtagcagagtcagattcaatcatcctagcatattactacgtccttccttttatatttgacgttggttagtttaacttctaacatcaaacaaacaaaaataccaccaacaaattaattctttataagatagttcttattttattcatttcctaaaattaataaaactaagctgatataaataactcaatcggtgttcagtaacaaaacaaagtaattgggttcatagacaagtactggtcatcgacgtcgatgtcgatggtgtggtcgagcagccgggacgcctcgccgaagctgggctgatcatcagcaacgctctcccggtgcggcagcagcgccacgcccacggaaccactcctggggcgcgcggcgcacaccctcgtccacttccttcgccggaggctgtacgcgtcgagccgccatctccgcggcgcgtcggaggaggaggagtcgagcacccacatctccatcgtgctggtggccgggcgcacggccacggcgcagagcttgccgttggacaggacgacgatccgcgatcttgccaggtcgtcctcctcgccatggcgccgtggcggcgcctccatcagccggaacctctcgcgcgccggctcgaacacgagcacctgcagccgtccgggtccggccgatccaccccgctgcaccagccagtgcaggttgccgtgcaaggcgacggagcgagcgccgtgcatctgcagctgcgcgtgcgcgtgatcgtcttgttgttccaggagagggaggggaacctcgcgccaggcgccgtcttcgactcgctggacacggaagacggtcgggacgaacaggccgaggctacctggacggcgtgcggcctcgccggcggcgtgaagtaggtggaagcgcatggtggccgggtgggcgtagcctccgatgacagcgccgcggccgggcggcggagagacggtggcgcgggtcatggcgagtgggttccagagcacgtactcccggagccggccggatttgggccagtgatggacgccggcgtcccagcggcttccccggagcagaggagcacctcgctcgacgcagagcacgccgtcccaggagccgacgaccagcgtatcgagtacccacggggtgtcgggctcgggggccatggccgccgggaacacgaggccgcgcggagaccgcggcgtggtgtggacgttgccgcggtgccagcggccgaggaacgcgtcgaggacgacggcgtcgcggtcgcagcagtcgatcgccgtggcggtggccttgcagacggcggccgggcggtcggcgtgggcgcggcggaaggccgcggcggagacggcggagctccaggccgagcagacggcgaggcagcgcgcgatggcgcggggcggcaggcggagcaggatctccaagagcagctcgtcgggcagctgctgcacctgtgcgtgagtgcccatcttgtcgtcgtcgtcgtccatggtcggcaggtcaggcattttccttcatctcgtatagggccgttttggtttgatgccaaaaacataccctaccaatttattggcaaattgaatagtttgtgtgttagtttggattgagactaaatatttggtagtgcccctaaaatatttggtcatattctagaagtttcttcactatgctataagaatttggctttaaattggtagcaatccaaatgttagctaaataattttaccctaccaatattttggtagtgccaaaattttcctagactttggcactaccaatgaattggtagggtaaagaaccaaacaagcccatagatatcaaagccctcttgcagagacaaatcaatttcaccccatagatatcaaagccctcttgcagagacaaatcaatttcaaatgtgccgagattagatcaaattcaaatgtgccgagattagatcaaactgtaacggaacttatgcttcattcaggaataggagcatggttagaaatttcagccatttcggatcccccgatacgatattatttcgaccaaaatttttatttttattttgtgaatttgataatattttgttcaaatctgactaacatttgttcaaaatttcggacagaaatttccttatactggtgacctccaatagaatcggccaaaccaaaaaattaaaccatgatcaggagtcctaaacttgtgggaggattattagtcctttcatcgaaagaaattaaaaagaagttcatttttgtctcaccggaacattaccatcgagggccgtcgcctgacatcagttagaagaagagggaagtgcagcttgcggtcggtgacggcggaatctcgcgggtgggagaggcggaggcggcggctgctcgtgacgacggagatgcgatcagcgaatgacgcgagcttatgggtggaaagggccgggaaatcctatccccctgggaagtgatgtggatagggccggtaatttcctgtcccgtgggcttccaaaaatgcatataatctagttcgtgaatgatttccttgtggaataagttcacctgagatcccttaacttgtcatcgaatccgattttcgtccttgaaccccaaaaccagatacaacgggtccctcaactatcataaccggtgcaaataaggccctcgatttagatggtggtttaggctgacgtgacagtgatgtggctggtttgacttggtcctcgtcctatgtggcagtgatcactaaaagcaaaatattaaaaaaaaataaatgtggggcccgcataccagttagactaaaaaacaatgggatactcctcttcctcagcagatggtggggccaaaggcagcagccgcccatcctcttctctagcgcaggacggcggggccaaggcggtgctcggccttccgcttctctagcgcgggcggacggtggggccaggggcgccgccccatatcctccatgcgcaatgttgcagcagcctttggggcagcaagaagacggcgttcgagcgggatggccggcgaggaggtggccgcggcgatccatagcagcaagagacggttgtggtggtagtcggcatgctcagacgctctagtccgggcctccggccgctgcccgtccggcgacaacaaggataaccctcttccgtgccaacttcggcgacgacgactgcccgcgccgatgctcctccgtgcgatgacctagaccctgtcggggcccaagctctgggattgcgacgcgcctggtggttcagaaaccaccaccggccaccaccaccaccagatctcccgcgttggctggtgagggggacgcggccaggtcacgctgctcgacctcagtcgctccgccgccacagtccgctgtccagattcgtgctccacctcctctcatcgtcgtccccgctaccttcctcggcccgccgcgtgtgcgccgcgctcgccgaccgtgacgagcatcctcctcaccgtcgacaccatctcctctcccaccggccgccgcagctagggccacctcccgcgtccccttcctctcccgccggcccatgcgcgtcaccgctcctctcctgcctcggccgccctctccgccgacgcggcgctcgcgttgtcggtcgccctctcgtgtcggccgccagataccagcttctaaagaaaaagaagaaaaggaatgaaaaagaaaagaaaaagatagacagagagaagaggggaggggagagtgaggatgacatgtggggcccacgtgggtcccaccttttctattatttttatgtctaaaactaacatgtggatcccatcggttttattatttttctggatcgaattgccacgtaagcgccatgttagagccacgtcaaatgaagatcaagtcaaaccagccacgtaggcgccacgtgaaccaaaaccgccatctatattggttttgatagttgagggacccgttgtttctggttttggggttgaaggacgaaaatcggattcgttaataagttaaaggacctcagatgaacttattcctttctttgtaggcctcctttttcaaggaatgggccaggtcctaataaaattctggatcccttctacatgtcgtataaccaaaaaaaaacaaatttaacagtcaatatctaactagcttagtttaatttatttgttttccgttatgatatatagaagttaaattttaacttgcatatttatagcgtgatatatcatgtgttaatatatcttctcatattttttttcactaccatttgagtgacatatgaacaacgaagggatatactttcgagagattagatagtttcccattataaaaatatgttatcatctccaactacacagaagacttgctaaaatagaagagagggagaggaaagaaacaccgttctttcacgcgcacttgcaccgtgcgttgcatactatagtcctatctagggctgtcaaaaaagctcgaggttcgcgagctattcgagctcgactcatcctaggctcgattcgagctcagctcgagctccaaacgagccgagcctgagcctgttccaaagctcgcgagctttgtcgagccgagctcaagcttctaacgagactagtaatttatgatttttttgttgctatttaataaattggaagatcaaatatgttatttgtatgccttgtattggcagcatatatttattttattctttttcctcttctactaatatgataaaccataaattattattttttaaaaaatatcctttgaaatataaattgttctaattaaaattcgagctcggtagtcgagctcgagcttggtagtcaagcttgaaccgcgcctgtttgaaaattcgaacattttataggctcagctcgagctcgataggctcaagcttgtatcgagctcgagcctaggcaggcgagctcgctcgagctcggctcgttgacagccctagtcccatcttcaatcgggaaaccaccctcgaattggatgcgtacaatcgtgagtttttgttgtgggcaagtattggaagggtgggataactgcaaaagcaccgcttctccatggatgcaagtggggtgagcaagcaagttttttcatgctcccccgttgaaaaaactcccctgttttcatattataagtcatttgatttttttagtcaaagttctttaggtttaaccaagtttatagaaaaaattaataacatctacaacacgaaattaattttattaaatttagcattaaatatattttaatataatgtttgttttgtattaagggactattcaaattttgagtatttgaattcaaattagatatttggactcaggaaaatatgtaggagtcaagcatgggacatcgaagtgggaggttgatatttttgaaatagttttatatttggggcttggagaattatttgggagggatttaaggagaaaggaaataatcttagaaattggggttcaaataaaggaattgaatttggaattttccttggagttggaacaaatattcgggaaaggattcaaagggttatagagatagatagagcgagggagagagagagatggatgaaacttgagagtttgaattcaaattcgagtatggatttcaggagacccaggagagagtttagggtttggaggtgaattgttgaaccgaacttgaatttgaatattcgacgaaatttgtggatagggttttagtagagaaatctgaatggaagatattactttggaacgaaaatttggaggggttgatttttggcatcatgaagacataacaaaggagggatttaacttgagatctagggtacaacttaagctcaacactcaaagaacaaaattttcgtatatataattttattaaattagtttttaatgccacacgaaaattggggtgttacagcttttagtaaattgatcaatgcccaatgaatagtccacattaacttggtatatcgtgaaataaatatgtataaatactaagggaatgtctatctaacattcaacagaaaaagtccccaaaaatatgtcaaatgcagttgcaccgtaatataattaatatataactataatgtaaatagaatgtaagtactccctctgtactcgtaaaggaagtcgttttggacagcgatacggtctctaaaatacaactttggcttcttgtttctataaaaatatttattgaaaagtgatatatgtatatttttatgaaagtatttttcaagacatatctattcatataattttaacattttcaaactcaacaactcaagagttattcatgatttatatttctaaggtttgacttaaacattttcttaaacgacttcctttacagatatggagggagtagggtgcaagtacagtaaacttggcaaagctcaaaggctgcgcgcgcgagggggaggtcgcgggttcaagacttagcaatctgtagttgaatctcagatgaaatcattcccccccccccccccaccacacacacacagagcacgaatctcagagtatatttctacccaaaaatctgtcgaaagttttttttagcaatcccgaatgctaattggcaacaaatgcgatggaacttgatctcgtgcgccaggcatgagctcgaacacgagcacctgcagctgcaaccagccagtgcaggacgacggagcgggttccctgcatcttagagagatggatgttattggcgcacctacctattcgccttcctaaccatgtcggattctctggaggtagtaggcagtcgggagaaacatgccggattctaggggaaggggacctgcggactttgccggaagcggtgcagggggtggaagcgcatggccgccgtcgcggctggcccggggggagagacagtggcgcaggcagtggagcacgggttccagagcatgtagcggaggcttcgtaaccgcgctcgacacagagacagaccacacgctgtctcaggagccaaggaccagggtcgatgtactccccagtccccaggcgaggagaccttggacgttaccgacggcggcacggcagaacgagttgaagagcacgatggtgtatccaaatccatcggggaatcagttaaacttaataaaaaaacaccctatattttaaaaagaaatgtctgaaaacccctctaaactttatatgaaaagtccattgttaaattaggacatccaacccatccaactttataatacagttcacttcatattaccccctccaactaaggctttgtttgacaaatgtgattgagaaataacatctcaccctccaaaagacaatattgcatcatagtcatccattcttcacacctcatttaatcctagccattcatccatttcactttcccaatcccacctctcaaatcccatttaataaacataccctagccattcatctctcaaatcccatttgccaaacacacctaagcttgttaggttgttaaatgaatgttagtgtaaagtttagggaattgaatgttcggttttaaacttcagaatgctagatggactttcaaactaattatagggagttattttgactttttttttctattttaaaataggagggagtattaaaacaacgtactcacgtgtattcccagtacgccattctatcaaagttgtatcaatttttacagttgtatgtatatcttattttgtgaagtgtcctatgaaagatactttatcaacactttgatccatttcggatctattatgtagactagcctagatctatgaaaacattgccaaaattgtctgcctagcaacttttgtttgtactagttcttttccggcaaaaccagtcttcaaaacccttcttgcagcctgtgcttagagcacaacttttctagaggaaatttgcagtgcgtatatgcagattgaaaatcttgggtaacttcagtgtaaaatcacattcaaaatagcgccactgtgtccattagataacctacgtcttacacgacatatttctcatacagaagtccaaacatggtatacactgggtatctagtcgacaaaaaccacaaacatggcacaagatgacccaggaggtatcagtgtatcatatcttgccgtcgtaccttgtaggatgaggatctccttacgactcacattgcgtcgttatcgtgcagaacatgtttacaaatcaacatggttattacctgatcaagtaaaaaagagtcaaatcagtatagagagtagagagtatttgtataaatccactaaaaagtgtttacatcaaacctaagaaggaacgtgtagcgcaaagcagagcagagctaggtgcaatcatgaaaccaaattggttttacaacatcaaacaacaaagaaactgccaactatatagttcttaattctcttcccttaattgtttttgatgttggcagcaaaaacaggacaaaataaaattcaagtaaatgggaagggaagaattcactcaagattaaaaggtgacaacacttcgtgagctgtctacacaaatatcttctgttctgagttctgaatttctttctagctgtttcgatgcccaaatcaaagttgttgcaaacttgcaattggatcatattctgcagtagatagtactacccaggatgggtatatctacatttcacttgacataacactaccgctgaattctttatctaaggagcaaacagtggcggagttctttttcatttcttccagcagcaataagtcaaaacctttgggcatattcatttcagatggtgtaacgtggcaacagggtgacttacattagccgtatagaagctggccctgtaacagcagcaaccttctgagccttctgtgtttcaaatttgtacaggcctttcagctctttctttgctttccgtgcttctctcttctcttctttcactgcagcctacatgtataccaagaaacagcccagatgacaaggatgttacacataccaataaacaatttaaaaattattaaaacaaaaaaaagtggttcaccatattaagccgatttacaaatcattttacaacactgctccagctaggaacacattgtaatcttgaagaacacttatcaattcaacataaccaccaagaaatacgctaatagctaggcaactgttgtaccataaattaacgctagtttatcttgaaaaaagtttaaactaaacttgaacctacagacaacttaaagattagtacttcaagatttttatactacaaatgatgaaatgactacataggtcgcaggtataatgcagcatacatttggtcaaccgttgaagcctccaaatgaatcaaataaacacaattaaaatgctttcccggtattctctactgttttaaggaataacagtacatgattgcaagaatatcctaaaaccactcttttacctttcttgctttcttttcctcctttgtttccttttgagctcctttcttaaaactttcagcacttggagtttctgttggctttgctttcttctccttctcaccatttcttttcctctgtggtaggtattctactggaagtctctctttgccttgaagcctgatgatatctttcgttgtagctgtttctccaggaaaaactttagggagcctatttttaggatttcctggtgtttgaatctttccaggatggttgtcaagatttgagtatgtggaaacaatagtctcacagtcccaaacttcagactcatcactgctttctgaaacaagtacaacttcttcctcttcagcagtttcatttaaatacctttcagcatattcagcacatttttggattacattagcagattcatccacctcctctgctgtgcttgaatccaattttctacgaacaaaatctgccggcgttctatattcttctgtgacagatacattttgactatggaacagtttcagttcatcaataacctcagtaggcagttcacattccccatttctaacacctggatcatcatcatcatcatcactgtcaccatattcttccaaagcaagctgcaagttgattcacaacaagtcagaattgggcataccatttgcgattcgcaaaacaaacgagtccaaatttgcacgatgaacttctaatcgtagaaagacatgactgattaggcgtctggtgatgattccctcaattcataaaatacatgtaattttggacaatgggacactatctagaacagtagtttgaccactaacttttagtgcattatgtatatcagaccgtgtaaaaagtataatattcaagaaagttcttgagacaaatatactatatagtgtattgatattcgaagtttcgaaagtcaactggatgcatgtctaaaacaacatacgcttccaactagagggagttgaacaagatacagcatccggtatggtatgctcaattagtttgatgaccagcattatatatgaacacagtcatccattatgcgtaatcttcaatctagaagcttcagatctaccatctacacaatgataaaaatatgagtaaatttcacaaaactacaggtattttgaccaaattatcacaaaactacagatttaaggagttgtatcacaaaactacacatttagcaccaaatttatcacaaaactgcagattttaggttaagtatcacaaaaatgcatatttaatattgaacttatcacaaaactacaacttttggagtttaaatccctagcaccattgttatgtggagctataaacattattactttgtgattaaattggttctaaacctatagttttatgataatttagttactaaacatgtagttttgtgacacttcatcttaaatgtgtagttttgtgataaatttggtgttaaatgtgtagttttgtgatacactgagttaaatctgtagttttgtgataatttggtcatagtatctgtagttttatgaaatttactctaaaaatatatatttgacaagcacataaatacttagaaacttatgcagctataagggtagtcccgtaatatgcccctatagaataaaaggaaggaaagttatactgcccctataaaaatggtgtatgtgaaatcatactgaaggaaacacaaaatgcaaacgaagcataccaaatcaaactgttcatccagcaaccgccggaccctcggcttgggctcaccctcatcatcctcaaactcctctttctcttcaacatcacttaagaacacaccatccatcactttctcctcttcatcatcatcatcttcctcctcatccccctcagcccggtttgccatgatgacaaaatcctcctccagtccctcatcctccgacccgccatgggagacatcggtctcgtcgagcaacctcgcgatgtcaggatcaaccgccctctcaatccgcctcacaggcgctgtcttcgcggccaccttacacatcgtcctcccctcgtccatctcatcctcaacattgccagaagcaatccgcaccctactggcatcatacgcctgcacgcccaaaacaacagcatatcatcctaagcatcagacaaccgaatagcaggagaaacgaaaattggggtttcgggaagggaagtcgcagaccttcacgtcgagggggagaggcggggcagtctggttgggcgcgaaggatgaggcggcggcggcggcggaggggcggagctcgcggaggtggtggaggtaattgtagccgtcgtccgggaggccgagctcgaggatctcgcggcggacgtggtcggggagggggccggaggcggaagaaaagtgatcgccggcggcggcgtcaccggtgagggagagggatgaggagtcgaaggcgtcgtcgtcgccgaagccggggacggtgtagtcgttgctgtcgacgcggacgaagacgcggtcgttggggtcggcggcgccggcgcgcgggaacagccggaacgtggcgaagttgcgtggcttgcgccctcctcctcctcctcctcccatggcggcggcggcggcggcggctggctggattagggttttggggatttggagaggagctcgtaaacagaaaagacggtggcgaggagagaggaaattttgaggcgacaagacgacaagtgcgtgttcgttcagcccatttcttcgagcggattcggctcaatagtgcgcataatttcggcccaaccacgagcgttatttcggtccagaactgctcgcaactccggcctaaagtggagcgtaaatccagcccaaaaatgtgggtaaattcagcccgtaattgtctatccgttcgtttaatttaagcccaactaataaataaatagtgttcataaccggcgtcatggcgatagcggatatgacacaattttactatatatttgtcaacaaattttctcctaaaaatttaacagatgtaattacagtacaatcgtagtgtaattacactataacttgcatgtaattgcactgtaactataatgtaactttcaaaaatctctctgtaacatgttatttcggtaaaatggaggtcgtggaaacaaatcctttcacatatgtgtgtgctgtaattttttttcttcctcaccagaacaaatcttgtaatagatctaatgattccaaattacgtgaaacttacatacaagttacactacagttacatgcaagttacagtataattatactacgattgtactataattacatctgtcaaatttttaggagaaaatttgtcgacaaatgtataggtagtcccgatatgacatagcatgttggaactaagtgatcgctttttttaaaaaaaaaagtacaaatgacaactatttttgtttcgcgggctgctatagcataaggccattttatataactactaacccataacaaatgacgagtttattagttgttttgtctcttaaaaccttgtattcttgtgagtcggaacatataatgagtagaacatcatatatgttcacttcttaatttaatttgagttgaaataagacatcaactcttcgattgctactaaatctatatttatactcagttatatgagtattgcttctaatttgtttctcagttgctttgttaatgttttataagatcattattcatggcatatactcaaatttatgcgtggttattaaatgttgctattggaacctagcgtccgctataatgctcgttgtctgcgattcgctacatagatatcaatctgctactgactcattatgtgctatttattactccttctgtcccatgtgttttttctgtgtccaacgtttgaccatttgtattatttgaaaaaaaaatataaaaaaataagtcacatataaagtactatttatttttatcatctaacaacaataaaaatactaatcagaaaattattttaaataagacggacgaacaaacattgaacacacttaaaatgggacgggggagtaccttattaggcctccttaacaaacttcttgtgggctcgatttcttcatgattttccgtagcaccaaaaattaatgcaaattttggcttggagataccaatccctcatgtcacgcacacgatgttcccgtggatggattattagtccttagattagtgtagagaaaatgttttgaaacatctctctaacattctaatctgtagtattatactcatcctctgagagagtgactgctgactgaatactgtcatacgtactgatcaatgtttaatcaggcttcacctcgatctacgtaatcaaaagtcttcgtgcttgacctctgatgagttcagagaaagtacatgcatccacgttctcgaagcaattaacaagagcgcgccgcatctggattcttgaaaaaaaaaggagataatattatgaaacttaacgagtaatcagttaaaggttatatattatcctgtgcattactagggacagattgcaggagaagattagaaaaaggcaagaggcggctgattgagacaaatcgttatcgctcaaaataaagtgcactgattctttataagattgtgatcggcaataaaatatttattcaacacacaatctctgccttgagagaacaaaacactagctgtaatttttttataatcccttctgattatttaatctcatatatatatcagatcaatcacccagaacaactcaccaaaaagaaatatatttacaaaagtacgggtgatctgacaccgccggcttacctccgagaagaacaaatgtgaaatgcgttctctaatgcaaagcattgtgctcagagagagaaaagaaaaaacaaagaattcgttaaagctgttgaccatttcagcaatttaacacactaatcaatcgaattggaatagttacgacaattagtttaatttgcaaagctcgtataatgacgcagatcgatgtcgatccatactgattcaattatggcgagatacacgcaacctccctttcttagcatcaaagctcctcaccctctcacctcacctgctccacttcgtcttcctcctcctcctcgcgctagctcgatcgatcgcccgccatgtcgtccaaggtcagcttgctcttcctctcttccacttccagttcgtcgtatatggctatatgcattgcgattatattagagacttaatcctaactgaaatcttgcagaagatcgtgatcaaggtggacttcgtccgggccaagtgcaaggccgtcgccatgaccgtggtggccaagatcccaggtactaatttgttggatgaatcaggtgcaactgcagcttgaatcatcatcgatggagctgaattgaattgaattgaattgattaattttgcaggggtgaagtcgctggcggcggacgatgagaaggggacgatgacggtggtgggggaggtggacgtggtgcaggtggtgggcgagctccgcaaggccaagttcgcggcggaggtcgtcagcgtcgagccggaaaagaagcccgaggcgcccaaaaagcccgacgaccctcccaagaagcccgacccgccgccgccctgcccaccgccgccgccgccgtgctgccccggctgcaactcctgccgccccgcctgccagtgcgccgccgcccccggcggcggcgtcgtcctctacgaggtggaggccgatggctacggctgcatcatcgcctgatttttttttctccttctctgattaattaattaattactactactcgaccattgggaccattttctcttctttttctttttgaaattaaattaagattaagcttcttggttatatatatatatatatatatatatatatatatatatatatatatatatatatatatatatatataaaatatacatatagtcagattgtcaagatgtagactttcttgtacatttcgctagaaaaaaaagtgataattaaggggggaaatgtctacgtacctaccaatggtatgggtgtttttcttcagtgttgatttttttaattaattattatgaacttgcatgcatgacactaaacacccatccaggtagctagtatcaaatgtattataattcacattgtagtattgtacaaaaaaaaaatcagaaataatgttatggttcatgatgggcgaaatcatagtagcacaaagataatgatgaattagggggttagttcaggatattatactagttacatgagcaaccgtgtacagccagcgtgatacttactcgaatgcgtttgctttgcaaagtcagctgggaatccaagatcccattaatattaattaacaagaccagctaaccagtcaagtatttcttggatttttttttatttttttattttacaaagagagcagcaaaatttgattctgccagttggttggaccttctgcagttcagagattggcagctacattatgcaggacagtttgatgaagtggggtctgagatgccagatttatgaaaaaaaaaacggagtcaaaacgttgtgaattggaaggtgtttagaagtagcataaggctattcccaacccaaaacactgacatagtttctataaactccacatcatcaaaaaactagtagtaggcaccactcttccaatacaaatactactattctatacataaatttaatactacttatctcacatgatgtcttagatgttgtgtagaaaccatgtctcatgcaagacatgatttccttctcttttttcgtttattcacttgccacatcacttttcatcctatgtggcagcttatttaatactatggacaccattctagttattgggttgggaatggcctaatggcgtattcttggtgcaagagagaatttaacttctgctgcaattggagatacatgtgctaggccctgtttggtccttttctcattctagattttctttgcgcgcttgcgtttagtgttaaaggttatataaaattttcttgtaatagatttctaaagcaaatattttaactttatagtgattgattcattcagttataccctcaaatagctaccataaaaataattcatcattttcagctatctaaaagatgaggacatatattttcaatctcgatgtcacaatcttaacgccaattcgttgttgtttgtttgcacatgaagaaaaaaaattccaaactcaattttagttcagaacaacatcgtggattatcccccaacaggtttccaaaatttctaaacggtgtgatgtttgtaaaacctttcaacggtattacatagagaacttcaataaataaacttctcaaatttctaatatttagggcccctttgaatcaaaggatttatatagaaatttcataagattcaaatcctataggaaattttcctatttggccctttgattcaaaggatcgaagctttccaaattctatgaaattcctatggaatggcacattgcatgtggattttggaggaaatttagcaagagctccaacctattggaaaatttcctttgagtctatctctctcatccgattcctacgtttttcctacgctccaatcaaacgaccattcctatgtttttcctgtgttttgcaatcctctgttttttacacttcaattcctgtcagaatccaatgtttttcctattcctctgttttttctaccctacgattcaaaggggcccttaatttattcttgggtgcccttaaataatgtgacatgaactcagtttcattcatcatctatcagctggttcgaacttttgacttgaaatgctgccaaggctgtgtatagttcacgttaaaattaaaagtttgattgaaattggaacgatgtgacgaaaaaattagaagttttgatgtgatgaaaaagttaaaagtttaaagaaaaaattgggaacaaccagacccaacttacagaccaagtgctgtagagtgtagtcgtcacagattagctcgtatagggtcgtacagaaaccaaattaagtacaactatctagtgggtgaagtacacacttggtcaatactgtaacagcctctactcttccctgcatgaatcatactacaccaagacaaaattatggacaatagtacactacggcataagcatgctatagcttgtacagttgtactctgaaaagtttggtgcataacgaatccagccttttcagtacatggataattgatcgacgtcaccacgaacttatcctaagatagttttctaaggagcaggtagctcaaacagtcccaaaagtacctctttgaaaggaaaatagcaacagacttgtatatcctccctcctttcctaaatgtttgacaccgttaacttttttaaacatatttgaccgttcgtcttattcaaaaacttttgtgaaatgtgtaaaactatatgtatacataaaagtatatttaacaataaatcaaatgataggaaaagaattaataattacttaaattttttgaataagacgaacggtcaaacatttaaaaaaaagtcaacggcgtcaaacattttaggatggagggagtatattttaatctacaatttgcacgaatatgcaccaatcatctgtagtaaaaaaagaaaagaaaaggaagttttccatttccagttttccatcctatagagaagcggataacaaaacatactaaccaacaactcactgccggtacattttttagcagagatctcactgccggtacatttttttgtctagctagtaacaactccaaaggattcttagctcagaaagacaagtgaataggatagaacatggatcattcattcatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18536 - DNA, 746 bp, Oryza sativa
  unsure (1)..(746): unsure at all n locations
actggccttgaatgacgctcggctccctacnncgcncgcgttctatgaaaatatccgtccaactgaaaaaccaacggggccttagtttctcacatgcttccgtacgcctcaaccaattctgattctgaaaccttatagcgagatgcatctggacatacagaacgtacaaaggttcattgcacctggacgtacaaggttcattgcacctggacgttgtaaaaaccaacgaacctagccgcgcaaacgccccggcgtccacacaccgaaacatatataaaaccgcctcgtatcgtacaagacgccaatccacccgaacctgcaacggaaaaggaaacggctttgccggcacacggcaacaaatcttgttcgcgcccccgcgtgcagtgctcgtttcgatcgaggcaacccggcgatcgcgcgccgcccgattggcgtgttggatgggagcgacacggccgtcgccgatggcgtacaagaaggccacgccggtgctggacgagccggcaagggcaccgttgcgtggcccgttcgccagcggtgccgcgtccctccggcgtgatcaagacgacgacgacgacgacctcctggtggatctggtgcacgagttctacgacgacggcgagcccggcgcggacgccacggcgaggggcggcgtgtcgtcttcgccggagcccgagcctaccgagtggaaagacnctcttcgcgaagcgctaagcgacgcaacgttcgacgcgggggccgnccct

SEQ ID NO: 18537 - DNA, 2915 bp, Oryza sativa
tcaatatttattacatacgaatttcaaaactattaaatcagaaaaaaaactctttaatatttttaaatatccataagaatagccgtgcaatgcacagtttgacatctagttacagtaattacgaatatgttgccataagagagaaatgttgcagggtgtctttccttgttaatattaatccaatataaggtaatggatctttccttgtgcaaaagtcagcaatgcagaagaagaatatgctatttattttacaaaaaaagaaaagaaaattttcaatcatgttgaacattttaccaacagaaagtgaaacatctccataatcatgattcataatttgaaaacctgggttgattccggattgacaaaaacgtgttcagaggaaaatgctaaagggaagaagataattcactacaggtctacagctacaaaggaccagattgtggttgtggttttgttttgtgctgttccatggaatctagttagttaaataaatcattactaattcaagttagatttcctgttatccaaaatgcattcagctaactgttatatcagaaagtataaacgtttataaaaaaataaaacactgcaatgccaaacagaacctaagaaagctgtccccaaacattaaaacaaagagttgttccaggtatatcatgtgtatccatcgacagaacactatcacgttagaaggagtagctaaatacagcttatgaaaaatgcaacaggaaatgtggcataatcatagaccaaagtatatatggcaaattaactcatggaaaaaataaattagtaaaaagagagatcaatcttacccaaaaatccacagtgaaacagcaagaatcattgtagcaaccatgatccattcatttcttgttactggtcccatgttcttcagtttttgtgcagctattgcaggggcctcaggagtgtcctttatttcaggtgggaatattttgtataacaaataaggtgtcgctaagagagaaatgatggcaggcaaactagcaaccttaaaccaagatatccatgggtttgcaatcttaacaccaatctcctcagctaacttcagacacaagagattttgtgctgcagcagtcaggaagagagcacttgagttaccagatgcctgtgaagcagcagaaaccaacacaacaatgccattgatcaaatgcaatccttatgggtgtgaaaacgtaaaatatcaaagcacagagcatgcatacagttttaacatcccagaagcaatatatcgaaaagttttcactaaacatgccttttcaaaagaaacctagtaccaggagtttgtattgctttcagcatatagtaggatctgacaacctcaaaagtaaatgtatgatgtactcatgcacttaaccaaacaattaaaatgtttgtgaattcaatcgattcaacaaagtgttcaattcataaagtacaagctagtttggtttaaatgtagctcctgataaagtgaccaggcaaccatttttaaaccacacttcacttaggccgagtttagtttcaaaccttttcttcaaacttccaacttttccatcacatcaaaactttcctacacacacaaacttccaacttttccgtcacatcgttccaatttcaaccaaactttcaattttgggcttcctaccatttactatttacagaaagagtcagaattgtaccacgtctacaatttattggtttcagttttagtttctcaaagaagcaaagggtgcacctagaaacagtttttttttacctctgctgttgtgatataaactagtcagatgactgtataacaaacattatatattatcactaacaaagataagtcgcaaccttaataatacagcgtgagcatttcatcatacatcaagtagtatttgagacggatgggataatagaatgatcaatgcacattagtactccagtcaaatagtatagacacccagtccaaagcaaaagtaagtgaagatctcattcttagcacttcttcaataacatgtcatagagaccaccaaaaaaagaagcatgttcccagctgaacattataaatatctaggcgaaatgcatctcccatttcacaaccattcatgaatggagtactaattaaaacgcatagcatttttaacatctgcagatatcaagtaactttttacctgtaactgagactgcacaaggtaggagcccagcttcctcgccgatgggtcgttcggcttgctgccagccgaaagagatagcgacttgactattggaaggaacaccccaccggccctcgccgtggtgctgggcatcgccggcgcgatgcatgcctcgctgatggcgagcccgtacgacaagcccagcgtgctgcgccccaaccacttgacgaaataggtggccacacgatcgccgagtccggtcttcacgaacccccgggcgaagaagaaggatatgacgatgagccagatgacctcgttggtgaacgccccgaacgccgcggtgaacgggagcgtccgcgtggcgacggtggcagtgagcccgaggaatgcccaggcgccgacggggagcgggccgaggacgagcccggcgatggtggtcaggaagatggagaggagctgccacgcctgcggggtcacctcggccggccgcggcgcgaggaagcggacggcgaggccgacggcgagggagacgagtaggggaaccggctttgcgccggcgtcggcgccgcccgccggccgtgcgggggcagggcccgcggcctgggcggcggacgcggaggcaaggagcggggggaggaggtggcggcgaggaggggcgggcgagagctggggcgagatggggagcgagagggagagggagctggggaagggctgtatctggagatggcggcggcggaagtggttgtggtgggtctgaagtggaagcgcctcccg

SEQ ID NO: 18538 - DNA, 1932 bp, Oryza sativa
gctacgggtaggatttattttgtttgtttatatccggggagacgtaggtcaccagggttctactgacaggtggggcccattgctcgcgtgtaaaggtagggccgtattgtcatcttctctgtgtacagttggcggtgacagtggtcgatgtttttttgcgtgtatttttctttttttggtgggatatgatgcttttctgttcacaggccacggttttgttgcttcgggatcggcgtgggaccggatggcagtgagtcatagtcgtgagttggggatgaccgtgtgcgaggatatggcgtgatgtgccgtggcagtagctctgtcgtctgataaggattgtgtggctgacactccagatgatcgttattgtcgctcctactttaaaaattgcagtcgtgcgcagttacgcttgcgtaacaatggtagagtaagtaatttatccttaattcactcacccagataatcttcaattatagtatgagcctatctctcgggatgggctggcaaattgactgcaatcctaacccatccttgggatgaatggatataggtttatgccaaacaaagcataaaaaaactttagagttttcttgcttcacttgggagctccttgatattttaggtgttctattaagaaatccttgatattttagcaactactagtctctaatattaggtaacttttacctccaaattttctctaggatattaaaatccagagtgaatttcagaaaaccccacgttttgaggctaatgtaacacatacccacaggtttcgtttattttctcacataaccccgtgcattcaatccaattaacataataccataggttttagtgagagaaagtgccacaagggcaagtgacatggcaaacttgctccacatcagctggccccacctgccaggtcaatatgtggcctattatggtgggatcacgcgggagaacagaagcgtgtgttccctgttcctacgcacacaacgcggcacctccgtctttcttgcgtacgcaggcggtggcgacgttccccaaccatctcttgcatgatggcctccggtgatgatggtgatgttgacctagctggaggaagagaactcgttaggtatcattcctagcaggtaacattcatctcttttcttgtgatgatcatatgaattgactccaaagcatgttggttggtgatttgcaaggacactctgcttcatggttctttgacgaggaattaaatccagccatttgatcatgtttggcttgtcaagaaattagggctagtaaaatgtaatttaggggaacccattattgttagggcattacaactttgcaatcgttcttctgtttgtcattgcaaaattgcttttcatcattggaccataatttttcaaataaaaaaagcatgtagattggaccgtgtataagactattctattacaactattatattgcagtcagatataaaactaaccataattaacatttaaaggcctgcaacatttttttctgcttcacaaaagagcagacatggcttcctcttttttttttctcggcaaataggttgtatttttctctgcttcacaatgtatatatttcagatatggattcgttttgcaaatttcttatgccttggacctgcaatgggtcacatattaactgttgctatggtgcttttattcagacatggaatgtttttataacgtttgctccattgttctgcttaatgcatagaaattgtcagtttttttcctttcatttttttttcataggaacacagtgtcaggcaccttggtgatcgacctacttacaaaaaactcgagcagaaacattgtcaggtcctggccatgtttaatcaaacacacacacaagctttgtatattagaagataggaagtatatggacagtttgatcagttgatgcaaaacagaacaggcgatgctt

SEQ ID NO: 18539 - DNA, 1206 bp, Oryza sativa
cttttcctgtaataaagttttttcggtgttcctgtaaaataaataaaacagtacgtgagcaacgaaatgcactgcaaccccgggaatgacacagctctgaaattatgaaacttactgtaagacaaccattgcctgatcaggcccaagcccattagcgaggtgggtatctccccatgtaagttgttggcaacaatagtcatttcaaatgttgccataccatcatcccatcctggctgggaaggataatttgaagtagctgattattgtttgtgacctgacaatggatataagtcaactatgcactattacgttggtactgatgaaccaaaaactaaaactttttttttctatagcaaggtatctgatgacagggctttctgccatttgacatcatgaatgtatgagattgagaacatgagaaaacctgcagatagcccccatttaagagcttgatatgaagcattgaattgttcctttcgatgtaaaatgattcagtgtctcctggtgaatctgcagttgctgagatcacatctccattacttgctgttaaaaactgacctttgatgcaccggaattgatattcacggtaagaaactctccaaagctgacaggagcaccaagaaaatgcaattaggatggaaactcggccatttattaaccagtgactcaagcacttgatggtcttgttgattttttaaataacactttgatttctagctgtttcctaacttcaggaacataagtagtgcattaacagaaaaataagctatgggcctaaaaactgatgaagataatgccatttttcatgcagctttcacagaatctccaagtaggaactgagtaatatatgcatatgataaaaaaatatacgcgtaatatcgatttatgaatcgtcaaaatctttagcattgacacagaaaagacaacaaaccctgaaggtctcccatgttgaagcaacatcctgatccactgtcaagttcccgccgccaccaccatttgcgctcaggtacttctggagccccactgacttcagctgcacctgagtgccatcctgaggcgaaaatccgacagtcacatgagaagaaagtaaaatgcaccgacattgccacaacatgagctccaaacctccaagaaccagagagcctacaagcatgttcccgtttgagatgccatcaaacaacgaaggcttgatccacccctccacca

SEQ ID NO: 18540 - DNA, 471 bp, Oryza sativa
gaaatgggagttgctgaaggtagtagtgaagaaatggtagaggctgtaagttcgagaggtgaccaagtgaaataggcaaaccatgtacagacggaaacaagtatacttctgtaagtaatcatttcatccgtgactgctgagttactgtatttatgttcctatcataacgtttgcatacattcttgtttcctctgaactctgtagtattttagaacaataaagattctacaagggtgtgttttgcatctttgtgttgtgcaattattttattaatgtttttaacctttctgcagtgttttggaacaagacagaagatggtttcatttcgtttatagaagattctttcagtgacatgctgatagaagtgaacataaaggaaaaaactggagttttaccaaacattgcaactgtgttcgttgaaggaagatccttcagaagttgcactttggaagattggtttcatacttcata

SEQ ID NO: 18541 - DNA, 378 bp, Oryza sativa
cgactacaccgcttgggcgaagggcaaaaccttcgaggctaacgacacgcttggtgagtctttctcgataatcaatcacttcattcgcacaatgctgctaaatgctaatgctatccagtttgccaattggcatttgaaatcgaacgctgattttatttggtgtaattaactgttttttgccttttttgtttcttcagtattcagatacgccaggaagcagcacacggtgacagaggtgaccaagagcgactacgacgcctgcaccgtcagcggcaaaccgatcagtgatttcgaaggaggcgcgcttgtgacattcatagcgctcagccccggcgagcactacttcatctgcaaaatcggcaaccattgcgccagcgg

SEQ ID NO: 18542 - DNA, 5809 bp, Oryza sativa
  unsure (1)..(5809): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcggggtcggcttcaaagcaaggacagagcgtgaaggccgtgagttgtttctgaaacttggttacagccacgaggtgcagttcactgctccacctgccgttcgtgtcttctgctttaaacccaacttaatatgctgtactggtatagacaagaatagggtacaccactttgctggcgctgttcgaaacagtaaaactccagaagtatacaaggggaaaggcatattgtacattgatgaagttataaagctaaagccagggaagaagcaaaagaagtaattaaatttgatttttagcctgctaagatgctctgtagcacatttttagtggcgcttatgttcttactgtttcattgtgttggatcatctttgtcccggtaccatacttaaaggcttaataattcgctgtatgcaatgtatgtgaatcatatgatgaaactgcatccaaaccattgggataatccaccatttccgatcataataactttcaattgtttttttgttgttactatactatccagcccaactgtcctagacattgaactcagtgtaaaacaagcttagatctttgcatttgagggcgttttttttttttactctgagctaatctgtacctttatatgtatgatgttatttgtgatagtgatgccactaaaggcaaaactcaaaactccgctcgcgaaatttccccatgaaagtaatatcttactctatttggtaaatggagtcatgtagttagacttgaaaaacatttagcgtctaatatgcacaaaaatatgaaaatttgtcttgtaaaactgaggtcaatagatttgggcaaatctattctcatatctatttgaaaagatgagcatttatattttttttagttgtttagacaatagatactacttttgaaaaactcaaaaacttgttcggcatcgagctacattgtagcatcacccaaaccactcttaatttgggccaagtttatagagtgtaagtgtttaataccttagtatttgacaatatctgaatttgaaattcatgatattttttttccaaactttaagtaaagcccagcactataaagcatactgtttccctgttttaatatatttttattaatttgttacatacttttttcctggttttaataactttaatgaacatatgagaagaaaaagtagccctatgtgtgtcctgaattcctgattgataaggaaaaatgaaggacgacagtaccgcctaattaagcaccggatggtgatttgacggaaatgtcaaaatagcctagatgaatgtacagggtagtaggtacaagtatcaaacagccggctgatcattttccataacatatttttgtcaaaattttgaaagtgaaacgcatgactaattggaacagataggtgagttgtccaatatacacgacgcttactccttgtctgcatttacacaattagctaacctgctatcaaggaaaagcatttgttcatcaagtcaatattactacgaatttctccacttaaaagtctatcaacaaataaaactgaaaaaaaagcaaaaatactagtactacaggacaaagctcatcatgaaattaaatggtgtacccctaattacaaacgaagcatagaatcgcacaaaattgtttcaaccaaccataattttttttgcgactttgtaatcgaagaagaataaagttttgtgactttatgtacacacaaattgccgccgaaaagagaagagaattaacggtgacgacaaggacgccttcctaatattagtggagtacttctaatactttgactaacaatcagcgggacacgtcatcatacatggtcaccaagtggacgtgggcacgcgccgccgccgccgccgtcgcagtgttgctccacggaggcggtgcagtcgccggcgaccttggcgccgtccttccccggagagtcggcttcggcgccgcgtcgagcggagccccacgccggcagcctggccgagaacgtgcgcatcagcgacgacacgttggaccacctcccggactggccgagccggacgctcctcccggcgcgggcgccgccgccggcggcggcggtggtgcggaacgattggaggctcgtcgtgcggcgtagcctcgccgaggtgacgatttcccggagcacgtgatcggggagcctcagcgtgtaccgctccgcggcgtcgtcggcggtggcgggcacggcggcggcggcggcgagcgagtgccccgtggtgtgcgaccgcgggaactgcggcggccggcggccggacttgctccgcagcgcgcgcttcacgcttccgatccgcatcagctcggccgcctcctccctcctgatcctctcctccgtctcctcggcatccgcgacgacgacgtccaccgtcacctgctctggcgccgccggctgcggcggcgcagccgcaacatcttgcccggtggtcaacgcatgcggcggcgccagcggcggcggcgggacgccggcgtcgaaggcgaggttggcgcggcagacggggcacgtgacgtgggacgccagccacgcgtcgatgcagtcggcgtggaacgcgtgggagcacctgggcagcagccggagcgtctcgtcgtcgtcgaactcgctgaggcacacggcgcactcgagcgcgcccttgccggccttgtgcgccttcacgtcggcgtacgccatggtcgggaacgcgcccagcacggcggggtcaagccccctcaccctcctcgaccgcgccgccgcaaacgtgaacccaccacccacacgtccaccgccgccgccgccgacgccataccccccgggcccacccaacggcccgccggcgcatcgccggatgtagatcgagaagaacccgaggaagaagaaggcggtgaccaagaccacgatcacgacggccatggacgggttgaagctcttggggttgaagtagttcgggccgggcccggacgtcgtcggttgcgccgcgccgccgccgaccagcgaggcaatgacgacggcggcggcggcgaggaggaggaggcggccattgtcgccgcggcggcgtcctcgcggcgaccccatcggagtcagtggctttctcctttgcccctttcgggtggggcgaattgatgggagcttagctaaggcgggagggagagagtggcacggcaagtgttgatacgtgagaggacggggataaaaagggcgggagttaacgaggtgcagtggcacgggcaagggtttgttaaaccaccctgaaggaaaaaacggaacgtaccccgccacccattttcctgcacaaaatgtagattttagagggcggctttagagggatggctgaggtgtaaaagatcggtggtggatggtagtgacacgtagatggtgctagagccgtgggatatgagggagggagggaggtgggacaacatcgaaggcgagagcatcaaatgtaaagtggttatcacacagaagcgacggtggcgtctcggcagaggtatcagagaagatgggtgcacctcaccactgctcggttataggaagagaagggttggaatgaaggaggccagtttggtgggccttgctagtactgtcgaggcagaagaaggctatgcacagggggtcattggtggtggtggactggtgggtgaccgggagggggatggggattgcgtcagcggcggtattggggtgaaggaaaggagaaaggaggcagtagagttggggggtatcacacaaatcttaaagtcatcctatccattaaaaaaaatcgactagtgctctcttccagttgaccgactaataataagccttgtaatgtttcattttgaattcccacgaaacactacggtggatattacttatgtgggcaccatgggtaatatgtcatcacgtgtccaaagtgaccaccacatgtattggatgagtgggatccatgcacgcataaatagccactcatcctcggtgtatctatgatcgtgattggcacctttcaatattattaactatgatgccaagtagtgagtacgagagatattcgacggaatagtttatcggtcaacttcaacccaagataggcccatgaaaccactcgaaaatgtcccaggggacttgaaccaagatgctacattccacgatcatcttaattattcaaaactcttactaatgctttgctaggccctaggaacaacgactagcctcgtactttctttacaagcaattgataatcatcgtaaatgtacaaatatggataagaggtttcaacatattacaacttgccctagaattttttaggaatccaaaaactttttttttaaaaaaaacatatatttcaaactgccctggcggtagctaacatctagtctgcatatgaaatagagattaacaaattgggcagaatctttccaaaccgtttccgtttcaaagaaacctaagcataggtgacgagtaagatggggagttctcactaaagtctcatcatcagctctaattcaaagcaatgtttctaatattaataagcgtctttggaaattaaagataccccttaaagttaagatttttttctttgatacttgcgtcgtggagtggtgttaacaaaggataatttgacaaaaagaaaatggcaaggataagaacgattgtttttgttgcaatgacgagacaattagacatcttttcttcgaatgtcgttttgtccattttgtttgttccatcatccaaatagcatatggacttcttccaccgcattgtgtagcacatatattggggagctggcttgctggaatccataataatctaaaagcacatgacctgttaggagcgtctgctactggtcgctttggctatgcaggaataatatgcctttttattaaaaaaagccacatcttcaccattgcaggttatatatcatcttatccattggcttcatacataggcttttctatagaaacctgtttcgcaggatatagtgcttgcggtatgtctacatttggagaagttggtcagggagttttttacctagggatatgggtggtgatctagtcttaagattggtggttcttaatactccgtgcttttgatggagatgataaatgaattgttcatgggtgacggttgagtcttggattgatggccctcaatactccatatcattttttttctttttaatatggatttgtatgttcgactgtgtgtatcttagttatgtagagaccgaaagtgttctcagaaaaattgtataaccttgttgtaattaattcagtaaaaacttccattattaaaaaaagaaaaggtgacgagcaaggtacgggttccatatgcacgcacgtggaacatgccaagtgcagtgcagagaccagcatcttttcttccttaattgtactcagccatgctgtgcctgtgcaacagagcaaaagcttctcctaagtcctaaatcttgttctcttctgcttgttttattgaggcttgcagctaaggctgaactgaatcgacgacgaccaaggatagcgacgacgctgacgacgaccaaaacaaaaaaacgatctttgcgtgaggag

SEQ ID NO: 18543 - DNA, 469 bp, Oryza sativa
attttaatcaaattttagtcaaatttatcgttttaaatttgaattcttgaaaattatttgaaatttcactcagattttgctttcgttccgcgtcgaaacccctaaatttcatgcttttcgtaaaaaaaaaaacgtggagcctgactgccgaatggccgatattccggcagcattgctggcttgctgctgctccaccctagaggcctactagaggataagttcatgactgcaagatggaggtgtgcaagtgtgcaacccatcttccggtatcgttcaccgggacgtttggcgtatagctctgctaccggtggtacgcttttcaacgggcgaatccaaacaaaatggcgtggacgaacgaggacgacgcgccgtggaaaaagatgccggaaaaccgattcaccccctccccaccaccgcgcgatgccgccatccatctgtcgcacggcgcggcggcaaagaaacgacggct

SEQ ID NO: 18544 - DNA, 6346 bp, Oryza sativa
ctttacatttgaagggttctcaagccatgagctgtactttataaaactagtcatccaataagagcacacatttagcactcttgatattatttctcctttatgcacatcctctctaccttcaattgttgcagctggcacatcaccactgtaaaatggaagccactcgagctcttcgcaaactacctggaaggtgaaaaggtcataaaaacacaaaaaaggtgcatagcattgagagctcggtgtattgcctgcatactaacctccacatacagctgataagaactaatcgaagacaactgtggataatataacacactcccaccaataagatacctggatgattgtaagcttgttaaggtgagagctacatcataattacgcaagaaaacagttatactgtagcttatgtacagaaacataatttcatcgagcaaatggcaattcaaaattcgcatcattcacaccttacaatatcattgattgaatcatccagattggtaagatgattggaagacaaatatgtttgcgtacttctgcctaaagcaatgaaaaacccaaaaattgctaaatccttttccaaaacctgcagtaaggaaaatagttattttggaaggagaattcataaagctagacgaaatatcttttgttccaacctcaatactttcacttgttgtcaatcttgaccatatcttttcacgatcaagagcccgtagcaactgtttctgaaccagatcaatccaaaacgatatctccacttcccgatcactggaaaacttcaggtcagcagtaccaggaccaaaattgcaaagggattctctctggagaccaatatcttttgtcaagggatatgctttacttagagggacaaattcaagaagcatatccatgaatcgaccaatgatatcagggaccatggaaaagaactgctgacaagaaacttttgttgatccaagctttgtgatagcagcaagacatgtcaaacctagcataagtagagaaaggtcactttcactagtattcatttgctggcgttcatggcatctgcaagcaacaaaagaaaaggtatccgttaatgtattagttcatttatcaaatgaagcccaacagaagtaaacaacttacattgctgttgcagagttaaaccgtggatcgttttcaaaagagttaacaaatgttctcacaaccaaaggattttgatcagatgagtaccactggtacaatgtaggttcccttttcgacagctcattttggatagcaccctctagagaactaagtaggcgggataaactgcaacagaaaattaaatatgattaaataggagaccaagaggcatgttctataatcacaaattgaactgttatgtacaacatagaggttagatctgatttggcttcatcatgctgtcaatactatgttcatgtaagcttgactattgaatccagtagaaggctcattctgggtcaacaaaaatgcaaatacagcagaaacctgtagactctagcagtaacttttttttcccatgaatcaagtggatcaattaatttgcatgctcttctgacagcatatgttttattgacattaaaacttaagaaatctaccagtcaagaaatggaggaatatatttctctaataattaggctatagatggaaagcaacttatgagacaggaattagctccaagaaaacttaatatacagaggaagctacataaaatgtacattacacaccatttgctctctaaggtattaaaaagcaaaattggctccaagatgatagatagttgtagtcttaaaaacacaccaggagaaaaaggataatgtcagcaattaggcatgataatcaaggcaagtgctagagggcagacctcctctgaacaaatacattgatatctctatctctgccatttcccctagatgaaacatcaataactgcttgcaacaatgaaccgacagcagcctgcaaacagattattttagataccagacaataaaaagtttgcatgccaccaaaattcagaacgcaacagctaatatttgttttactgaagatttatgtgtgagaactaataaacatcaactcaaagaaggttcaattgccgcgattggctctaagttgattaaaagactctgcatcttcatatatgaaaataatactccagacaccagagcagaacacttcctctggtggcagagtagcactactaatatcctaaaaggggtgaacaaaagctaaccaattaatagtttaccaagttcaacatacatattcatctatacaggcatccatatttcataagacctctatggatgatatcctgactacatcatcttttctttttctaaacaaaaaaagggaaacagtagggtgcatgcaataaaatctggcttacaaaatttcaatactagttttctgcgtggaaggccaaaagggaaaagtcaagagaaactatttaatcaatgacatgaataatggtcactatcattttatgggcagatatatgcctgaagaaagttcagtcctgtacctggtaagagagtggttttatccattcattgttatccacaccaagccattcctttggaaaccaagagttttttgatgatttgctgtgatctaagaaagccaattcaatagatcttgcagcatcatgtattgattggacaaggccagtgcttatatcctcgctttgtagtgctttaaccaatttcacccttatatcatccatctcgcttgccgaatcaacttgtggggatccgttaacagataaaccactgctatcatcttgagaagccaaaggaataagatggattgtccttctagttctctgaaatgctaccctctgtctcctaaattctagccatctagcactgtgaatgatcttctcacattctgatgctgaactcctgaaatagctctttctcttataaacacgtgtatgaaatttttgactcctcagatcaaccacacttctgcatactaatctgaatccatatactttctccagagtgtaaatcttcgatgtgctgcaaacacgttcaaccatttgatccattataataagaaacagcaagaaaaatattattaacttcactgtacaatgaaacctattccataatcaaaaccagtagcaaacaatttaagaaacgctggcaagctactgttttaggaataagcatccgccgtcaaattgccactgaaagcacaatacgggaaacacaccgtgtgcataactgcaagcctcaacagaacagaagaggaaactactagtagtaaagtatcccagttcaattggccatgtcaaagctccggccgtcaaaaccgcaatgctatcgccatcaccaaaacggcaacctacaacaccaaatttgacgaaatccctcggcggcgcacgcccccgaaccgaaatcgcacagataacttagtgagccagtgacgaattcaacgaccctactacctctacccctcccctccacaatccaagctcgcaaccagcgcattccaccgcaacccatccacccacgagctaaacggcaacgactaaaccagcgaatcggcccgcagcaccgcggccagaaggagagagaggagatgggggtgggggggggacccaacctggcaccgcacatggccgcgcgcggctgcgacccaaccgccgtcgccatcagcctccgcccccgccgccgccgccgccgccgttactgctcgccctcgccggcggtgggatcgatgcgcgcgcgtcgcgacaaagcgatgggccggaggcggagagggatagggtttataccgggagggaagtagcggtggggaagcgagcggccgcgaggacggaggaggaggaggaggaggaggtggaggagggcccccggaaacgataggctccgggagaggccaccggtgctcgtcacggggaccagaccatctctctctctccccaactttctctcgtctcggtttttcctcgcgcgtttttctttttttctttctttttttttcctccttcctcgtcgactggagtactggacatttcgcatttttctttttcttttttttttttgcctcgcaccactgctgtcgtgataaggccatttacggcgttgaaggaagaaaaagaacaacacgtcataccgttgagctgcattcaaacctgactagctttgacatttttgttttatgtttagtttaaaattaactctttgaatcaagccggtagaatattaccttagtcaaatttgaacaactaacaagcttgttttttgctgggtctactcaagagagtgttaaagtcaaaaaaaaaattactcaagagtgtgctctgtgtttgtgtgaactagttcacatgctaaaattttagcacagaaaagaactgcagatataatggcatggcagattggcaggcatcacaatttgctgaaagaacactacattgtcactttgtacaccacgctcaaatagatgtccccacaaccgaaaatgaaacttatgcccaaataaaagaatcaaaactaagagaaagcatatccgttctttcaagagaactgattgaacatggtaggtacgtattcaggccacgtaatagagtgggcattatcatcaaacgacgatatgaaaccattagtaagttagtaagatgtttgcatatggtacatgtatgcattaagtgctaatagcattgcactttgtagctacagatacactaaacctatagagaaccatcttaaacacatatattccacctcaaacacataaatacacacacatacatataaaacaaaatatatgcatccctcaaaaaacattacaaacatcaaacatattacatactttaggcgtaaatgcttgggagaggtgcataaacatgcatcatatattttggataacggaagatcaaggagcgtaaaaacttttggcaggatgacaagtgcaaaaaactggagatacataaaaccaaaactggagcacgacgagtgcgcttaaaatcaaattcgtggattatattccaccgccttaagaaaaatgaatatagttaatctcctggagtttactcttgctcgctagcactgtcaatctgatcttgctccttttttatgccgccatcagccaaggtgcttgtattaccactaggccgggttccataaacatgccccatctttaatctctttgtttccatgtaacgccgattctcattggttattggtgtcaacagtggcactctgcccaagacactcaaaccatagcccttcagtccagtatatttcgcaggattgttagtcataagcctcatggttcggacaccaagatctcgtagtatctgcagagagaaaaacagcaatgagcggaatctggaacagcgtgaacaggaacgctatgtcacaggttcattttcaatagttcaggagtacagacaatttatatatacctgtgcaccaataccgtactctcgtgaatcaaccggcagacctagatcctcattagcctcaacagtatcccgcccatcgtcctgcaaattgtatgcacgaagcttgtgacccaaaccaatgcccctaccttcatgtccacgaaggtgaacagctacaccccagacagtcttctcaatcatggtcattgccagggcgagttgattcacacatacacctctgtttgatacacatatatcttcagtaagcccagccatatgcagtgtcattaagattgtttggcggtaaccctcttcgccctgcagacagtgtaagaatatatattctaggttcaacttcttcctggatgagaaagtctggtagagcttataacttaaatacaataaaagaaaccgttgcttcactactttctaacaatcattgcagatgaaccatgtcctgggtatcactgaatcattagttgcgatccagtctgactaatgtaacaggcaaagatatcttgttatactgtaatttgttcaggattttgtacatgtgattctacttttctatataatgcataagggcatggattttacttttttttatttaaaaaaagtaaacgctctcctaaaagtagacattgtatcaaagtacttaacatagtctttgttgagggatgcttaccttgaccatagcaatgtgctccatcccatcaataagagatcggtagcaataagattgaaatgatccccattgtaattgtaaaggtgtaacacaaacacgttctaccaatctgtctctcttcctcctatacctgcataagaaaattattagtagctgatatatatagtagccggaaagttccacaaaacaataatccatgtattataatttataattcatatcttccacaaatatagttttacatgtatatatatcaactgtgcttt

SEQ ID NO: 18545 - DNA, 800 bp, Oryza sativa
catgtcatcagaaatgacaacctgaaaaaatgttgcttcatcattattatttttttcggaagatgcccttttcttttgttatgatggctgaaaatgtacttagaaaaaaaataagattaaggactgagttagagtaattactgggaaaatgtcagttaagcaatcctcaatcatttaagttctcggtgtgttcccatgacaattgatgcttagctaacaatctgctcagatgattctgccttcagatcctcttccgttggtgcagcagatttattctttttggcattgtcatctttgaacatcacgttaatggatcttcccatcaatttctgtgatatatttcataggtcagaaatagcatcaaaacacaatcatgtattagaatttgggccgtacacaaaccaaaacttgtactatattttatttctaagctacatttcagaatacttaccgtgccattgaaggtagatatggcagcctctgctgcctcttttgaggaaaaggaaacaaatccataaccagcagatcgcctcggacttgtggtatggaagacaacttcaactgattgaacacctggggttgatgcaaataattcacgaagatggcgagatctcactctccacgtcagattacccacaaaaacgctgtgcttcggcatgggagctgatggcacaacatactgcttctttctcgatctagtaaagtctaccttaattgttctatcatttagagtctacaagagaaaatgagtagaaagacagttagatgacaaaaaaataaagagtaaaatgcaccagcgg

SEQ ID NO: 18546 - DNA, 15639 bp, Oryza sativa
cgacaaggaagaaagagaaaaaaagaaggaaaaagggagaaaaaataaaataaaaatccatgtcatcgtccacgtggcgtgccacataggcaagaccacggtcaaacgcggctttggaccgggatgatacaataaaccaagtttagggacctcgatgtgcgctttgcaaattcgtggacctaagtgaaacctgctgacaagtttaaggaccgctggtgcattttactcaaaaaataaataagagtatgtctgatacaaatagacattccttccagaacaatctagatcttacagtcgaatttagatggttgagtgctgaaagagcctcctcttctgaacccatggttacaaacgccaatcctctgtttctggtcgaattgtacatcgagagctagcaaatcaagcaataaaactaatcactaatgatgccatttatcagtaaataatggagaaagatccatttttgaatgcatcatagccaggtcagctggttaacctcctgatattaacatgtaaggcttaaaacatggaaatgaagctgcaaatagtgcagtttgcattggactactgagtcccgattcttttgcccaaaatttctgctagattgttaagtacaaaaatgactcagattcttcagttcacccttcgagaagaggctggcaagggaacacatcatccacgttagtagaaccattggagtctttcaaatacctggctcctacttgagcagaaccaactttgaaatgaacaatagtttaaagtctaaattggacattcttgcaggcaaatggaccatggtgtattggtgttcagatcgacgcgctaaacgcatttgtgttcttgtgcaaattcacgccatcctcttggcactaggatctcaggctctcagcaaccgtggggtgccgctgctgcctgcttcgtactgcggcgcggtcacagcgaattactgccactccaaattcgccgcacattccttctctctgaagcggacaaggataaggcgacggaaaacaatttacctcgacatcgacgacagagccgtgcttcccgaagagcgcgcgcatgtcgtccgccgtgcagtcccaggggatgttctgcgcgatgagccgcgtcctcggcccctcgggctcttccaccaccgcctccgcctccgccgccggggccaccgaggcgctagcacagcaggcagcgaaggcggcgcggctaccggacgaacaggcgaaggagacgcggccgccgtgaggcggaacggagtgcttggggaggcggaacaacggtgggtggcgcgcggcggggagcggggggaggcggacgagggggagagccatggcgatggcggcgtacggggcacgtgtggatatctgacacagagagcagtaggcaaacctcgcggtcgcggggaggtttatccaccagaccaaccacggcaaaatatcccaaacggccggggaaacatatggggttccgggttcgctggactggaacccgatcgtctgactgacgttggtcttgcgacgtcaagacgaacgtggcgcgtcgcacgtccgttcgatccgcatcgcacgaaaaactagcgagaagcgcggaagcgaacaaaaattatcccacggatgcacagcccgtcactcctaacacttcgactctggtttccttcctcctctctcttccatcgcctcgcctcatgggcctgctccacccatatgctcgcatcgacgacgatggctttcacggtggtgtccttatcgagcacctcgttccaacctagatgagaacactaggacgggagcgggtccctagcttgttgctagcaaagtctggaccgtcagggcggccaccaccagcacctctgaggaggacaacaacagtagatcaagaatgtgattgtaaattgatttgaaactgtaaatctatttgaattgagattgtgactcaatactgaatgtgatgagagtgagcgtccttgtaaatttaagattctgactattgtgtcaatttaaaaatacgaagagattgacactgattattgtgccaatttagtgtggcaaaagagattgtgacatcagaacagaaaaaaaacatcaaaatgtgttgttgttgctaattcaatatgtgagggctgaacatttaaagaaatttggttccaaaatgtttgcttgcaaaatgacaaaagaaagctaattataataaaacaacgaatgatttggttccaacttggtgacttgccaactcatttgttgcctttggcccaattcctgcaccatcggctatttcaatttcaaaaacttgtaaatctgaaattcttctttataatgccatcaagtgtaaggtttcaggaaaatacaaaagggtgagtgtgttccaaaattaacttagctatttcatagtttcttgtctttctgtccattactacacccatgtgtaattgacaatcagatctagttttagctcaaggatactttattagatgatctcttttatcctttcctcgatgaccctcatttccataaacatatctacatggtgtaactttatccttggattctcttttgtttgtatacctttttttggcctcaaaacctttttttgacatccatagcgatgccaaaacatccaacctcatataaacttatcaattcaattccaacttgcggtacccaaaaacatggtagtagcatctctctctccctatatataaaacaaagttagtgcatacaattgatgaccaaaaaacataacacacaagtatttcagtaagagacaaacaccatctccttatttgaccaaaacattatcccaatactaatcgaggatatatttacttagggcaaatacttttcgaccctttgtgacaagcaagtagaagatgaccgagggacatgacacgaatgccggcttggaaagtagtattcgaattcgttacaagacaaaaatactactccctccattccattttgatcatcaccgaagcaaagagcacagagaccaatgataataaaacattcatcattatgtaattaattctcatcggttaaggtgctacgtcatttcgtgttccatgtattgtatcaaattttaaatattgcatgtagttggaccaatagaaattaatcttggttggttacatgcaatgcattcaatgatgctcatttactcatggcacaaataaaaaaaagatgcacttgttagaggatgatcattttgggaagacattaaaaaccttatgtgatgatcaaactaggatagagggagtattcgacaagggagaaaggagcttgatgattacaccatggagcatggaatattctcttagaagatgtcgtggggatcactccaatcactcgtgcaagctgacgccagtagctctgggagaccacttgaatgtatagttacatccttaggttttccaactttatgggggtattatagtaacttccagtgcacccttggggcaagattgcaatttcatgtgtaatttcgggggctatataagccgatccaattgtatagcaacacaaagaatacaattcattataccattataccacaccatttattagtgaatgcatttcaagttcacctcatcctcaagataggtggggaaaacaatagtttccagcctatctccaatttttccgtgatccagtgtctcgacagagcttggagttgcattacaaacctagctccttccatctcattattttgatggggaagactttaactgaatcttcaatcaaacgattcttccatgagaaagggagaagcttgctcaaaggcaacctaatatgtggagtttgatcgattctaagaaaccattcatgaggaatagggtagaagagaggaagctagttgacatagactcatgatcaaagtgaagaaagtcctcattgtctcaccaccctcagaatagcaggcgatagagccttttttccccctccgtctaacaaggatggtgccattttccccctccacctgataggaatagccgaatggcggtgtgttgcagcctaggcaagcatgaggctgttcgtgggccgattttccgattctccatctccatctcatgttcatcttctccaacatctgcatcccctttcttcattcagtgatattgacctactgatacaccgatgcgtgctcttcgcacgagccccttccggtgaggcgttttcggacgtcgggccgttggtccgaagggtgacagactggagctgcgggagatatcctcgttggcgaggaggcggaggttaggtatgaggccctacggctggtgctcgaatcccttccgtcaccgtgcccgtcgcaagccatgctgcctgaggaccgactaacgaccaagcagcaacttaggccacctgtttgattacgctgcatcttaatccttctgtggggaatcaagtgctttggtggatcggatagagattattagatgcaacattgtagcagggatgcaagcaggacgacccgaaaacctacttatatatcaaataagtggtaactcatgggttttcgcgtcgtagcctagcttgccgcacctagagacgcaagtggatcgatccataaactcatttacaaagcaaattagtagataacccacgggtcaatccacaggttacccattaatttttcatataagcaggttcgtgggttggcctgcttgcatctctactagcaacatggcagctaattcaccttgggatcatgtcccggtgattgtgagtagttgttgatttgacccatcgttgctgcatatgcctgcatgattgggtccacaacagctactccgcttctacataccgtaggtcctgtttggatccagggattaaattttagtccttgacacatcggatgttgggacactaattagaagcattaaacataaactaatgacagaactcattccataaccctaaactaattcgcgagacgaatctattgagcctaattaattcatgattagcctacgtgatgttacagtaaatatatgctaattgtggattaattaggcttaaaaatttgtctcacgaattaactctcatttatacaattagttttgtaagtagtctatatttaatactccaaattagtgtccgaacatccaatgtgacacggactaaagtttagtccctgatccaaacaccactgtagtaggcatgctgcctgctgcttcaaggttcagctcagtggccgtgagatctagttcacagagaagacgaacaagagagaggaaataaaggaggaagaaggataatttggtttagaaattttaggaattttggtttagaaattttaggaattaaattgaaggaataagtagtggtatatttcaaataatagcaaaattgtaatgacatgactcgaaatagatgaataacagtaaaattgtaataagatgactccaagtacatggaacccttgtttaaagcacaacggtctgcgcgctggttccctctctcatctctcttctcgggctcgcctgagatgatgctgctgctgctgcaacgctccccatcccatggcaagcctccagcctaaatcccgcagcactctcaccgtctccatcaaccgccgtccgccggtgcgcgctttgtgggcccgacctaccggagaaacaaattaccagcaagggcccgacccaccgtcgccgccattcctttctcggcttagtacggcgtggggaacacggcgcgcaacaacctcgccaccgcttctccccttttctcttctcttctcgcttcccaatccgccattccgccttctcccctccaacacggcgatctcttataaatcgcgtcgtcctccgatcaaatccacgtcaccaccaccaccaccaccaccaccgcaaccgccccctctaaccccgccgtcgccgccgcggccacagcaatgaggggccgcggccatccccggcaggcaccagctgctcacgcgcgccttgctcgccgccgtgacgacagacgcggccatgatgggcgcggccaaggggagcgccatttcctcgaggaaggtggagctcgtgggcgtggacgacgcggaggagggagagggcgccgcggcggcggcggcggcggcggcggcgtcgctactgtttccccgcagcgccgtgctgctcctcacccaccggagcgcggtcatgcgcgcgcgcgcgactggaacaccgagccagcttgcggccgaggggatcgggaatcttctgcgatcgtcagggcgggcgcgcgcggcgtccaagcccgaagcgccggtgaccagcaacaccaggcgtacggccgcgagctccgacgcgatgctcggactccgcgcctgcaggtctgggctccggtactcagcatcggcatcgccaacaccaacggtcctacgttctggattcccttccttgaagccatgggatcgttcgccggttgcctcccaagcagtgcgctgcggggcctcgggaacgtgcccgttgggggacccggagaggtctacatccacgctgcagatgcgcagttttggttgggggcgcccctcgaccgcgatcttcgtagaggttggggaggtcgggtgatcgtcgtcgtccatggagatgacgggcacctcggcgatggtatcgggctcgaccagcggggaggacaccaccgctatttcctccccgtccatttgcatcctcccgatgaggtatggagggatgctccgggtggacctcgccgcggaggagtccgtcatggcggtggcggtcgaggttgcgatcgttttccctgcggcggaggaccagctgcagatcgagtgggcggtggcggtcgaggtggcgatcgtgttccctgcggcggaggacagcgcgcaaatcgtgtgggcggcggcggcgctcgccgcggcggaggagtggccgcggaccgtcaggatggcggcgttgctccccgcggtggatgggctggtgcggtagtcggcggccatcagcaacctattgtgagagaggtaatttcacttcaacatttgcttggtactatgtttgatctcatcatctgaacatttgctcggtccagtaattaaggcactaactacatttgttcggttcagtaactgttgagtgcatgatgttcagttcttcatcgacttcttttacgtgtgcatgatgtcacagggtcccggccgtcgtcggcgtagacgggatagaaacatggcgcgggcggctgccgccgatgttgctaccccggcccaagccccaccagccccagcgcctcaactgctctcggcggacaacagaaggctcgaaaaaatgcatcaaggtgttctgaataagaaggaacaagtgcaggccctactacgccagttgcaaacagaagaagatttagcgcgcacgaactctcagaggccaaaccacgataccatcgagggaatccacggtatggtggtgctacaaattgcagattacgagaggctcgaggagcaggtgcaccatctcggtgcacagattttgcaagacggtgagatgccagttgccgcaccagcagatcttttgtgcttagagtccgatgatgttcttcttcctgttcgcttatttgtgaatttttgttcttcctagattagcaccaaagtcatctcccaagggatggaaaaatccaattgctaagttgctaacgctgctaacaggggttctattctagtacagagatcgccacttgtcatgcctggtctcctttttcgagttggttactaagatctttttgttgagcaacgttttcctggcaatctctgcttattagggtggcctcttaagcttccgcaaatgttcctcgtgaaacttgtttacatgagctaggaaaagaagataaacaccgacgagatgtgtacatgccaaattaacatataaccaccataataaactaagaaaaacaaaataaaccaatactaataaatatgcctccattaatgcgcgttttgaaataaggcttcaatcacaaacattggatggcattttctcggatgcaatcctcgattggagctctcggaaggaggcgtctaacaggatcatgccacgcacgaacatggcggtcgtccacgcatcctgcccgtcgacgttgttcgggtacttgaacctctcgggcatctccgcgacgttgtatgtgccacccttggtcgccacgtactccggctcctcgtacaccgtctcgttaagctgcagagctctcttcctcctcaccaccgtgtgcgacgacgccgccggcagcaacgaggcctcctgatccatctacgtacccgccacgcacaagtcgtccctcctgctcaactagtttgtgacttgccgacttggtgatacgcccgtacggtacgggtgtgtttggtgtggtcgtacgcctacgtgcttgtgcatatatagccaggatcccccgccccgacgcggactcgatcgaggtcccgggctcccggcacggcggcaccaacgtacgcgactcggactcggagccgtggcacgcggttgctacgtgatcgcgtcggattcttcgtcgcagtacggaatagagcaataggctggctggcgtcccgcggagtcgcggtcgcggggttctccaacttccacccgaagcgaccggcgccaaagcaatgcgtttcgcgcggccgggcttctcgccaagtcgctgttcgttgatccagtgactagtgtaagcaatggcagctgggcttggctcgcgtgcgcctcgtggtcgggggatataaatccaacacagcagaatatcccaagcaaaatatcataagctgagctggcttctcgccggcgatggccctggaacccgggtggattttgcatgaaaggtagacaagcgagcagttctgatttctgaaactctgagcactgaacaagacctggggggacagttcaacaggaacctagaagttgacgaattagcacttcatattacgtgcacaataactactatatccacgagtccatgacaacccaactttaaataaatgtcataaaaatttcataagaaactgttcgtggttccagttctatgtaccaaaaaggcattgttcattttgtgatataatagcatttaccagtaccaaccattctattttgtaccagtctatgaaatttcacagctcaacagtctcaatagtcaatgctaactctactttagtttcgagcaccagccacaacaccaccatgcgtcacaataagcatggtataactcatacagaaaggtacacatatgtacaacgaatcattcaaaaaaaaaagcatatgctatacacaatggggagctgagagtatttccttctacgtagggctagtgattatatatttgcatttactccatcatttgatgttgagtcttcgaattccttctcaatctccgtgaagataggttctactttagcatcaatcttgtcgctgaaattctcaatctgtattagcgagaagatcaataaagtgttaatagcttcatctttggttgtctttcacaatacttccaaaacagtgcagatatctcaacagttttacgcaaaatgactctatacctgtaggaatcctttctttctttgcctgattcagttttattaggataaaacaatactagttgatttgtattggtacaatccggcattttgttcactgttattgtactcttctacttgctatatagatacattttctaaaactagtgcaatgccacaaggctgcatagtagtagactctttttaaatacaaaagaaaataggacgttattcctagatgtcctggcaaattgtggcacagtaaaattgcattaattttttttgatttaatgtcaacaatatacttttgaagtggaactatgaccttgaagtcttcaacaatacctacaaagatttaccaattaagcaaaatcctttaacaattgaattgtcagaatttttgtagtggaaaacagaaatagcgaaacaatccttggcagaaacaactaacaaagttaattatcatcaatataaacactataatggtaaaatgtatgtagcacacaatgaaggtacaacactattatacaaaagaaagttgaatagatatattcttgatgcatgtggttactacaatactacaatttaggtggagccaacagaaatatataacggcacttgaaaactggtgttcacagttggcacttagagttgccctctacccacttatctttagcactaccaatcaactcatacagcatatccaactgctaatttgctttcaaaatattctgaaattcaaatgacattatgtatcctatataaaatatagtaggcaaaacagggagtgacatggagcccaccttctcagtaatggcctcaaccttctctgcatcttcatccactacctcagctatgtattcaatcttctccactactttctgcagacatccattctctggaaggtgatcagccacgttagaagccagtttctctgtgacctcagctatttgctccacaacctcagcagcagtctccacatttcgagccgtctcatctgtgaacaaccaaacatcagcactaaggtgtgtttggatcatttgcttactttacctagcccggctagatttatctagctccttttggcagtagcctatataagcaacgaccatcatttcgtttacttagcttttaccgaatctagcggttgattatcacgagacatcacgcacgccgtttgccgtcgggggagaaccgatttggctctcctcatcaggcaggctttttcaggttattatggactggtgccatcaaaagcaaggtcttttagcttctacaaaacactaaaccttgacagcaaggtcttttagcttctacaaaacactaaaccttgacagcaaggataaattaggccttgcttgagatccaaacgcaccctaaaattctcccaactattgcaaacacagatactttgtaactacttggcagcaatttatgaactgcacagcagtttctggattactacttgacagtgatttcataaaatcaataatgattacctcccattcaacattacaaagtcattttctcataggtaaaggtggaagattatcggagttgggcgcacataccttcaacataccgtgctctctcgtagaatggcaccactgtgtgcagcacacctacaatcacccaccgagccctgaaagaacaccaaaacaaacacaaatttagtcaaaacatcatacagaaaaaggaaacaaccgcatgcttgcttctcctaccatgtaggaattgtcttcggagatgagcgcaggctctgggctgccaaatccgccgggacgatattcgacttaccaagaacaacccagctgcccagaatcgccaccacaacaacaaatccatcaactaattataagccaagaaccaagcgagacaatacaataaattgggcagagccacataccccgagtcgatgtcactcaaatcggcaccaccctccgcaggcttctctcccctgctgcagcaagatcaaaggacaagaaatcacaaacaaatcaccgaaacctagtttctcccatcttgttcttgctctcaatctcagtgagtacaaagcggaccaaggaattcacttgccttgtgccttcttgcttagtagacggtaggggaccgatcggctgcatggtgagagtcgccatggattggaaatcgcgaatcgattggagaagagaagctcgaatggattggggacggggagacgattcggagaagatcggatcgattacttgtgtggatgatatggcgtgcttaaccgggctacgatctgagccgttgaaagatgatcgaacggctgctctatcattgattgcgacacagagaaagagaccccattgctaaaacattacgctatgaaggtctcttttgcaaagttcctcctagattcaatccagaccgcacagtcccgatccaacggtgcccatcggctgctttccctaatcgcgtttattcttcgcgaaccaatcgattcgccgccggctagccgccgctgcgaccaccgcgccgcttcgccggctgctcgccgagcggcggccggcgggtggaatgcgcgccagttgtccgatggaacgcctccgggttgagtgctcgcctggctccttcggatagaaggaggccatggccgccgcgggcaacggcggcggaacagtacggcgacggggggtttcgcgaagtcgccgttcattcctcctcaactggtcacgcggcagtgctgggtgcggaggctgagaccaatggcgaggtgctagttgccgggaggtgagtggaggcggccattgttcttcctaaaccagctaattggggatctttgtgttgaaatcgcagctagatggatatgtctgacatattattgtctcgtttactaaatttagtggtttatttaacattgtttggataagaaattatgcaaccatgtacagatttattttgtgatagacttgatactacagtagactcagtagattgtaaatgcaatctgatttttcttagcttggcttttagatgtaaattaacactgttgcctgttgggttaggctgaaactataggctgtgactaaactagttatgtcatgcagattgatactccctccgtttcgaaatatttgacaccgttgactttttagcacatgtttgaccgttcgtcttattcaaaaacttttgtgaaatatgtaaaattatatgcctacataaaaatatatttaacaatgaattaaatgataggaaaagaattaataattacttaaattttttgaataagacgaacggtcaaacatatgctaaaaagtcaacggcgtcaaacatttcgaaatggagggagtattatattacttgcgtgcatccgtgtgtcatattctcatatcctcctaaactgatccatacaaccatttttcgggaataccatacaaccattttgaacttgttcctgaatatttcatcttacaagttgatgaggatgtgagtttgtggcatattcctgattttgagggaacttgtggtatacttgtattcaagtatttcagcagatagtttgtgcataactacatatttgatgctactaccttttgaaatagacggagctctctgtctctgcttttcatcagactatagttcactgtaatggaagctagatagttattctccttgtacctgcgattgtttatctcatccaaataagtcttctcttcagatggacatcatgaacctgtgaatggttatggacaatgacgcagcaggtcccaagaaaacaacattatgccaattaacatggaaaaaggcaaggtggttactctttttcagacataataggtattgctatcataattatccttttcttactaactattagagtgtgaaacacgttcatgaactgctttcctgttaggtggtatgtctaccttccttagtacaattgtttggtattgtagtatgtgtgcccgtcccgtgttcaaagtccttttatgaatgtggaaatttcgtcatttttttctagcaactagccaaaatgattaaacatcacatccaatcaataatggaatttaccattggcattattggtatacggacatgttgccagaaccatcttgtttcctcttgaatcttgataaaacatggagaaattcagctattggttgagactatctgtcctatttgagtgtataatgctagtctcaagtttctctcatcgtggaaatttgttttaattagaaaaatagatgtactctacgcaaattgcggagacgttaagctaacttgttgttttatgctgtctgatagggaagtcagatctattttctgatctgtgcacatgttgctctggtctctggcaatatgccaaatgatgaataccctgtaggacttacagacttcagtagcgtatctaataccctgatgtcaggtttctatgatcgatctactattctcccagtgctttaagagaagtatacttagtccgacatactgtgtagatacaggaatattcctttctgatgaagttatatattcctggatgtttcagggcctactccgagagtccaagtgattcctttcggacagcagctgaatagaattagggtactggagacatgtagggctaacttattagtcaaaggtgttgtttggatccagagacttaactttagtccgtgtctttagatgctaatttagagtattaaatatagactacttacaaaactaattacataaatgaaagttaattcgcgagacaaattttttaaccctaattaatccataattagagaatgtttactgtagcatcacataggctaatcatggattaattaggctcaatagattcgtctcgcgaattagtccaagattatggatggattttattaatagtctacgtttaatatttagaattagtatccaaacatccgatgtgatagggacttaaaagttttaatcccatctaaaccgtgcctaagtttggaaacatccgatgatttattgcgaaagctgtcaggcaacttgtatgtttgtcttgatatggtgaatgtagtttcccaaggttccatgttacctctaaaatctactagctgtctgagctgtgactaagttaatttggacatgggtttaatatagctcctctacttccttttatatttgaagcatgcgttacattttctactaacatatcgtatgtactggtgtcattattctctctctatcctagttgattgttacttaattggtgtaattttcaactgagcgagaccgactgcagtaaccatgcttctcctctaagtaagaccagtgatctttaatgatacaccattatctgttatatatgcatgttatttgtatatgtagtatttttatatgtctaagtaaagtagtgtagagacggtagccgtcttaaccattatgcacgtacgtacggcttaatctcttgcacttcaattagctctatacttatccaatgtagtagtaccattatttcccaatatatcatatgattctataggaccatcaaacgattatatagctcttgggttttctgcatatttttcattcgattgcagttataaaatggtatattaactcttgcatatttttttagcctggtacaggtaacttgtcaaaaattaggtgaaaacagttagtggaaattttaaaatccatccatgtggtgcctaaagtgtcacgaccttcatagtggcgttgcctagcaagttttcgctccccaccttttctgtctcctctcaatttggttttctcgatggtcgtgatcagattgttgtgagagatgagtggatattcttctctcttgccctctctctcctcaaccctgtgaggatgatcgaaagcccgtcgttgatctcttttgttgtttcggtgttttgtggagcgtttgtgatccccaagtaggtatatcggcggtcgatcacgcttagcggtgaccagcttagtgctagtgccttctaatgggttgtgcggtgagctactagcaagtggaggtggtttgttttttaaaaattcttttatctggttacaggcttttagtgttgcagtcttataatttatttgactatatcaatataaatttttgcactatcttgtgcagattttttaaaaaaaaaaaaaaaatcatccatgtgtggtagttcctcccacaatctcgtgatcccgtccttgtattttgacattttg

SEQ ID NO: 18547 - DNA, 5707 bp, Oryza sativa
cagtagacgtacgtcgatcgctctccctcctccctccttgttcatctaatcatctccaatgctttgctgatagctctccttgttcatctcccatgtggccatatgcgcttttccacccaaaactctccttctggagtaggattatacttcattcagagaaaaaggctcgtcagacaaagccatgcctagctgacagctagcactggtcaaagttaaccatcctccaatcttaagcaaacaaatcggaactatatatgatattcaattctgtaatataatctgaactgttgatgtttgcgagaaaggcaaagcttgttttaggaacaaacatgcatgagcaaaatttaggttatcataatttgttagagtatcttcttaacttaaactttgtggacctggggttgtgtgtgtatcctagatgcagaggccagggatttaattatccaccaatccaccatattaattaaaaatgagcacaatttagattaccatgaattttgaactgttttcaatagcttttgtctataacttataaatctgataaaccagtctttgaatttttttttctcatgctggttgaatactttgacgactcagactatcacaaccacatgcatgtgtagaggtaacttgaaaaacggctctagtagcatatcttttgatagacgatgcctggtaaccaccaaatggttattcattgtgtccatgtggcttataattctagaatatggctccttgtccgctgacaatttaaggatgaaaatggttgaaaatggtccaaacagccttaacttttcccataactatatttttctcgaaaaaaaaattgaaaattataaagctactagaaacgaaaatggtatcagagatattgaaaaaacagaaacgaaactatacgaacggaatcatatcggtatcgatcgaaaaccagtaataaatgttaaaaatattaaactaaaaataccacatatttaacttagtataactatatataatatgaccaattaaattcaagtttgcactagataagttaaattttgtctctcttagccatgcattcaacctagggatttagtttaggagttgacgagactctaaactatagatcaaaagatgacttggaccatagatattggagtatttagaaatatgctaattactgggatttattttaggagttgatgagcatctaaactatagatcaaatatagatcaaatagagacttggaccatagatattggagtatttagaaatatggtaaataccattgccaaaaaggtaatttccacgataatacaatcaaacatggaaatcttttctgcttttgttttttttgttttcgttgtttaccatttccatatggcttggtcagtagaaataaaaaacgagcgtccgttggttgaaaatttctgtgaccattttcaaccctggttggcattggtgggtggccataggcggcagagcagaaatgttggaaccttgtcataagctcatatttggggctatttagaactcatgatattctttttccgcgagattaattttcaccctgtttagttcaattcatgtagaacttctttgaaatcctaccatttcaaactagggctttgaatattgcaataatcgacgtatgcttcatgcggggaacaagctaggggtcccgagatcgagagtaccccgcagctgtgcctatcaattgcgttgtttggatcctagctacagatcgaaaacatgtaccccactaagaaatgttcgtgtctacatacgacgaggagctcccatttcaaacacttcactggctcactgccgcattatattggtatactccctccgtactaaaaaaggaagtcgttttggacagtgatacgatttccaaaacacaactttaacttttttctataaaaatatttattgaaaagtgatatatgtatacttttatgaaagtatttttcaagacaaatctatttatataatttttacattttcaaactcaacaacttgagagttattcatgatttatattctcaaggtttgacttaaatattattctaaacgacttcttttataagtacagagtggtagaccatgatgcattaattgaagtgaagatgaactacagaaatgtacgtgggtgtagtaactgcggtacatgtgcatccagcgtacagaggtctagaagaatcgaaagtgcacacattacacacggttggcgcatattaatattgaccatttttgccattgctaaatgttctaagaaaatactctagctgatctagctacagctctgcttctgctgctgctgctgctcttgctcgatcgtctcgacgatcccgtgtaccgccgccgcgatgtcgtccaccgacgtgagctggcagtcttctttcacctgcagcgaccacagagcagccatgcatgcgttagcgtcattaaaaaaaaaaacggttgttgttttccttctgcttcgggtgctcggttctctaggggtgaatgagcgaagcgaagcagccatgacactgatccgaatgacgaggagtttgtaggcgtcgttcatgacaatttctgcacggaaaacgaggctatctagctacagtagcaagctactcgtagctgctaaaatggagaaaatggagtagagtattttggggagaggatacgtgtacgcatgcacgtatacacgtactctctctgcatccttaaaaaaatcgaatctaaattcattgtattagattatgattatgttctatcttttaggttagtttttttttaaaggaagaagtagtgtgtttttactataccttaaggctaagggagtagagagccatgtggccggcgctggcgacgttgaggtggagcacggcgaggcggtggtgttgcagccctgccaccatcctcagcagctgcctcggccgccgccgcgacagcaccttcaggttggcgtggctctccaccatcgtcacctcgatgtccgccaccgaggacggcttcgaccccgacacgtccgcgtccgcgtcgtcgcccgcgccggcgccggcgacggcattgccgttttccgttgctgctgctgctacagtggtggtggttgtcgtgggcacggcgctcatggagtactgcgggaacgtgaagaagcccgcgaatggcaacgcggcggcggcgtcggtgcgtgcgcggcgggcgtgtctgtgcgcctccagggattggagaagctgctccatctccttgacgtagttgattgctccgccaattatggacgcctggtcgccctatccacatgagaatttaatttatttatagcttgaattgttgataattctaacaagatcatcaatggcggtcttgggcgaagtgagccctagatgggtcggcaggagacgtaccctttgcacgtaggaggccggcatgagggagcggagcacggcgaggtactcgttcatctgcttccggcggttgcgctcgacggcgatgtgggtcatgcgctggctctccacctcctccctgttcttgacggtcctcgccctccgccgcttcctcctccctgcggccgccgccggcgccgccgcggagccatcccgtccgacgacagacgcacctccgtgctccggcggcggcgctgcgtctgcgacggaggaattaccgccgtccggctcctcaataaaccccgagacggcggccatcaccggggaagagcttgcgccgcctccgccgccgtcccagaaggcgttcaccaccccgtcgtccaccactaactccatcgcccccttcccctgatcaacgccaccgccatacccgtggctccagctccaagctcctcctgcagctgcttccgccgccatggcaccgccgcatccgaagtagtatccttccgagaacaccaccgcctccaacgccatgctccaatcaagaaaccaaaccacccacacacaagagagagatgtctagagagaggctatagctagctagctagctagctaggtcatctccatgggcagaccgagctccgatgatggcgatggcgaggaaggtgagactacacgtgaagaagggaagaggacgagagggcggcagcagcatggagcagctgggaatggatggaggagggtgaaaaaggcagaggtagctttcggaggcgactagtagtaattatatacacacaggtcaaggtgaacagggggggggggggggcgtgggaaagcgcgggttttcgcgtgattaggccatgatttggtcgggatggcggcacggcgcgtggcacatctccaagagggtccgcgacgatgagacgatcgatcgcgacgtaggcgcgggccattgggaaacgcgaccgcgcgcgcggcgtgttgctgctgctacggacaacgcacggaccagcccgttctggagcgtacacccggctaatcgtttatagtagtacatatgccaagtaattgattataaattcctttttaaaaaacttaaaagataaattaatatgtcatactctcttcgttccgtaatataagtcgttttgactttttttctatcaaatcattttaagttgaatcaattaaatataaaatatagcaatattttttacataagacaaacatgttatgaaaatatattaaatgttagtttaaatgaaactaatttggtgttgtaaatgttgttaaatttatctataaacttaatcaaacttaaaaaaaaattaaaataacttataatataaaacagagaaaatatatcattttacaaaatatatgtcaagaaaatgagtagacgtagattcatgtgattaaaatccttctcctaacccgttcctcgtgtatggccaaccagagggaatggccggctggctctctctggccgcaaaaacacaagcgagagaatacatcatcctcgcagtaaataaagtactgtaaaatggtaacagagtgtggccgcgcggtaactttactttccgggaatattttacgcgtcgtcgccatcggtcggtcggtcatctctggctgctgcagtgtacgtacgtacgagctgagaatcactggtacacaggcgtacagatgagctagccataactattgtggtaatagtactgtatatactccctccgtttcatgatgtaagaatttttagcattatttatatttatatatatctagattcattaacatctatataaatatagacaatgttagaaagacttacattatgaaatggaggaaatagtacagtcctccctcgtccctaaataagtgtagttttgcactgtttgtatccaacatttgattgttcgtcttcgttgaatgtttttatgattagtatttttattgttattagatgataaaacataaattttactttatgtgtgacatttttttaattttttataatttttttaaataagacagatatttaaatgttggatacggataccgcggctacacttattttagaacggaggtagtagtaagctagcgtaagctatagctagccgcacttcgatgccactcgatccagcgattctagctactgtatatatacaggcttctacagggaattcgcatgcactgtgcatgtgcagggctgaatatcctatccgttcatatataccaaagcactgtgtaacgtctaatccccaacaggatcgattgctgcagtttctctaatcttttgatgcatctccgagaaacagagggtaaattgtggatgatacacccttgcaaggtggta

SEQ ID NO: 18548 - DNA, 2125 bp, Oryza sativa
  unsure (1)..(2125): unsure at all n locations
aaaggaacagcggcggtggcaccgctccgacttcgtccaacacgtcngccacccctctcccttcgcccgtcactgctgatggctgacggcgagcagtcgccatcacgaggtcgtcgtcggatctagtgggcctggcccatccctggggcgttggtggctgacagacgggttcgcggggcccgtccctctccctccgccgtccccaggtcgtcgatgtcacaaatccgtcggctcctccaccacctcgctacctccgactcctccgcattgctatgtgcctcccgcctactcccagcgacgaggccaagggtggaagaggaaatttgtggtgcgggaggccgtatccatgagctacgcagtcgtccaacgcataggcccaagcggtggctcaagaaaaggagctagaggcgtgcgttcctctgccaggagccgcgcctctctccaaggacacggcccgatgacggaagcgggacaccgtttgtgaaggcacgacttggggctacgcattgaacatggcctcatgtttctcctatggaattggaaaaaaggagagacttggctagggggcctagggtcctgaactctggagaagcggatcaaaattagcgtcatgtttaaacaaccaaattcttcccaacagttgcaacttacaagagtgattgtgttacgggtgctaatcagttcaacccaaaagtttaagttgaatagaatgtcttcgaaaacttcactaacttcagttgctcagcacttctcctgacgaatagcaatcaacaaagtgacaaacacgatgaatcggtagcactactggaatacaaatggacaagtattggtgcagattacttgtcaaatgcttcatttcatggtcaaatataaacgaaaaccttcaagtcaaatgcactaacctgctgaagggttttgcacaagttcatcaaagattcacatgtggcaaatattgtagacaaatacgctccgaaaatagtctgccactctgccatccaatttgttggataggaagatggcacatttggcctttgatgtttttatcttagcaatcctgtgttgtctgatgaaactcatggtcctatataataaattaacaatcacggcatatagcaaaagcaatccatacagttccgagagtacatgaacaatatgctcaaggaatcaagactcattcctgcagttaatttcgttcatgagaaatgcatgggagttgtacaaaacgcctatgagaacccttctgggttgtacaagtgtatcatgttcaagacttctaatgaggaacatcgttccattattatgcactcatcaaactcctctgaagaaaaaatgactaccactccagaaagggagccatgaattacaggtgtagtaaggaacacttttggtcaacttaacacttgcaatgactcaataaagccctaaaaacttccaccaaaatgtaccgacgactccccatatcacagcattgattgctgctgttgtaaaacccagtttgaatacatcaggaagatcaacataccccgctgcacaaggaaaacatgtactcaatataagaagtacacacaaaggcttaaagataaaatatgacaaacctaacagtaaaagaaaccaaggaattttttaaattgtctgctggtatccattagcttatggttttattcctttattaggctacatttggattttcaatgtagtcctacataatgatatcaaataaggcttgtattcgaatactctatccatacgtagtaagtaaaatatttgttatgctctttctctaacaacagatcttttacaaacaagaagaggcaaatattaaagaataatgtgtcgtaaagtgtcaacatgaaaacaaattgaattcaatgaagtgtgcacacagaaaaacttacctccatagtatactgcagactgcccactactataatgtgtcagtgcaccaaagagatttgaattgtatgtcaaagcaagtgccgacagtatagctggaacgccagctgctaaatgcatcgcaagaaatgctgaatacaaagctccaacatgtgctgtttggcttgcaaagagatagtgaataaagaaataggaggcctgaagaacaccaaatgctgcaggccaactcaat

SEQ ID NO: 18549 - DNA, 18359 bp, Oryza sativa
  unsure (1)..(18359): unsure at all n locations
caaaatgaatgacatcttaagcatatagttttttcatggttacaaactttctaattcctgtatctgcttcgaactttgtaaataagtcttttattttacgaaaatacattactaggctaagtcctggtagtaaagtcctttcaaaaaatgattcaactcttacgtttgtctggcagattctttgtataaggaggagattactgttgttaaattaagagtaaattgtattggtggtatacaaacttgttaggtgggtgcaatttagtatataaacttataaaatgctcgttttcagtacacaaacttgtctagttcatgcgaacgaggaccaaaataacttgacaatgttaattttataaagttgatgttgattaggatgtggcgtgtatacgcatagttaatatgcataagacatgtaatatttataaattttatctctactttatcctttatcattgaaatgatgaatttcatatatttctaacccttatatcagtgttcaatttttttaatctttttctactatcactaaattatattctatattttattgaataggtgtatgtataatggtaaccttctcatatatatgtttacatagggtgagtttgaggaggaggggattgagaagattgggaagatacgcaaaacgaggtgagccattagcgcataattaattacgtattaactattttaaatttcaaaaatggattaatatgaattttgaaagcaactttactatagaaagtttttgcaaaaaacacaccgtttagtagtttgggaagcgtacgcccagaatacgatgtcctttctcaccctatgtcaccagaatgaacgctcccatagtatcctaatcgacccctaaatcaacaagattagtcatgtaatgtcctttttacttccccgcatgcaccgcacaagtttgtgcaccaaaacgagtattttataagtttgtatccatctgacaagtttgtgtaccgacgatgcaatttacttttaaattaaatagaatatttatagctcactttttaaatcgaggtataaatattctattgcatggttcacgatttaggatttaaattctcaaaattaaaaaaaaaagtttttcgcgtgtatacttttcaaactgctaaatggtgtgtgttttgcaaaaaaaaatttacaagaaagttgctttaaaaaatcatattgatccttttttaaaaaaatagcttctacttaattaatcatgtgttaatggactgcgtttttcataggtgaggtggagttcccgaatacagccttaggacgttcctaagtcgatcaaagaaagagcctcatgcgaaagggcatgtagcctagtggttacaagagcctcagtgttcgactccccgtgggagcgaattttctaggatttaacggcgttgtgctttcagtggtaggcgacgtacccatcgacagagggttgagtgcgcgtgcgttgtgagtgtctgcgttgtaatatgtaattctcaaaaaaaaaaaaaaaaagagcctcatgaccaccattactccattatcggccgccaagatggacaagctggcgcagttgtctgtcaacgcgtattcttctcattttggataaagcgcacgcgcgaggttcagaaaatcagaagcacattattttgcatggcaaaatgcagccaatgtgtgtggggcaggccgtgtgttcagggattgggaatttgggatggcaaatttggaatttgggttgatcgagttcatcatgcatggacactcttcacgccagtccggcgaaaaaaatcatgcatggacagcatggtagggggccgggtcgtcgtgaatagtcgactgggtcgtgtcaaaaccgcaaagaaacgccaacgccagggattcccaacgccagtagccgcacaatttccagcacgcgaagaccggttcaacggaattataatattcacgcacaattccagcgcgcaccaatgaaacgcgaggatatccaccacttatccattcagggagtagaaagcaagctgctagtgctactactcactactgttttatttgatttattttcatctcaattttcttttcatccgatcgatatattccgtccaatttatcctaatttattttttttcaatttaattaagtttatagaaaaacatgataatatttataataaaaaattagtttattaaatatatttttaaagtatatttgtttcgtgttaaaaatgttggtatatttctcagtaagcttcactaaattaaaaatattgacttatgacaaacttaaaaatgaactataatatagagcagattgagtagaggttaaaatgataattttgaatcatagatctaccagtgaccagtcgtgtttacactcgtaatggttgtgttgtgcaaccttgtaggtctcacaatttgagatctagagtttcaaaattcaggtttgaaataaagttccaataggatttttttttcagcttgaaactatgcaacttaacaaaaaattttattaaagtaaagtgttcaaattttgagtttaattattattcaaagtctctgatatagcaacccctcctctcttgtcgttgaaatatttataggttccgaaatagtgaacacatattggcaaacgaagcaaaagttcaaaatcaaactcaactcattatactcaagagtagtcgaaactagttttacacaagtcaacttagttttgagggtttttttttctctttacctctcagcctactgtcatttggattggagctctcactgcggtctaccaaagtctggtaaagagacctgaaaaattgcaacgaacatgttgtgatcttctcgctaacaaattaatatcccaaattgtatgacaatgactgatactctggaacggtgatatactccaaatcacggacggtctcattgtctcaacccttttctttctttaaggagtttaattctttccttgtgttcaaggagtctgaggcggctggcacacactcatctagtcatctatacacaccgccttgatgctttgagattgaaaggtgtattcctcctcaccaaacccaacctactcccaccatcactaaagaaatcaagaagttgaatccgccgtgtccactgtcgtcgtcgtctcatttcagacactgacatgacagattcagttgctcatttcaaaggtaagcacggctaattagcatcagagaactttggtacctaagctaaccgtctgactcttacccccggagcaggtgttgaagcaggaaacttttgttctaacagaagcagaaatgtgaggtattcccttctctgaaaacgacgcactacctgcccttcgatctattattcgattcttttcctctaggctagtgtcctagtagttagtagtcgtctcattgctcttctttcaggtcggtctggtcccattcttactacagtgatcggcctaggcaagcttagatcatgcattgctcagcatgaccaatccgttaaccatcactttaaccaccggtttttctttttgcaagattgatatagagtgatatagagtgtccgatcaatatgcagatgataaaattcagaggaaaattatacaaatccatggagatgagaaaacaaatcacatgacagctcgtaattacagtactaagtacacgatggaacggaacaacaaccccatatcatcatcaccatcatcatctagctagctagcaaaccactcatctctctcacacacatgcatgccggccgtcagacgaaatgatcaagaaacaagaatcatatgcactgcctctatcctggcaggtgggcccgatcagaagagggcgagcttgacgaggacgccggcggcggcggcgacggcggcgctggcctgcaggccggcggacgcgccgccggtcggcttggagggggaagaaggggtggccggcggcgtgccgctgcttcctggggtggtgctgggtggcgtcccggagccggagccggagccggagccgctgccgacgttgatggccagcttcatgccgccggcgcagtggccgctgatggtgcagatgtagtagtgcatgccggcggcggcgaggtcgagggtggctgggctggtgctggtcgagctgatcgagttgcttgcgacggcgcagttgtcgtaatcgttcttgttcacctccgtcaccgtgtgcgccccaacgaagctgaacactgaaaagggaaattaccaattatgcttgattagtcacgagtattaattagtactccacttatttggaaggaaaggaatgcacgcgtgttctagaatcgtcaaagaggaaatcataatctggaaggaagctgaagttttaaaggatttgggagaggaacagccaagccgtagcacatttttctgttttcgggaggttgtttgtgtaccaatctccattcggttttgatagcttttttttttgtcgaaattcacaggtttataaatttgcataccctctatcttaatggaatttggtcggccgacccggcaaaagaagtacacttatgtgctactccctccaataaatttctacccttttgtttctcttttgatgtatagaaaagcatgaaacaagaaattgtaacaaaaatatgactaaattccagcctgaaattccaaacattctgatcactactaccaaattaagccaaaagaaaacaaggactcaccgagcttgtctccaaccgcgaaggtttggccacttgcccaagtatcgtagttctggccaagcgtccacccggagctaccacccacggtgagcgtcgccgcggaggccgcggcggcgcagccgacgacgacgagcagcttgatcagaacggaagaagacgccatggccggccggtgagctagtgttcgtccaagtggaataatgccggagacgaaggggaagattagttagctagctatcggtgtctcgctgcacaattgacagggtgaggttggaagggtctctttttatagagaaccatcaccatttcaccgcatggttggcaacttgcatgtgacggatcgatgagcgatcagtcttttggacgacgcggccggccgctttgttggacagggctgcagttttacacacgcagcagaggatggtcagcgtttgtgttcgttccttttcactcattttctgctcgctcgtttcttcgtttcctccagaaatcctaatcattattcattcagatatttcagatgataaatcagtcaaatcacacacgaacgttcagaattccgaatttctttttctccttcatctactgaaaaaatacagcggccgcttttttttttacacagaggtatttgatttcagaacgagatgagattggttgaactcatccatatttcgaaaataggaagatcgcatttatccgtttggtatgagagataaaatgacctactttttaagtgacggttcacatgttagtgatagagaaaaatgggctggattgatccactagttttttttaaagataaggccaacccttatattatattcaagaaatattacttttcagacttaatgcatctcatgaaccaaactgaaagtggaatagactcaacacaaaattggattgatattggcgcggagtacatatgaaacctccattatccactcaaccggtttatagaaacagaaccgagagagataattaaggagcgatgtccatggtggggagagacgaggtggcggtgggcgctatggagagcgccggcaggtgctgtttgagggcagcatgtacggcgggtcggcggcggatgccctgtcgatcagcggcggagtcggtgaccgtcttggccatggcgtcatcaattgtcgagccgggcagggcttggtaagacgcgcggacggcgtcggcaacggacgtggaaacaacgttgacgagggactctggcaagaggggggaggtagccgtcgacatggcggtgttggtggagttaggcttagagcggtagatcgaaaaaaatctgataccataaaagcggaatagactcaacacaaaattggattgatatcggtgcggagtacatatagacacgaaacctcccttatctactcaaccggtttatagaaacataaccgacaaagataaaaggaattggcaaaataggaaaacagagatatactacaatacatactacaatactgctcattaacatgtgggccctaatatcattgccaaaatgccaagtgttgttcgggatcatggtccatccaagtttgtctacccttatctctaattatcctctatttccgcgattgttcatacacggtaggtgggtcatcgtcaatggtcgacatcaagcacagccatgcatttcttttctccgcgcacattgcacaaaagagaaaggttcagacgaattactctatactacgcataccggcactgctgcttattaatacatgcatggtccaacgagaatacttctggcctgcctgtccttgtactttacttaatgaacgcacagaaagctcaattaaactagagattaaactaatgaaactatggcagaacgaggagtggttaggtaactgatgcaatttgcgaaaaaaaataacataatgcatgtgaattgtttctttagccgcctgtagtggcatgagcaacaaatggaaggcaacatatatggtagtagtcgaagcaggaagaacactagtgctagctcactcatctgtcaaaatgtcaaaagtatatttctcgttttttggaaagagcttttgaccttgccgtttgcaaggttaataaagtgatcttttgctaatggcacagttaactctagcttccaggttaaaaatttctagcgtactccgatccacatggacacacggcatgttgacctaatcattttgttcgatctgctcctgcaatctatatatgtgatagcatgcatgtaagacgactcggttttcacctaatgcattgaccgaaaggaaggatctgccgtatgggataacatcatggccggcagggtgtatgtaaacagtgccaacgcatctctgtatagagatcagcagattaggtttatgtcagtctcttcaatcaggagacgaataattttggaaggttcatgaaatgattcaagatcgagaagaatatgtttttaaaaatactagtttcagagaagaaaattttggattgttcactggctgtaccgtacaccctatttcccttttcccacccctgaaagaaccatttcttgcacacgcttagcactgtgaatttgaagggggaaaaaaaggcatactgtcgaattattttgtataaggcctctgctacagtgccactcacatgatagttgcttggcaataattttacccagttgaatttgtataaggtccctgctactgtgctagaacacatgttagttgcatgccaaattgccaataatatttttagcttcatttttttttatgataccctcttgttgaccgtccttgaagcttgggaagggaggaaatgtgcaggtcaatgtaagaattgcagttgcacgtcgtctggcatacgtaagccatgaactaatatgggctgtttttataagtactcttcagtcagattattaacagttcatgggagcgcaaattgctcctccattgtttatgtacatatataagtatattcgacatacatggttgatagtgatacgctgatacataatccaaatatatttactttacaagaaccacacatgattcacacatcttctagatccatatcaaccttcagtgagtgtattttcacaaaaccaaatgtacgtatgtatgtgcacacctaactagcaaatattattgaaaattcaagaaaaaaataatgtacatgaactcaaaatgtactatatatgtatataggagtatttgttaagtcttagcttcacattcattatattttagccatacaataatataagacaatttttagagtataaatttgtcaaacttaatgtgcacgggattcggttcctataaagaatgcagcaatgccgagaataaggttaaaacaccgcagctttagaagaaaaggaagaaaaaaaaatcaaagaacctgatatgcaatgcagctactgaaagtctggaatcgagctattagtcttggccatggcatcgcttgactgccaaggtgcccccaagctgccaaagcaagggtgccacctaccactgcctgcccttcgtatatagaaaatgatcaaaggagattggtcgatgcagaatccaattcctcactttttattttcttttttattttttttctggtggtccggatttatatattaagaaggatcaagagaactataatagcacgaacgaagcaattcctcactttcttctcaaaatatataaagcagccaattgaccaaatgtagaataagggaactgaaaaggcaaacggaaaataattaagggaacctcgagagctcaaggccgaagagacgagaagaatgggccgtttacacggcacagaaagcccagccctcccattgtgctagcccaggtgactaggccgcgtcaggccgggatggtacgacctggcatcggcttggcccatggcctgacgggcccggcccaacataccaatcaagatgtggaataagttcattctaggtccctcaatttgtcgccgagtttgaaattcatcccttaagtgcaaaaccaggtacaacacatcctttaacttacaaaaccgtgcaaaagaggtccctcggcagtattatgctcgggtttggctgacgtggcgcttgcgtggctcctttgactaggtcttcgtcccacgtggcattgacgtggcgcttatgtggcaatttaattttaaaaaataaaaaacatgggacccacatgtcagctacatacaaaataataataaatggtgggacccatttggccccacatgtcatccctcttctctccatcctctctctctctcacctgggcggagcaggtctgagcggagtggccggccggcggagctaagcggcggcggctggagcaagctggcacaagcgacgggcaaggggcggcggcaccgcagcgccgagaggtggcgggcacagcaaaggggcggtgggcaaagagggggcgagtggcaggcgagctcctggagatggcgacgggatgaggctgaaaggacgccgccgtcatcgtcggtgtcctcgaaccagtacggcttgtccacacccttgaggagagggaaaccattgaacagcaccgggattgcgtcaatggtggtgtagatatgggtattggccgtcttcgggtgcttctcctcgcgccacgggaccgcctcacggccgtcgccattgtcgtcgtcgtcttaatccccgccgccgtcaatgaagaggtgggggacgatgttagctaaactccggcaactgcagtgaaacctgcaacacacacacacgcttggacgcgagaagaacaaaccaattgggaaagtctttttggcgctgcatattacttgcttgcgacattttctgtttctttcccttttatccatacgcgattacagaacgtgggcacgatgacccaacttacgcggacacgatcctttctcagcggatgccatcccaaatgctaggatcgtggccacgcggcgtcatcgacgcctaggccgagctccgccgagtcgccgacgctgatctggggagcgaggctgccgtctcctccctttggatccacggcgacgagaggagaggggaaaagggagaaggaggtgtcgtcgtttgtgggctggccgccggttgctcgacgtcgtccgcggcgccggcgtgggttgtcgtcgtcctccaccgccttgcccctcgcctgtgccgcagcctccgcctgctggagctgcgcgtggagcaccggcgcagtggagagggcgaggagctcgctcattctagccactcccttctttcccgtatctcgtcgaccaccgcgagtcactccctcctctcccactggtgccgcgcgccgctgccaactcttccgtctcccgccggcgccgcgcgtcgctccctcctcacccgtcgtccgccgcgcgccgcccctcctcactcgcgtctagagagaggacaaaggagaggggagagagatgaaggggagtcggggagagaggaagaagaagaggaggggcgaggatgacatgtgggtcccacgtgggcccccaccattttttattaatttgtgtgtgaaactgacatgtgggtcccatgggttttattatttttttctagatcgaattgccacgtaagcaccacgtcagatgaagaccaagtcaaattagccacgtaggcgccatgtcagccaaaaccaccctcaaaccatcgagggacttaatttacaccggttttgatagttgagggacccgttgtgtctggtttttcggttgagggacaaaagtcgaattcgttgacaagttaagggacctcagatgaacttattcctcaagatgtcgatgaccaaatcagtggatcgtccctataggcctaccggccgtgcacgaaagcaaacctttactttggttcggcacttacatcgatcttgtgggaccatgtacaattagcagtgtctgacctccctcgtacaaactgaggctatgtttacttcccacgtaaaaattttacaccctatcatattaaacgtttgaatgttccgttgaaaactgaggctcataaagatataacctattgaatgttccgttgagacttccgaatttccgattatggatccaaacaggatgcgacttcaaagtgtatcctacacggctacacgcagtcgtcgtagcgtgcaccgtgcagcgaatcagcgattggttcagggatagaaatgatgccaattttgcctgatgatgatcctagctacacaaacgttaccaccaaccacaaccaaactccctttatgcgagggttaattggatccatgacattataaattcttcagtttgaaaatatgccgttataattcatatatttgtaacgatgatattataattttacaacagtttaagatataccactacttacctcttcagtgtatttataaaaattattttgaccattttaccctcgtctttttgctccctcctccctttcttccttctcccctcttctctctcctctctccctcacgcctagtgaggcctgggcctccaccgaagctcctcctcctccggcctaaaccatgcctctaggcgctccttcgcgccccgcccgcctgccgaggaggacgagcagaggacacgacgcgaggaggaagagaagaacatggtggcgtgaggatggcgagcgtacggtggcggcgacacaatgaggatggctagatggtgccggtgactcgaggaagatgggcagacaccgacagcgtgagaatggttacggacggcggcgacgacgcgaggaggacaacaggacagcggcggcgatgcgaagaggacgagcggacgacggcgtgaggatggcagaccggacggcgggggcgacgacgcgagttggttggccggatgatgccagtgatgcgaggaggaccagcggacgccagcgacgcctggacgcacgtcgctgttaggactcagatctggcagccgaggggtggggggtgggggtgccaacgncgggggcgtcggtgctggtgtgggcagcggccatggagcacatccagggacggcgggagccatcgagctcgtgtccaactgcaacaagaactcgcccatgctgctttggaccaaggtcgctggatatgcgttggagttcctgccggtcccttccagcagcagctcttcgtgcgtcgtggacgcctgctgcatgagctcgtcagggcagcgctgcggttggctgcacgagctcgccaggggctgaggcgatgaccagcagacgacgagagcacatggaaggaagaagatgattgagaaaggagggtaatttggtcagaaaaacttagaaattgcattgaaggggtaagcagtgctaccccttaaatacatgttaaattgtaatggtatagttttaatttcacgaattatagtggtatatttccaaacagataaatttataatggcatggatccccacaaatccaattgcgcttcctagtatctttctacatatttcaccctcacaactctatgtttcatttataggtgattcctaatcatcgagatagcaattactcaaaatatccaccaagtctttcggatatatttctttgtataggcccatcctattatctcccattagtaatatatccgtgaattataacgaactagacccatgacttgaggatgggttgtgagtgtagatatatactttgctctcttttttttgtcgtttgattttttttctagtttattagggtgatagtccaggatacagatcctttgcagtactgctgatgcagtagcaaaggctgacatgtgggtccggacccacacatcagccactgctaccgcactagcggtaccgcagaaaatccccattggatgttccatgctttgcacgaggtggggaaaggatcgatgactccatgtttaagtagtagaaatacaaattaaattttaaaatataaattattatctccgttccaaaataagtgtaatcgttggtacccgtgtccaacgtttgaccgtccgtcttatttgaaaaaaaatatgaaaaagctaacaaaaatttagacacacataaagtattattcatgttttattatctaataacaataaaagtacagtcataaaaaaataaaaaaagacgaacggtcaaacgttgaatatgaacagtgtaaaactgtatttattttaagacggaagaagtaattttcttgattttgcatatatatacatgcgtatgaaaattttatagaaatatacatttcccgcggtccacatacgcggcccgcgccatcactgcaactcgaaggcgcgaaaccgacaagaggggtagtgtcgtggggcaattgcgcgggaccgacgtggtcctgtggattggtctcacggcaccgcggcaccggcatctgaacacgtacatgcgtttttaatattgttcaaaaacactattgagtaccgtctaacattgtttgccactgttcacagagttggttccacgcaatgaagccacgctgccgcactcctggtccgcaggaccgtcatggtcccgcaagttcagcccaccggaccgtggcggactagcggttctgcttgctcgttcagcgggaacaccctggttggcgctcccgcattcccgcaacgcgatttgtgattgctcctatgtattcaatctgcggagctcgtatatttgtgacatttcttcccgtgtagatatataaacataaattattaaacaaatagatatattctcaattgtttttcttttgtagaaatacttgcgccgtatgagcagcagagatacaaccatcaagagaatcaaagcaacgatactcggctgagctgctttccctatcctaaaataaaataaaagaacattctacataaacaaagctattaaaaagggtggaaatacttattttgcctccaccagtggttgaggcacaaattttgacaatttaactctttgcaaaaactatttttacaaataaaccaccgccaaaacttatttcaaaaatgacccttttgttcaacgtcaaatcgtatggcgctgaacttagatacctcagcgctaaatagtacggcgctgaatgtacgttggcacgctgacttagccttccatccgtggtggcaaggcattcagcgccagttgacgtggcactgagatgtctaaattcagtgccatatgatttggcgctgaaaaaaagtcattttttaaataagttttggcggcggttcatttgtaaaattagctttttcaaaggatcaaattgtcaaaatttgtgtgggtgaggtgtgaacctggattagttaacttggtaataaaaccaagagctagtcaatcggcagagacgagtataatctctgagataatacaaaattattttcgtgtttttataataatagttgaaaggcaaaaaggctctaaattaactaaaaatattctccttttactattctttcttttttttactctcacccaatcgtgtttccatattatagagactaagaatggttgttgaaccgttattacccatagcaactatgttttgtctccttttttttccatgtcaacgaatattcctaatcaacactgagagatcagtattaacaaccattagacatgctctttagctgtaaataccatattttataagtatatagttaagatagaatttgtactaagttgtggaatggagggagcaatgaatattctatagaattcttcggattatccaaacaatatactatatccatcccaaaataagtgtagctttggatatccgtgcctaacatttgaccgttcgtcttatttgacaaaaatttaaataaaatattcacacataaaatactattcatattttatcatctaataacaataaaaaaataaataaaataaacggtcaaccgctagacacgaacgatgcaaaactacatttattttaggacggattatcctacacttatcttgggacggattatccaaacaaggtattactactctcttttaaaagtttatcctacacgcagacgcagtcatgaatgtggtagcgtgcagcaatagatacggcatcttccagcccattccccatcatccaagcttctctttgggaatagaaatgatgccaattttgcgtgatgataatcctatctacacaaacttcacaaccaaaccagtcacaacccaacttccttctgaaaacagtgattcctaagtttctacagttctcatcagtcatcacccctctctgttcatcatgttcatcatttacaagtgattcctaatcatcgaaatgttccagatgctagcaacatttttttttgtgcagaattttttcgtagaacgatggattttcatgatgtctgatctgatcctccaatgtgcagtttccccttaacaaaaaggtgaagaaacggttagttttcagaggagcttgcccatggcgaggccgatgccggcaatgccgacgcagacggcgagcgcgagccaccacgcagcggccccgcgccgggcgccgccgtcgtcgtcctcgtcctcgtcctcgccgacgccttccttggccgagccggcggctcctgctgctcctctgagcccggagttctcggcctccagcatcatgacccaccggcggtgcgccgacagcaccaccgagtcccgcaccagcagcgccgagagctcgccgttgctcgccccggcggccgccagcttctcctccgcctcccgcgcccgcgactgcgacagccgcagcgcacgcatcaggcggtcgccgccgtcaccaccaccgccttcgccgtccccgcccttccgatccgggctcgtgctcgtccacgccgccgcgttctccaacctccacatcaacaaaaagggtaaaaaaaacaaaaaaaaaaacaccgcgccgctctaagcaatgccacactcgcgaattccacggcatcgatcgtgtgagagagggagatgggaacgcggcggcgcctacctttgcagagtggggagcgggccgaagagcttcgcgggaggaggcaggtcgcagttctggagcaggtcggtggcgaacgcccgccgcgccggctgctgctgcctctgcttcttttggtgttcgccgccggccgccgccatcagcaccatctcccgctccagctcccactccatcccgccgcggccgggcgccgcggccgcgctgctcgccgtccgccgcggcatccacgcgcgtcagagcaccagaaggcgcctggtttgggggggtgtggttggtgagagtggtggggaagggaagggaaggggaggggaggtgagcggttgcttgaagcgtggcggaaggaacggtgggcttcttccgcgaggaagggaagaaaccgcgggcgagaaggttaacgcgacgcggggatttccgcttgctttgcttgggtttattcggttcgttttttctgtctttgtatttttcgttcgtaggattttatatcaaaatataattaattttaaaggaatgtatcataataatctggtactctagattggtagtattagattgtgtcatatctctccaaaataaatatctctccaaaataacttatattatgggacggagagagagaatattcttgtaaatttaggtcttttttatgtaataaaaattggataaaaatttagataatcacgtgtttttcaaactgctaaacggtatatttcattaaaaaactttttatatgaaagttgctataaataaatttttaaggttatgataattaaaactctattaattatacattaatgccatatcgttttacgtaaaacagtgttttatctacgtaagtatagtggaattagattatacaactctttttatatctagatttattatttttgatatgctttttaattattttatttaaaatgaattgcatccattggttgaaaacttttcaagatttgaaggtttaaatttgttgaaagattaaataggttgtcccggttcggtttcggtgtggcgtcgcacggaacaatcggcggcgaggcggtcgcttggtgcgaggacaacgcactggcctcgttgtcgcacacaagacaagcagattgcttctgctccttgctttcctaggcgttacatgtgctttcgcaaaggaccggcacggtattctcaacacataagtgtccactaatccactatgtttggtctgccggccaaatgagtacggtatcaccggtgcgaatgaaggcgacggatgcaggagtttcatacgggtatcccggcgaaaacaaaaggagtttcagatggataatccaacgattgaccaaaggagttccgtacacgtttgctcatgcgtttagcgtttcaggtccactccgtcaaggtaaatgctgcgaaatggataactcggagtttgcgcttagctagtgttattagagcacccgcaatggttatctatatgctctctataaaagataatcgtattttcctacttgtaagagattaaatggagagagagagtaaagctatctactaacctggagagtctatagagaaaaacaagacaatggatgagagagctatagatacccatgtagaaatactattgaggtggtttactattaatctaatctattactgagatatacatgttttatagagagcaccttactttaccattgcgggtgctcttagagcaggtacaatagcatactattagccagctacaaacatattttaataagataaaagatgagagagaagaacagcttctgtagcccgctgcagcacggactccaagacataatgtgtatatgacagtgggactatatactaatagtatagtaagcaactattgtatgaattaactattagattagttatagatgaattgtagctagtagttggctatactattaactttgctcttaggactaggtccaggttaagagggaggttcagcgtatctttagaaccaacataaatccactaaaaaaagaatggacctaaatatctgcagcacattcacaatcaacaagcttagtactacaagattatcagattattaaagaggatactttctgagctaagaatagacagatggggacggaagactggacaataattgattcagcacagttcagtattgctcacagatgtttcgtcggaccgctcgtgacgcagatgtactagcccgtttggttactgaagaaccttgggtctgtactgcacggcaacctttaaggatagcacaccaagcgtgcaatttggaactgatgtgaaggctatatattaatttgacagttgtcacagttcttccggtcacatttattttagataatggattagattaaacccggcctctacaatcttccggtcacataaaaacgaagacaagtacagactgaaaacaataccagtagtagcttttagcctttaaagttatcccggtgatttatacatttcagccaaatatttcacaataaacaaattatcgctaaatccatcgggttacggctgagatccttgagacttatctctatctacaattaattaacctgggtgtcaagaaaagcttacatatattttgtgctcatggcataaagctgacctccaaatgtcatatgtcatccatatcaagtggacagcataaacaacgctgtaatatagaactcacgaggcgttgaatgagcaaaactgaccagcagctgggagaccttgtgagaaaaagaatctttcaccattagcagagagtggtggccaataattcagtatcttcaggaggaacacacaaccatagttaagtcaacgacgcccaaactataact

SEQ ID NO: 18550 - DNA, 5054 bp, Oryza sativa
gtatgcagtattgttcctcaaaggaaaaaaaaagaaaaatgggaagttacgggattcgaacccttgacttatgagaggcagccctccaccaccaggatacaccttccatacagtaagggtgtacatgcatgctatttatacaatccagaccatgtaagttagcgccaaagaatttggccctgatatcgcatgacgtgtgatttgcgggacacgtcggaccttatctcagcgccaagtaagatgccgtgagaaaatggtctatttttaaaattagtttttgacacggctcaatatcaaaataagttttttcaaagggtcaatttatcaaaattacgggggagaaacagtcactgtcaaaaagttcagcggcgactactctagacttaaaatctgaataagtaaacggatgtgaatacaataattgagcacagctccataagactcgatccatggttccaaaaggtgtcatgtccattttcttccgattaaaggattttttttaaattgaccaaagatttctcaaagctaatatttatcaattaaccaaacaaaacaattttttagataaaagaaccaaaaacatactcctactactcatctagtgtcattttaagtaaggaaatagcctgtctattctagtatatccacttctctggcaattttaaactgacattaagattgacgcggcattgttataggcggacgcgcattatcacaaatagaaaaggcaaccgaccttgacttgtggccaaaacttcagagctggtcttaaatcttaattaggaataaaaataacatttaacatgatgaaagagaatatgatgagaaaaaattacttcacttgcccatggtgacaaaaatacccattctgatatgagaaaaaacaaaggaaaaaaaaaagagagttttggattcatatggattcgtgactgtaacaccgttcggttcaaaggaattgatctcttacagaaacccaagaaaaatcatgtggattctactagaaacaaagaaaaaaaaattcatgcactctgacatgtctttatttcatttcttacgtttttttctttgcttttgctttgtttgacgcatgttttacaattctatttagaattcatatgtttgttttgcatatgctcttatcttttcttttcctattttgacttttttttagtcctataatccaaaaagcccggaattggatcgacatccctaggctttagttcgaatatgagatatatgtaaaagttccaaatatatctacctggtttaaaatttcggacaagtcaactgttttaaatacgtgaatggaaaatatcttttgctttgacatgaagatattgcaccgttcgtttgttttgcagaatttgctttcattataagtagcctcaacattctgtacccatatcatctgcaccctggcagccaatccaacggccatcctccatccgacggccgaaccgacttaaaaaggatggcgtaatcaccgtccaaaatctcgaattaaataaatcctccaaataaaccaatctccaatttttaatcgctatctataactcttcctttttcgtttctaccgcgtagtcagttccccccttttgagatatttaaccatttgccacatttagatgtgacaattaactttttgccattggacccatatgtcatagacatatgtagacccacatgtcattgagataggggtggcaaatagttatttgctaaaactaaccgtggcaaatagttaaaagcccccttttttatagcccccatacctgaaggccatcatccatcgcccgccttgccgcctcccccacttggaagttgcaaagcgaagcccaccaacctcaaaaacccaaaccctagctctcctcgccgccatcccatggcgcgcctccacctcgtggtcgtggccatggccgcgctcttcgccgccgcggcggtggcgcagggcccgagcgcctccccgacgccggctccgaaggcgcagccaccggtggcgaccccgccgactcggccgccggccgtggcgccggtgtctcctcccgccgcccagccgccagtgacgacgcctcccccggtttccgcgcccgcgcccgtgcccgccccgagcgccgccgcgacaccgtcaccccaggcctcggcgccgaccgcggagccccccgtcctctcgccgcccgcgccggctccggggtcgatctcccagtccccgacggaggccccgacgtctccgccgccaccgagcgccgcgtccggagtctccccctccgccgccgccgtcgtcgccgcctgggccgccgtggcagccgtcgcggcgttctactgagatccggctcccggagatgagttcctcgccgccgccgatatcatcaccgccattactgccgttaatttattattgttattattagctatttccccccttcgctctggggttgctaatcccattgcgttttaatctagatctagcttttgtgagtgagagagagactgtgcttgccattgtataatcctcccccaccggattcttttctttaatctactttcggacattattagtagagattttgtcatccgattgctcctgcctgcttgatctgttctgatctagctcctcagatctgctcagatttttccccctctgctgtattactgtagcattctactcctgtttgctttgtttcgattctaccgctgtggctttcgttgcgtgatgatgttgtcacgttggtggccagctggggagcacagcatctcgcgtgtgatgggagatgggagaggcgtccggtgctggaggtggtggtggtggggggtgggtgagcacggcaagacatgcggcgaggggagggcgcgtggcgtttggcctgcgcgcgttggtaacgtgcccgcggccgacacgctcgcgtaggcggtttttcggtccggttagtgcgtgcgcgggcggggcgggtttgaccggtagcgatgacacttttgggatgaaaccagtggtggtggcacacgtttgattagtttggctccatcccaaaagtgaattctccgacttcatgactcaactgtaaactgaagtacaggaagttagaaaagcctcatccttccattctgactacgtaaattaggtaagccttatccttccatcctctcatccttccattttgtgactacacggtacacgcaagttaggaaagccttatccttccatcctgatttatatgacgactacacaaagtcaggaaagcctcctcgttccatcctgactacacgccacaagttaaatcagaataagtaaaaaaaaaatgtattactttcgttttttaatagacgacgccgttgattttttatcacgcgtttgaccattcgtcttattaaaaaaattatgtaattataatttattttgttgcgagttgttttatcacttaaaatgctttaagcatgatttatatcttatacaattttttttgaataagacatagtaaaaaatatgtttaaaagttaacggtgtcatgtattaaaaaacagagggggtaggactttacatcgagcgaacaatgcagggcaattatgttatctttgcccctatcctccagccattggcctctaacggcacgatgcgaagacattttgtatgtcgccgccgtgatccctcggccgtcttgaaccacctgctactcgtggtttctcgccaccgcgtgtcgtggccgatgcggtgctcatcagcatcatgtagccgccgtccctattgtacacggagttggagccggtgctgtgctcgagtgaggtgttatcaatgttgacgaggtcgtgttgttgttgttgcacttgcatcgccagtgtcaccactgctgccaagaagtcgtcgtgtgagccgtcggtggtagccccgaggttgagacggtgaagctcttgcaagctgtgccgtcgggctcttgcttgtaccacttgtaatgtggctgcgcgtatgggtgaggtggccgggtacgtgtggaacaggcaaacaatcccgcgatggcaacacggtatattcacatttcttagacgaatcatcacggtacaatgtggcattctggaatctatgaatgtacgatagtattcgagattcacgtttcttagataatcgtcacgtcgatcttcgccatattctaaaaccaggggtaaaaatactccgtaatattgttcgggcgagtggctagcacgggccgtttctacttttctggtcctccagaaatctggatagggaaaggccacagccgcgtcatcgaaaagcagcccatagaacgatgtatatacaagttagctctaatataagcttatagccggttatctactattaaacatgctctaaccagctcaataatacaaaacagatgacatggacagtcaaataagttagtcatttgcggactacggagtattacaccgtaattgtttcatatcagcacatctactacttccaagtaaagcaacagctctcgacacaacaaataagcaaaaaaggcacagacggctcaaatcaacaaacaataagccccaatatggcgcctatgatgcccagtgatgatagtaacgaagaacaagaatccagaggaaggctggctggaagggcccataaccagcaaataactgaaactatgaacaaaatcaggagttcgacaaaagctatcaatgcttctggaagagtatgcaagaacaaaatcgcaagactatgcaaattccaacgtgcgtgcattgttgtatatctgcacactgaatgaggaccctaataacctgcaatatttttaccctaaaaagaacacgaaataaagtgtactgaacataagtggaggtaaagaaagaatggctcagagaacctttcgccgaactgcacatcatgctactaccatcccgtcccataccagagactaattgaatcgggaagggaatgggaggcagccgtaagaccggcctttcatttctcctcattgccataacactaatcacaatccacacgcatacagcattagggactagggaggaggagaccacaaaatatgatgcaatgcattttcttaataggcgga

SEQ ID NO: 18551 - DNA, 580 bp, Oryza sativa
  unsure (1)..(580): unsure at all n locations
cgttgatcaggggaagggggcgatggagttagtggtggacgacggggtggtgaacgccttctgggacggcggcggaggcggcgcaagctcttccccggtgatggccgccgtctcggggtttattgaggagccggacggcggtaattcctccgtcgcagacgcagcgccgccgccggagcacggaggtgcgtctgtcgtcggacgggatggctccgcggcggcgccggcggcggccgcagggaggaggaagcggcggagggcgaggaccgtcaagaacagggaggaggtggagagccagcgcatgacccacatcgccgtcgagcgcaaccgccggaagcagatgaacgagtacctcgccgtgctccggttcctcatgccggcctcctacgtgcaaagggtacgtctnctgccgacccatctagggctcacttcgcccaagaccgcattgatgatcttgtagaattatcaacaattcaagctataaataaaataaattctcatgtggatagggcgaccaggcgttcataattgcggagccatcaactacgtcaaggagatggagcagcttcttcaatccctg

SEQ ID NO: 18552 - DNA, 1579 bp, Oryza sativa
acacatacaatgcctgtcccatgcctcactatgaaagccatagcctcaggtgtcacctttgatgctgccattataagatctccttcattctctctatcttcatcgtccacaacaatcacatactgcaatataaacactgtcaacagatgaaggaactacttcaaaaacctaattaatgctagaaaacatgatattttttaataagatccatacttttccttggcgaatatcctcaatagcttcaggaatggatgagaaaccctcagttgggctgtctaggtcaagctcgtcatcatcagcagaaaaaccatcaacaacaggtgccatatcagcagctatggtcccaagtgcagcagcatctgcttgaaccactttagaaggactagcctgtccatttataataacatgttctgaagaatcacccacagcatgagatatatgaaaatttctggcccgatggttatacggcaagtgaacagaactgattgtcctcaaactgtttgatgtagaatttggcataattgaacgatcagaccgcaatccagaagtcctgtgttggctgtaaatgctgctcagccgtgacatgagatttgcagtacaggaatccatctgaggaaaaaaatcagaactatgaaacaagttaggaataaaaatattcaaataatatacccaaaggatgtgatggaaaaaggaattcaaattatttcagtaacgttacagagattttctatgttactaccgcagtaccgccttgtgcaggggagaatctcactttcctcaaaaggaaatttagaataagtatctagtgcctattgattaccagaaatgcggaataaacccttgaaaacaacaatccatctcctaaataaaccaagtcatctagaatctagagtaaagctaaacacagcaaaatcgcataacaaacaccctcaaaaactccaggggcggacctaaagtaccgcatgagattcagctgaaccctcgaattcttttggaaaacaaatgctatctattattactgcacctcgcacgcgtccaagtaatagaatggggaagaaaccggatgggtttgatttgacgggaaacgaatcgaacaatcaactaaatccggacgagctctacaccaagccggctcatgacgtggcgctgagagagagaagaacgatttaccttcgattccgttctaactcagatggatggccggccgcgtctacccctggcctttacctgatcacccggctgtgcgcgcgcgcagccaggtaaggcgggcgcgcacgccgtgccttcggagtccggacctgttcgccgggagcgggaggaggctggccgtgcctccgccgggaggaaggagagtgacagagcggtggcgtttggataaagagggtggtggaaggtggaacagggaaaatacgagagtggttcgggtgctttgttcgttcgggagaagacgagacgagacgagccgcgcgggtggggatggcactatagggcaagtctgcaacgtcgacaggtaggtggcggcgtggcacagtgtaccgatgtaaggaaaagaaaaactaatggaaaggtgcaccggagg

SEQ ID NO: 18553 - DNA, 1629 bp, Oryza sativa
gctcggcgtcggcgtcggcgttagcttgtcggtgccggcgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcgacgaggcgcggggttactgcgtcggcgtcggcttgtcggtggcaacgaggcgcagggaggccggcctcggcgtcgccctgtcggaggcggaggcggcaggtccttgagcacggcgcgtggcgaccagcattttctcgacatgcgccgtcctcctctccacatcccccaccgccgcagccttggccggtgcaagaatctgacccggcctgctcccgtgtcgcagccgccgccaccgccacctcgtcgccccggcgatctcctccccaaccgccggccggcttgcaggagaaaaagtgaagagagagaaagagaggagaaagggagaggaggggagagagagagagggagtgatgacatggcatgctgacatgtgggtcccatgctgactcagccgccacgtataccaaaaccggggttaaaactaccaaaggacctcgggtgactggttttgtatagttaggagactctgtatatctggttttgcggtttgaggacgttttcgtatctcggtgacaagtgcaaggacctccggtgcactttttccaaaactaatacactattatgtccatcaacccatcggacgtgggctccaagcccagaacagagagctagtttgtccagtggaagcccaaatgtattgaccttaggcctaataagagttcataatgacactgaaggtgtgttcactttgttgcaaaatgaaacttgccaatgttttgtaatgctgaagcaaaggttagatggtggtagcagtgaaatattctaaatcaacaaaatttggtagggttgtgttgttgattgtcttgccaaaattttttatgaggttaaaaatgacaaaaagtgaacacatcttgaattttagagtgaattttagaaaaccccatgttttaggaccaatgtaacacataaccacaggttctatttattttctcacataacccaatgcattctatccaattaacacaacaccacagatttaaatatgggaaagtaccacaatgacaagtgacatggcagacctgctccacatcagctggccccacctgccagatcaatgcgtgagctatttagggctgggaagcacccatcctctgttcccgcgcacgcgacgacgcacccctcgtcttcctcgtgctcgctgcggcagttttcctcctgttacaagttcagaggggcagctcgtcgtgcacatgcaaaggcaagcatcgcctgttctgttttgcatcaactgatcaaactgtacatatacttcctatcttctaattatacaaagcttatatatatatttagattaaacatggccaaaacctgacaatgtttctactccagttttttataagtaggtcgatcaccaaaatacctaacactgtgttcctattaaaaaaaaattaaaggaaaaaaactgacaatttctattcattaagcaaaacaatgtagcaaacgttataaaaacattccat

SEQ ID NO: 18554 - DNA, 1237 bp, Oryza sativa
tacatatgaaattgccacctgtgtgatttaatacttttaaaaattgtaagtatcacatataactagcatatacatgatttaaacttgttgaaacctctaataatcgtgcgtaattaacatatgccatacatcaattgatttatatggataatcaatatatccaaaatagtttacatcgtgtacacaataattacggcattacatcggcggtgacggttgaccgcacgtactttctcctcaatattgttccctccttgtgatcgctgcgtgagtaaggggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctgcccttctttcctttgctagacatgtccttcacgaaaaagacttgcgttacatcattggcaaggacaaaaggttcgtccgagtatccaaacttgttaaggtcaacagttgtcatcccactgtcatcaatcattacgcctccaccagtcaacctaacccattggcaccggaacagaggaaccttgagaggaccatagtcaagttcctatatgtcctcgatggcaccgtaataagtggcagttgttccatcgtgtcccatggcatcgacacgaacagcgctgttttggttcatgctcttcatgtcttgggctctcgtgtagaatgtgtacccatttgatctcatatccctggaatgtcgtgatcgacccagacggtcccctcgccaggaaggcaagttgttggttgatcgactcgttacccatgagatgttgtcgtagccacgcggggaaagtatcaatgtgatgtcgtgtaatccatgcatcggacttaccgatgttcctggcgcgaactagagccaagtgctcctcgatgtaaggagctaccaatgaagagtgttgcagaacagtgaaatgggctttatggaataaattgttgtctaccgtcattattgctttccttccaagagttccctttccccgtagtctcccttcatggcgtattcaggtaccccgattgggcgaaggtcttcgataaattctacgcaaaattcgatgacctcctctgttccaaaaacaaagcgatgcctgcctctgacgagccggttcgaacaacttcttcagaacgcccatgtacctctcgaaag

SEQ ID NO: 18555 - DNA, 1311 bp, Oryza sativa
atttaaaaacaaaaacagaatgaaatcttgatcaattaaatctaaaaactttgggctggcttgttaagatgaagacatgaagtttgctgaattctttgctcgtagttaattatctgattcttttcaaaagaaaattaattcttaaacattgaatgcttcttaaacttttccagcagagaggtgaaacaaattatcaacatctattaaaatgaatgcaaatttggcatcatcttcctcctgctttgcctccccccaagtgaatcatgattaacgggatcttactgggatggctgtataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcatgtaacaactctatgtaacaaacctctatctctaacactccccctcaatcataacttatctaagttaagattgtatctgaaattcctaagttgtggagcaccgagaggtttagtaaacccatctgtaacttgatcacctgaagatataaacttgatttctaattgctttctggcaaccctttctctgacaaaatgatagtctatctcaatatgtttagttcgtgcatgaaacacaggattaacagccaagtaagtagctcccagattatcacaccacatacatgcagtttcaggtgaatctattcctagctctttaagtagagcctgaacccacattacctctgccgttgcatttgcaacagctttgtattcagcttctgtacttgatcttgatactgtagcctgttttcttgcactccaggaaaccaaattcgaccccagaaacacagcaaaacctccagttgatcttctgtcatcaattgatcctgcccaatcagcatctgaaaaagcactaacaagagtggatgatgaacgacttatcttaagaccaagatcaactgagaatttcacatatcttaaaatcctcttcactgccatccaatgatctatagttggactatgtaaaaactgacagaccttatttactgcaaatgaaatatcaggcctagtcaaagtcagatactgaagagctccaactatacttctatatctagttgcatctggttctcctagagcagttccactatgagctgacagtttttctgatacagacagaggagtactaacaggtttacaatctagcatacttgctcttttcaacaaatcataggcatatttttcttgtttcagtaaaatat

SEQ ID NO: 18556 - DNA, 8958 bp, Oryza sativa
tcataatcaataccatagcgttgtttaaaccccttggctactagacgagctttatatctatccagactaccatcagactttctcttaattttgtagacccacttgcagtctataacatttttaccatgactaggtggaattaggtgccaagttttattttctaataaagcagtaaactcagcatccatagcatctttccagtttttatcagtcaaagcttcatctaggttttgaggttctcctgtagttgtcagcatgccataccttacagtaccatcggtataaaccttctgttttcttatacctcgctgaagacgagtgaccggccgtgcgggctcagccacggctgtgtcgggtgcagacgatccgccggtcagagggctgccgctccccccatcatgatggctgcttgacgacgtggctgcatgcgactgctccccctgctgcagagacgtcaagccaccggtttcgccgatttcttcatcgtcgggaaaagacagtgcaggcgtgtgcacaggtgagggctgaaatcctccctcgggatcgctgctgccaggaaaaatgtcctcaggatcttctgtggcatccagatccggtgcatctccttcaatatttgctgcagaactgtgatcattttgtgctgtattttctgaaccttctccgaattgtatctcctgatctgtcacatgctcaacaggcacattagattgctcagggacattaggcatgcggtcattatgttcaaccccattagttgcaatattttgatataaggaggaaggaagcaaaagaatttcggatctcagccttgctccagcgtttgcatgtaacctttcaaagggaaaaatattttcatcaaatacaacatctctagagatgtaaactctgccagttgatatatcaagacactgaaaacctttgtggatgttgctatacccaagaaaagcgcattgtttggagcgaaactgaagtttgtgtttgttgtaaggacggagattgggccaacaagcacaaccaaaggttctaagagcagaatagttaggcttttgatcaaggaggcgctctaaaggagtagtatactgaatgaccttactaggtgtgcggtttatgagataggcagcagctaggaacgcctcatcccaaaatttcagaggcattgaagcatgagaaaggagagccaacccaacctctactatgtgtctatgtttgcgttctgcagaaccattctgttgatgtgcatagggacatgaaacatgatgtgagataccaatcttagtgaagaaagagtgcaatttttcatactctcccccccagtcagtttgcatagagatgattttgcgattgaaaaggcgctcaactcgttgttgaaattcttgaaacttaagaaaaacttcagctttactcttaagcaaatagatccaagtaaatttactgaaatcatctataaaactgacatagtactttctgcccccaatagaagtaggagcaggtccccacacatctgaaaacacaagttctagaggattatttgacacactaaaggattttggatagggtagctggtgactcttggcctgttgacaggcattacagactcctgactcattgacatctcctaaacatgggagattattcctactaacaactttttgaacaatagctagagaaggatgacctagacggctatgccaccttgacattgtgggcttgatggctccaaggacttgcttggatgtggcgaatgaagatgttggcaacgggtacagtccattgcggcacggtcctctaagaagaagattcttcgtgacctgatccttaatggcaaagaaacgaggatgaacttcaacaaaggcatgattatcaacggctaaacgatgagcagagataaggttctttttagctttaggaacatgaaggatatttttcaactgaatattgcgtatgggggtatgaataatagaatgaccaatatgcttaatgtccatacctgcaccgcttgccgtgtgaatctgttctttgccgttgtacttctcatgggttgtcagcttgtccagttctcctgtgatgtggtcagtggctctggtgtccatgtaccaatttgtatctacaccataggaagccgcagctgctgtttttgaatctggaatgaaattttcatcatacctgtaccagcagtctgccaccacatgtccaatcttgccacatagctgacaggtggggcgcggtttgttggagaagcgcgcgccgccaccgtttcctcgcccccggcctccgcgatcgccgcgaccaccgccacggccgcgaaacgtgctggtgttgccggtgttgacgttgttgctgaagccgccgccgcctcccttgcctcctcgtcgtgcgctgttgacggaggaaccattagcctgctgtcgcagcttggctcggctctcaaaactcaggagctgggtgtagatttcggcgactggtacagcctccgccttgccgacaagagtggagacgacgggctcataatcgtcgtcgagtccggcgaggatgtacgacatcatctcctcgtcatcgaggggcttgccggcggatgacatctcgtcagctagcgtcttcatcttgccgatgtactccgtgacactgagatcgcccttgcgggtcgtcaacagtgcaagctgcgtgttcagagcacgcgcacgggattgtgaggagagcatcgttgtgatcactctccatgtcgcagccgccgtttccagattgacgacttgggtgagtatgtcctttgatacagatgcaaggagaaatccaagcacctgttgatcgacgacaacccattcctcataggctggattgatcttggtgatgaccttgtcgccttccttgacgtcgatcgctgccgacggagcgcgagtcgcgccggtgaggtacccctccatgcgggcaccgcgaatgatgggaaggatctgtgtcttccatagaaggaaattattccttgtgagcttctctgggacaacttggccggagagtggattggtggtggaattggaggaactcgccatttttggtagatgcgatctcacgcgtgcatgattggctctgataccatataagttggcagaagcgttctaacctcgttagaggccgctgtacgtgttaatatatgtttgggaaaagcccccaaagtggcgcatacaatggtgaagattggttacaaaacagaaaacaaaatctcttcctatcttatcatctcatgcgttgttatctcacgtaacaactctatgtaacaaacctctatctctaacaggctgcaggcacgcgatgcggacaaatgatgcagggacaggacgccagtgctgacagcgatgcacctctggtttccttcccagccgtagcggcgctggttcactacaataattttacagttaaataaatgttgccacaatcagacatactataaagggaggtcaaattggcatgtaaaatcatattgcttgtattgtttcaatcaacatgcttctctaacttccgaagctctcataaaaactttacgtgctttcaaattaatatattcatcattcaacactattagcaatttaactcccaaaaatgacatttcaatgtagagttatctaaccagcggtcctgtacttggcgtctagagccagtgggccttttagaatatcggaaaagataaatgataatacatataaacttgaattgcctctaaagtttgaggttagtcccacatttaacattttcgatttggagctatatttgagagaagaagataagcttgggtcgaggacgactctacttcatgagggggatgatgatggagacatcaacaatttggatacacacaatattcctcaagttgctatgcaagatctaatcactagagctcatgcccaacaattgaaattacatgtgagctcgttcctaggtatttcttttatatgattttgaggactaattattacataatgatttaaatatgattaggaactatggagagaactagagactaggagatggagaaggtcaagatgggcgttcaagtcaagatggaggtctatctcatatcaaattcaagtccatctcaaaaatactggagcagcccgcactaaaatcatcacccttatctcatctgaactctattttcgacgttctgtacaagtatggaaagctaactagaccgcctttctaatgaatctagtctcatattaaaacccctttgaagtcaatgaaaatcatcgaaacaatgggcatccagaatctgtccgggtgttatgtcaccatctttaggcccgttgggccaagtatcatgctagagtccattatggacgcatcagggatctttggtaggctactaggacagctgacacggtgaaggatggacgaacttggcgtcgacagtgttccggcgcccaaaagggctcgggaggtggcagccaaggaggaacatgcaaccgcaaacgggagtggcggcgaggccgggcggtactccggcgaggagcaatggcctggcagagggttggaggcacgggagccggcgagggcgcggatccaacgagcttcgggcagggaggcagagaggccggcgaggaggttgacgtcgcggtgccggggaaggaaccgacaacgtctgacggcgaacgagcatggcggcaggggttgccggagctcgggtggcgcggtggagacagggaggcagctaggaatttgggaggtggcaaaatggagcgaggggagggaggaggctccgttttataggtcggggagggagagccggccacaggaaggggcggattggcggcggcttcaatggaggaggaaggaaggaaggagcgagagaggaacggtcggccagaggaggaagacgaccggcggctgggccgggaggcgaggcggcccaggcgcggagggagggaggcagtgcaggtgggctggggacgagaggcgggatgggccatgatgtggaggaggcccagagaaagggaggccgaagcaggccgcatgaaaggagggaagatggaagactgggctagacatggcacaaggaggagggatgatttattttcagtttctatgcttagaaaactctgtacgttgtttttattgtgtaataattatttttggtgctctaaaaattcaagtaaaacacgaggacgtattggaataaaaattcaagtaaaacacgaggacgtattggactatggataatttaatgaaaatactgcaagctacatttaaattttaaaattttcttgtacgtattttgttgtttctaatttctttttagtttttaataaattcttttttccatttagataatggtttttaatttgggatgaatttgtcacggcatgaaaattggagttcatgtttgaaaatattggagtttggagttgtatagaaattccctagtttgagagatttcctaagtaattaggattctgtaatgcttgttggattcgtgattatggacaatcatgttttgggtataaatagaagggtgtacaattatttggccccaaaatttgaaacaaaaaattaataaatcctgaaatgaatcttaaacaaattcgatgaaattctaaaaggtatgttcatctcaatttggttgaagttaattattaaaagaatactactttttgtattctaagaagcggagaagtactgatttgtgtaatttcccctccaatttcaattttaaatttggttttccaattttgtgtcaaacaattttgtctgattcaaatttttatagatggaatttttttagcttaataattttgttttcaataataagccagcagttacgaatgtgcgaggagcaatataatcatttcaaaaaaaagtaaattgcagaaaaccatcaatattatgatctaagatatataaaataaccaataagttatgtcacacagtacacgtaaattatgtggtttttataaaacactagtattataatcctcgggattatatggcacatgctaaaatacctatagtcttttgcaccttagatgtacccgagtcttctgaaatttatttttgtaaactcttgtttgaagcgcaatgtgcttatactcagttttaaggcttcaggcaatctgctcgccactgcttttcttttatttataacatcttccacctatggacagtctaaaatgataaataaaagaattgatgtatggcacaagtctccaccactttttttatggtatccaactaaaatacgaaatagaaaatattctacacgataatataaatgaactttgttaaaatctataggaactatgttatcgaaagtaaaataaaagatacttggctttggttctaagagtgtaatttcactgtgcacagttttcttctacacttgtagcatcagggacagtaataatgaaaccaacttgaatatataaaataacctatattgagttagaccggccggcaataatgactaaattaaaaaaaaatctgtcgttgcaataacgtcaaataattcagcataaggccggccgctgttttgcacccgcagttttattcaacttgtcgaaaatttgctccgtgcctgctgctcgatattggcagacaactggacgtgaaaatgtgacgctccgaacgacgtaccttagtatgatttggttttagttgaacagagcaaacgacgtaatacctttctcttttcagattattgactctgttgtactattagcaattttccacttataatttattaagttataaagaacttttatggtcagagtattgacaaatttgtttgaaaaaacatagcgattgtgaactaagcgtaagtctctcacgtcggttagctgacactagatgaatcgttatttctgtaatcaggttgggggctgaaaaattaatggccgtcaaagctaaacgtaatcagtttgtcatggtagaatttcactgtccggtggaatcaaccaccttccatatagttggcctaatagtatttcgtgtcattaagttgaatatatggttgaaaaagaataattaattcaagttctaggtcacgtgatcaggtacatacatagggctatgccggtctgctcacgcaatgttctccatatcatatggttcaacctcgtcatgtgtcagggaggaattcgaaaacctgctagtcctgctagtggcagccgtaatattttgctaccgggtccatactttgggctatcctccaaaaaaatcgggtttacaggtttttggttgcagcggcaagttagcaatatcggagaaggtagctagaggttgtttcactcaagcgcatgtggtggaaatttagtcagtatattttaattttcagaaaaacatcatactgaacatgacatgacatatgtgtagaatgatctagtgatagtgctaaacagaacatggcaataacaaaataagtatcatctaataacatggttaacatggttacttggagaatgctccggtactagatgaggcattgttggtgttgttgtctacgttggtgttgctgttctcgcatgtgccggtgcccggtcccgatgccgccacctccaccattgctgccttttgataggaagaagaactagcagtgcagagtagatgaagaggaagaggatgagagcagtcgctctagaatgcgctccccaaaaaattgattgtcctgtgtgcgtaggtgatcggaaccagagacacacaagaagcgtaggaacagagaaaacaagattttcccaacaagagaatcagagttcgagagagaagatgtactgggcatttgtgtgtactatgtctattctagaggtgggagttatgtagtgcatgagagagtaatattccgggaggaatcaaatcgagattgaattctctgtctgttggtggagtaacgggagtgctcgaatcaatctgattgaattctccgtctattgttgcagtaacaagcgcctccgtcggttatatcttcaatcaaaacataacgttccgttgctggagtaacgagaaggtgggagttatatagtgtacaagagagtaatgttccaggaggaatcaagtcgagattgaaatgtccgttgctggagtaataagagcgcccgaatcaatccgattgaattccccatctgttgctagagtaacgagcacctccattggttatgtcttcaatcaaaccataacgtttcgttgttggagtaacgagtgcatccatcagttacatctttagttaaaacataatgtttggaaatagagcagccagcccttgccctggcccggctcgcgcgcatgcgtgtggcagccccaccaccaccttaaccgctcaacaattgctctccaatagcagtctatttaagttgagatccctccacgttgattttcaacgtgatattaattccttaacattaattatgggcacatagaatttattaggattaaattggtccagcttatttaatctaacacaatcaagtatgcaaactgatagttattagtgtgtattcacccaaaaactttgctttggctgtgcaatctaatgatagttgtatcaactttgagataaatgtcttatttcaacaaaaatcgccctttggaagcaccactacgcgctaacagttaattgtttaattatcttcacttccctggcgtttgtttattttttgatcctttttagttacaataacactggcagcagtggcggatctatatattttctaaaatctgggcagttctaatgacacacatattcaaacaactctatgggctatccatcattaatgaaagccaagttaacgctatcaaattgtggtttagaagagaaaaaccattttgatcaatagattagattgattggacaataattatgtattacttaattagtgggctatatgttaatacatgaattgtgatgctttgcccttaattgcttcgatagtttgcctagataatctagttcgagcactcatgctgtcatgcattctttactggttt

SEQ ID NO: 18557 - DNA, 1816 bp, Oryza sativa
aatgattgttatatttgtaatgcaattaattaagattattagacctgtaattggacttatcatataagattgtgtagtgttctaatattatttgagttttaatataagattactttatttataattagacttagtatgtataattattgactacggaattggtgcgacaagtagcaattgactattgtagtcttaattagacttagcatatacgcacgaaacacttagcatatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattgtagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaaaagggaacgaggatccaaaccagtacttgaacgaggaaggaaacgtggagagggatgcggaggggaaccaggaggaggaggctagtggtagtcaaccctccgttggacagaagagggcacgcgggcaacgaggtgcagcgaagaagcttgagggtcggcacatcataacggaagtgcaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactggaggggcagacaccgaacttcgacacattcccaaagctaagggatcacttggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagagaaaggggtgattccttggaagattggtttcaaggaggacatccacacgtacaggagtcggatgaggagcaagagagataccgaggcgaaaattgcagacctagagttccgggtatcgagctacgaactcaacatgcaag

SEQ ID NO: 18558 - DNA, 1633 bp, Oryza sativa
  unsure (1)..(1633): unsure at all n locations
atgccattattctatggcgcaggtggtacatcatcctccatgggcgacaagcggcgtctcgtgcaccatctcctcgggttccgccatctcctcctcaggatcntgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctccaccgcctacccacacaagggcaacgaagaaggcgaaagttgacgctgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccttctacgtctctattatgagttgctggatgttgtcagtatatcgttcagttagatttcttactatacgcctcctttaataattaggcccttgtatataagtagactatagaaaataatatactcccttttatcgttgtagaatggagattcaaagggcccgacggcggagggttttcgatactggattcatcgaccctcgaaaagtaaacgtcgcaatgctcgaccaatatccacaagaaacagaggacaatctcgtccatctcctgaaggcgcagcattacaagacgttcatactggtgccatacaacacagagttagtttaattttactgtcttcctacataccaaatttcattcccgtatgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccctcatttggtccgcggcaaatggacagaaagacttaggcggaagttcaaatttcctgtgagtacacatgctctacatttatatttctccgattcaaatacatacaagtgtat

SEQ ID NO: 18559 - DNA, 5276 bp, Oryza sativa
tgagaagagaaaggaggccagaaaggagtagctaaaacatgcatggaaactcaggagttctcttgcgatcagaattgcttcaccgaggcacatgatacatgtgacctgtgaccatcatactattagaggtcatatgcttttgattttatattgaattacaaaattaccataactatctcctcaaaattacatagatttaatgggatttaagctatgtgaacagaaatatcacttgcgcaaaacatgtggctaagctgtataaacatcaacaattgattggagttaattaatctcgtttattttgcattttagatcttttgtttgaaacaaattcaacttaaaataagactgaacgcaactatataaatattaatatgttatactaaatatattttcagggtatatgtaacatggacacgtggtctccatgtgttcaaacatgtgctaactgctaatcactttttcagtagcgcacattcagctaagtgttaactcattttgagtgaaaaataatcacaaatatctgaaatttcgatagacactagttaagcataacagaactattatcggtactgaaattttggatgttttttttcggttctatttgattgtcttctgaagtaaagaaccaaccaattcagtgtcctggtagcacaatgtcaagaatcaactcatgcttaatcaccagcgtttatatagaccagatctcctgttttcatgcgtgaaacttcactgtataatgtggtaacactgctacagaacccttatgggtaccggttgggaatctggtttccagtcggtaccaatttggcggcaccaataccgaaccgcatgggatactcctatcgtccaacaagattatttagatttccactattattttactataaaattaattaataatgcacttgcaagaatttctaccaaagtgctaaaatctacatccaaaatgctaaaatctagcaactagtgaaaacacatgcatcaataaaagaaacggagatagaatatagagaaattaaccttaaataaaaaatttaaggcaaaacctcccctcctctagctagacgagtagaatagaggcgccactagctctgtctactcctggccagcttgaggtaagtaggaggtatttatactgcacacaataggtgctggttcttaggacaaaaccggtacctattttctattataggtactggttctatgttaaaaacagacccaatacccccaagcaaaaatcagcacctataagtgggcccaccttccgaaagtattggtggaccgttagtggggcccacttataaatgatggttctgtcataagaaccggtgcctacacctccctgcatataggtgctgatttttctaaatgaaccgttacctataggtgggcccacaagtgccaatgtgccggccggaccaactataggtgtcggtttttggttaataatcgacacatatgcttgttggcgaaaaatccgtgttcagccgatggtgccaaaactgtgttaacacggactaagtcgatgaacacaatagcctgggagatatgcttagctccagtgcaagtccaaaatattgatgagatgcgggcgtgccagtcagtttgatcctgtagctgataagatatgcaaataacagatcaaatagccgatcggctgacaagccgatggagtaattccagccgatgccgataccagccgatgccgataccagccgatgtcgatagggttttgaacaattggctatatatccaatgtatattctgatacttgagtaaaaaatgatataattaaagacaatcggcgggtgataatcaatataattcgacaatataatctagtagaaactaatcggctaataatgatacgatagaacaagtgtcgatccaaaggttaaagcatatattggctggaaatccgatgttataaaattcaagagattaattagataaacagtgaaatctttgttgcgatcggctaaaactaacttgtatacaatccttgtaagctgattgtttgtatttcttaacgatattactagaaatataattcccagcaatggcgtagaaataattcctggtatattatggttaagtttatccacaagcgcacggatataccattgtagcattccacccaagagtattccaagggtatcgtatttgtttaatcccgtgggaagattatagtagagagaaccgtactaataatttatatgttacttgtaataatcatagtctaagcaggggttaatataatccatagggtaggatgacatacaagcattgaactactcattctcatactaaattatctaagctaagtggaaagaaagtagaaaagaatctattcctatacatctagtatacatattatacatacattctagttatatgattaactagctaatgccctctttccgatgccctcctagtacttcgagaagccacccctaactgttgagttccttacgacagcccgtcatgaccatacaaccggagctaaatacgttcaccaggaaattaacttaggactatatacacgcgtggaggaattcccgtactgagctatcaccatcagcggctgtcggtgatatgggcctgggggtatcacgtttagagggaggaggccttccccaagcccgcgtggcttcccctgaggggggtcgagcccggggtggagcggcggctgccccctcccagcttggggtcggggctgcgccccaagcccacgtggctcccctctaggagggtcaagcccggggtggagcggcggctacccctcccaacttggggtcgagcccggggtggagcggcggctgccccctcccagcttagggtcggggccgcccccaagcccacgtggctccccctgagggggatcgagccctgggtggagcggcggctaccccctcccaacttggggtcgggttgccccgacccgctccccgtatcagcccacgtgtacagggttaggtgggcacacctaacgcccacctaaccgcatttaaagtggtccttgcagccatgctatggcacgccgcatttaatgcggcatgttgcacatctgacaggtctgtgaccgatttgtggctagtctatgaccggtcgaatgaccgatgggacggcggctgtgtacccccaccctgtcagtgtgccaggcggcatgcggcgtgctctgtcccgtcacatcataatgagaggctttttagtctctcatcatagccagagtcggtttatccgctctggtcaaacaggagcccagaagtcttcatctcttaaatggcaactgacaggggcaccccctgtgtcaggcggcaagatttgacgggccacatcatcaagacgacgtgcgcttggcttcccaaatcaagatacaagacatggatttaatgcaaagattgtaatacttctccactaagttaggttgttgggcccatgtggtaaccccttaaggtataaaaggaggtctaggcctacttaaggagggggatggacagattgaggggaggatgagccattttagactctagagcagcttctgcccctcatgatcaacaccttctactccaacaaggagatcttataatttctcccacaatcagcatagcacaggagtagggtattacgcttctcagcggccggaacctgtataaaccccttttgtctcatcgtcttggaggggcctaaccccctcaagatcacacagtttcgctctccaagccctcgaatctcacccgctacccccggccgaaccaaaaaaggggggcctcacggttccctggtggaggagttcaccttccgacaacggcccacctctcatccgcagcatataaccccaaataatgattcccgataatttagacaccacgcctaaactaccagatactactctaatatcatcgttatgacatagagtaattacaatagcaaacattatacccgtacctatgcatctcctaaataagctagcagtataatcagtataacattaacataaagtaaagttggtattcatatactcggaaagtattttaataccagaattgtataaggaagaatattctaaataaagtacaaatcttacaaaagagaaaaggagagctactagagccatacctgaactcttccgaagacttccagacttcgatttctattctattcctactcactagcttgagaatactaaactaaacttgagagaaatgagaaagctcttgcttgaagtgtgtgttgaaatggagggagtgagagccttttatagcttgagtatgacggttatgacggttggaaaaggtcggtaatactctccaaccgtcactgtggatcaatcccagccgtccatcaaaaccctgcatcgaacgaagccgcggtgggttcggccgaaccatgggctgggctggcttggctcaatttcggcaggtggcctcctcttttgctcccatacgcagacttgtgaattttggcccaattggtcatgtcatttctacattgttggtccattcattgataagtctgattctcgacattgttcgattgattgatcgtctgatttgatgtcgattctcctccactttatggttattctcttcaaaaggttagtaatcctaatattagtgaaatattattattctaacataaatatgcattgcaagcataactagttctcctctattttggtagtattgacggtcgaaattgatcgctaacgaccgtcaacaccgatgcaacatccatataactcatcggctaaaaccccgatgaaactcttattataatcaacgacatgttatgttttatgattctaaacatgactagagatgatgcatcgcaaagtatgcaaagaagcataaagtctaaacaatcaaacctttgagtaattttcagggtggtagatacattagctaatctaatctagcaagataatttagccgatactagcataaaccctataacaaatctcagccgatacaagtaaattacaatgctaaactagattgactaagatatatgataaataggttggcaaatatgtcaaccgaatcagagcaatccaagaggttgaagcgatgcagccttgaacaacgccaatgtagcccaatacaattgccatggccggtggaacgtaagacttaccctttccccggagatcgaaagccgatgcaaccccgcgtcaggtgccaagttccgctgtgataagtaaaaacctcggaaaagaaagtggcgatgcgccgagagtagttgtattaatctgtggagatagtttacattga

SEQ ID NO: 18560 - DNA, 13863 bp, Oryza sativa
gagtccatttgtgggtgtgttttttttctcgtaaagataattttcgatttagttgctatggagataaaaataacatataatgaatggtagggagagaggaacgggacaaacggttgggacggagttttgggatttccttttaaagatagatctaaccatataagatagtgcatccattgattcaagtgtaaactgatggttagatgttttgttttcatttgtcacacttatagatttttttaatttaatagtgtcatgtggcaaatgacttagaagcgtttataggtgtaccattaggcctagacatttgtagttagaatggttgcatgatctaatatttagataacaaaatatgatcaatatggattttgaattttatatttaattataaataacacaccacttaacaaaaaatgagaataaaattgtacttgagggttatattatttagatgtctgaattatttttttgatatattgagtgttaattataaaataggataagttagctagaaaataggagaggaggggagattcggagggtggaaagagtatgtacagcttttttttacctcatgtatgtaaggtgttagtagtggggataccagatttattttctttgagatggagatctaatggttaaaattaacgggtccaccaatttaaaagaaaattgacggtgtgattatagaatgtcacgtgacgatgtatgagcgtttatatgagcgtctatatgaagtttaattgtcttttagtatatataagtccattgaacttcccacgaacgcttttaaaccggcacgtggcgctcgtataaatgcttgtaggtcactacatgtcatatctctaaattaaaataaatattaaaaattatgagaaaaaaaatcaaaccatcgattttcccttaaattggtaacatgtgattttatatctattaacacttcccccctaaactcccgtacatgtacgtatcgtatcgtagtaatagtactgtttgccgaatgtgtaaagcaaaaaaagtattgtttgccaaaaaaaaaggcgaaaaaaatactaacgtagtaacgtatgtatgccaccaggaaaaaaaatagaacgtatgccaccagaaaaagaaaaaaaaagaacgtatgtaccctgcccgatcctcactggcctcttgtcctattatgggattctctttttttttctatctattagttaaagcaaatacggtaatttttctcaaaaatagtggggatgatttttctctaagggagatctaacgcttaaaattaacgggtccaccaatttaaaagaaaatcgacggtgagattataaaatgccacgtggcgacataggagtgtttgtaggaggccatgtggcggcttgagagcgtttgtaggaagtttaatggacttttagtatataaatgatgatagccaatttacttctattcatgataaaatgctatatgtatttgtatttgcttgttaatttattttctatcattaggtttgtgcaggctaaaaaaaaattcataaatccgccaccgcgagtctgtaccaagaaatttcacgcacgatggcgtcatgcatgtgtatatatctttagctgcacgacggcggggaaaccacatgcttgatgctaaaggtaagcacttatagcatttaaaacatattaaaatataactgattgcatgtggcattgtttagagtaaagggtcccattaaccatgacctatatatatatatatatatatatctttaccattttcccacccctaaccatccatataaggagtgttaaagtgtttttaaaaccttaatatctgcttaataacatgtaaattcttatattttgtaaggatgtaatcatgtaactgttggaaatatagtcatatatcggcatattttaatccaaaatattaagacaataatcatggcatgaacaatgtgaggtgatctagtgataaaattaaacataaccaggagcgtgcttaagatagaataagcatcatcatcatgtagagaacgcaatagcattgcgactaacagaagtaacaaaaacagaaatagcggtagagagttataccctgtgaaagtccctccgctggattatgtggcagaactgcctccgttggtattgtcgatcggggcgccagctccggctcccgctccaggtgtgccatctctaggtgcgacaactccagacatggtgatgcagatgaacagacgacgaacagaagaagagcagtcgtgcaaacctgatcacccgcctacccggtgcagatcttaggcgaatgtgtggttttagaggccctcctcgtcccgatctctcgtgtgcgcaagcgatcagaaccgggaaaaacagaagcagcacaggcgcgaggaggaagaaccagcgtttggaaactaagccttgagatctgatcggggtgctctatttcctaatagcgcaggagaggaatccgcccgttgccgcagtaacgatgcaatcaatcgcattgaatcaactatccattacagaggcaatctcgcgggattggattccggtccgttgcaaaaaggagagagagagagacgcaacgcatgccacgccacgcctcgcccacagcctcgccccggctggctcggcttggctcggcgcgcgcgcgtgcgcgtgtggctttctaatccccacctcaaccggtcaacagcgagcctccaataactccctatttaagttgagatactcctcttttaattctcagggtggtattattatccttaacatttattatggggccttgagatttaatagaaaattagggcctagcccatttattctaataatccccaccaaatttcatggctcataagaaatgttctcaaagttgaacctgtttgatataccaatgttttggtagagactgttaagttgaacttccacctagaaaatgagctacatcagaccacaactaaacaatggactatgccttgaattgttagtcttgtgtgatcaggtttcactcaaacccttgattggtactgggttgccgtttgcatcccctctttttggagcatataagtcaaactcaaggccctttcatgagtatctagagatcgcccaaatctcatagactgtggctagcagtcgaactcatataggtgtgttccttttgagatgttctgcaggtcaacatctctgcttagaaaagccacttggaccacattaaggcataagccatcctaccatgcagaatagaagagaagtacatcatgaaaatgagccatttttaagggtctcttctctcagccacacaatagtttgtttcgccatccaaattcacgggatttccgatcacaatggacaggtttccactattgtgtgaccttaggtgggtatcaagcccatttccctcaatgcactgtctatcacattacatggtagccccttggtaaactgatctgccagatttttagccgtttggacatagtccaatgctatcactccggagtttttctgctttctgacagatttcagtcttcttttgatatgcctagatgacttcatgttgtcatttaaactgttcactttaataactattgtttgattatcacagttcattaggatagctggcactggtttttcaaccaccggcaaatccatcaggagtttacgaagctactcggcctgaattgtcgtagtatctagtgttgtaagttctacttccattgttgacctcgttaagatggtctgcttgcaagatttctaggaaacagcgccacctccaagtgtgaacatatatccacttgtggcctttatctcatcagcatcagatatccagtttgagtcactatacccttccagtatttttgagtacccggtatagtgaattccatagctcatagtgccctttaaatagcgcattactctttccagagcctgccaatgatcatctcccgaatttgagacaaaccggctcagcttacttacagcaaatgagatatcaggcctcgttgcactagccaagtacatcaatgaaccaatgatttgggatattaatctaaatgaggataaagatatattttgatggaatcttcatcaaaatggtatgttctctatccatcctatgtacttagctgcaatcaacaatggttatatatattgagaagaacaaaatgggattcctcttaaaataaaaatatttatgtgatatttgcttaattaaaggggatatcttaaacagggataatttagcaagactaaattgggctagtactaaaaaaatgttgcttttgtatgcatattgaaactgtccaacatatattctttgattgtcactttgctaaatttctttggagattggtccgtatttattttggcttgaatccaccaaataatgtttcacattttgggggagttagcttagtgccgttgacgtaagaaccataaagcttattttagtagatccatatattttatgttaggttctttggtttaccatgagtgatatggtgtttgacagagctacttttaaatcttatatgcaagtacttttatatttattggctgcagttttgggcccaactataaaagtgtgataaaaacaaggaactcatatatgtattgtacgccagagtttggagaaaatggtcatgcaaatcttcactaacattggatgaagattcaccaataggaagcctcctaataatgtttctccttcttgtcatctttttcattagtatgcatatttactgttgattcagttgaaaacttcataggaagtgggggtagcttgttcttaagtcaaagccggattatccattatctgctaagaaagaacatgtcgtagttatttgatactaatgttctaaaagagaaacatttgataatttaaacaacgtaactagaaaaataatgtgccctaatcgaatcataacaattcaatctacatctagtgtacatctagctagaatcgttaattttgaatttgagttattaaataaaaaaactaaacgaggactccaagatgaactttgaatttcactaaaatttatgcggttttaaaccaatgcaagtataacatacaattattgattggtaatattgaaattgcctaattaatcaagtcagaactaaactttacactgcacgccaaagtggaaggcgacatatataaggcacttaattataagacaattaggagcatataaatgtaaatgtaaactagttgaatgcacatgctttgctacgggtaatttgacattatatgtggctatctatttagatttggttgatttttaatactaagaagttcaaggggtaatgtgttttaggtttattttcatgtgaagctatgcgtaggtattttatctcttacttacacgggaaatcaattaggacggaattaatttttaatagacgtaatctagtggttcaaaataacggatccactaatttgagtggaactaaatggatagatttttttctcagaatatatatgattttctctaatttattagagcgtcacatgatggtctgaaagcgtttgtagaagtgtcacgtggagcgtttataggatgtttaatggactttaatgtgtttgaaaggagatgaaaagagaagattgagatatacaaaatgaggtgagccattaacatatgatcaattgagtattaactattttaaaatttaaaaatagattgatatgatttgttaaagcaactcttattgaaaatttttgaagaaaattaaacacaccgtttaattactcggaaagtgaagagataagtcttctcttaatcggcagctgccgaacgcagccttaagatatatcttatagatagatagatatatagataatagatagatacacaaaacagcacacgtagatgttttgaaaaatctggcaactgacaaacaagcagtgggtcatatatccagcgcactgctatataaacaccataagtgtgtgaggtggtctgcaaaacaaaagtgcgagacgtgccaagcaaggcgggcggagatcgatcgagatcgaagaattagttgcagtgatttaattgtttgcatggcaccgacgacgaccatgggaagcgccttatacccgctcggcgaaatgcggcggtcgcagcgcgccgacgggctcgccgccgtgctcgccatcggcaccgccaaccctcccaactgcgttacccaggaggagttccccgacttctacttccgcgtcaccaacagcgaccacctcactgccctcaaggacaagttcaagcgtatctgtacgtgtaaacacacgacagcctctctccttctactatccaactcttctcagtcgatatattaattttgcatatacaacctccaccgagaatggattttaaaccctcgagaaaacgttcacacgtccactcgttgtttacatatatcacccaaatggttacaaaataaatttgcaaaaaaaaagatgtattagcatgtgatgtatcagtcgataaatatacatgttaaaattcaacttttacaaattacaaattataaaaaatatatacaaattagaactcttacaaactacaaattataaaaaaaaatctacaaattaaaattcaaagtattagggcggatgtagtatatgtttttgcaagtttagtgagtagtgacaatgcgagagcatgctgtccatggtcggtcgcaggtcaggaaatgggcgtgcagaggcggtacctgcaccacacggaggagatgctgtccgcacacccggagttcgtggaccgcgacgcgccgtcgctcgacgcgcggctggacatcgccgcggacgccgtgccggagctggcggcggaggccgccaagaaggcgatcgccgagtggggccgcccggccgccgacatcacccacctcgtcgtcaccaccaactccggcgcccacgtcccgggtgtcgacttccgcctcgtcccgctcctcggcctccgcccctccgtgcgccgcaccatgctccacctcaacggctgcttcgccggctgcgccgcgctccgcctcgccaaggacctcgccgagaacagccgcggcgcgcgcgtcctcgtcgtcgccgccgagctcaccctcatgtacttcaccgggcccgacgagggctgcttcaggacgctcctcgtccagggcctgttcggcgacggcgcggccgccgtcattgtcggcgccgacgccgacgacgtcgagcgcccgctgttcgagatagtgtcggcggcgcagacgatcatcccggagtcggaccacgccctgaacatgcggttcacggagcgccgcttggacggcgtcctcgggcggcaggtcccggggctcatcggggacaacgtcgagcggtgcctcctggacatgttcggcccacttctcggcggcgacggcggcggcgggtggaacgacctgttctgggcggtgcacccgggctcgtcgacgatcatggaccaggtcgacgcggcgctcggcctcgagcccggcaagctggcggcgagccgccgtgtgctcagcgactacgggaacatgtctggcgctacggtgatcttcgcgctggacgagctgcgccggcagcgcaaggaggcggcggcggcgggtgaatggccggagttgggagtgatgatggcgttcggcccggggatgaccgttgatgcgatgctgttgcacgccacctctcatgtgaattaagttaattaattttgtttcatgtagtggttaattggatataatccggggttaccggaattatattcagtgaagccaagaattaagcgtttcttcagctcgttttctgaccgaagtcggatgtgccacgacgtgggatagcgcgtttgttgcatcgtgcgttttaatcggtcatgtttgtgtgtaatatgaaacaaaaaagaaaaagaagaaaagtttgtagtatgtaacaaactcccacttgaggagatcaataaataaaggagaaagaagatcagaaaagctgcgaattttgcagcaccaaactcttctggaatcgctagaaattaaacagtgaatttcccttctaacagtcggattgcattgacattcgtccggggttggtaaaagaaattgtctaacacatgcactagctaaagaaagaatcagcctcgcaacctattgattgcagtctcgctcgtggcgctagccaactatgtcgtgcacatttttttgaatagttatatatgagtacaagttaaatatacattttttttatagctgcccccagctcttctctcgctctctcctcgttttcagtttttctgcaccgatattatagcacataaatctaccttagaacatcaccttaaaataaattgtaaatttgtaacaaattgattattaaatctatagttttgtgatatacctcttaaaactatagtttcatgatatatagtttggtcgatgtatcaatagttttctgaattcactcttaaaaaatctatcttagttgagcttaagatcttgtttgagaagttgcgattatgataaacagctcataaaaatctggggaagttaggtttcttaatttctagcttctagtttattttgtgagttctactcatataaagtttggggaagttaggtttcttaatttctagcttctaatttattttgtgagttatattcatatgaagtttgtcatttctttctctcaaatgaagttgagtttggacttaacatttagtgagaatttatttcttatttacacctatctctaatattttttcatgaatttacaaaatattaaagtatggttttcatgagttttcaacacatagctcatttccccaggatatttccttttcttatattttgggtaggcaaattttgttacatgatgcccgaaatttctataatatgcttgtagacatcacaaaaatatgtgatagctgaaaaaaaaacccaaaaaatagtaatttgttggagaacaatttgctgcacataaattcttgtagaacactttgctggagataaattcttaagaaaaacaagaatacccttaggaccacatgctttaacacatgatgttagagtgaaagtttagaaattatgcaactttaaatttgtgatcaccttaagtacatcgcaagcgtacatcatattccattttcactccagcctcaactcagaagcttttggccctaggggcattctcgtctttgaaaagaattctctcttcaattgaatcgaaagtattctctagcaaattatcagttttttatggtgtctttcagccataacacgtttttaccatatctatcagcaaattatctaaaatttgaggtgttccgtagcaaaatttatcttctgggtaagaatctgaacagtttggaagagaatggggttccttcgggagcacagaaacgccattccatatatgttgccgtgcacattgctgagcaaaaatatgaagagtggcggatctagaaataaatagtagtggggtctaagcaaactagatagagttacagtccccctcccatggtaaaaaattttagtggggtctttgtggggtctctcatagtcttcacgccagtaatggagggctcgagaccccgccgcccccatgctggatccgccaactctatttggttcgctctttatttagtaaaatttaacactgcattgtgcttattaattacttcagtaatcaccgttgcctgtgaatatatctggccggagcagtccttcacaaggctaactgccacatctggattatattaccggtaatctggtatccgctataatgggcatgtgaacccattccattgccgcccgtataccatctaaagcaagctaatgcttcaaccgggtaatcttttagaaaaccaacactcctcaggtagtcaagccgacaatcgagccgacctggatttttatatatggatgactctgtctctagagtccagcctctctctccctctctctctctctctcgccactctctctgagcctctccgtctctctcttggttactgccaccactcctatctacgttgccaccaccgcccctcatctctgccacaaacgccgtccctcctcctctccgctgggtttgttgttgtgagcaagggggtggccaaatctgccgccacgagcacgggggcggttggatccatcgctgtgagctcagggacggaccacttgatgccggcagcggctccctcaattgtccctggcacggcgactccctcaacgaatggtgctgccctcccatcatgcggcgctcaagagtggacttcacccacaatgagcagtagtggcagtggccttctctccttcggtgtcctcccctctgtgttcttggattttatttttgatatgtggatgttgattttgttcttgaatgttgattctgtgttttttgttgttgaccgatctcaagggtgatggggggcttctcgactttttggatatgtggaacatcaaaggtgttggtttagaaagggtacctttagttccttctcatcactcggaatgcattgatatcgcgtctatcttccatgttcaccgtcgactatgcccactgggagttgttatttcgtttgaaccgttgagggaaaagaggatcaaacctttgtttttgcagctgtcgctaggacgtctccgaagatgcacggtggaaagactctgggaagtgtgttggaattaatgaatgggccttagcccactcgaagattaattctttggaaaatcacaaaagcccacctcatgagatggcatgcatgtggagtttagtaccaccttgcttattctaggagagggggacctccttaaaagggaggatgctctcctagccacttgaagcatgtgtggtggagagaagaggggaaacacacgcgcgcgctcgctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtacgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcatcacctcggtacgtgttcaatatgttgcgcatatttgatatgttcatgttattctgcgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattgttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggataaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcattgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacacctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttccccatgaatgatacacatagtggttcgaaccaaccccctgaaataattcccagttcaatcacaccaccagaacaaactg

SEQ ID NO: 18561 - DNA, 2140 bp, Oryza sativa
taaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacttctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttagctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccactagaagcatgtgtggtggagagaagaggggaaacacacgcgcgctctcgctcgcctcgcctggcctggcctggcagggcagggcaggcggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccggtacgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccactcgccggcgtgcaccagcgatcgggagagcaggtctccggaacctctgcctttgacgtcctgcaccgggagaaggcggcaataaggtttt

SEQ ID NO: 18562 - DNA, 14156 bp, Oryza sativa
  unsure (1)..(14156): unsure at all n locations
ttttggaagcgctcgcgcgactgctcctgttcgttcgcgacggctcgccttcctcttcgctcgcgtgtttcgtgccttcgtaaacacctgcgaaaagtttcgaccaagcagccggtcttttcgtcacctcggtacgtgttcaatatgttgcgcatatttgatatgttcatgttattctgcgtagtttacatgtgtagatctaatgatgcgttcatgctagttttcatctgtaatgtcatgatttatttatagaataaattaaatcattatatgcccataatctcaacaaagtgattgatgaagctacattctactagcttttcggagttcggaccaatgttttcttctcactgcctgcaagattattgcctttctaattgtgccggcaggatgtctggtggagcaaggaaaaatatataaggagaaagagcccttctagttttcagttcatttctaaataactaaccaaactttatttcgggattggtgggatgggagtatggagttggctccccttttggccgccatgaagagcattagggctatcgcctattgggaatttggaattaacatattcttatgagttactttctccgtttcacaatatatgtcattctagcattttccacattcatgttgacgtcaatgaatctagatagatatatatatgtctagattcattagcatcaatatgaatgtgggaaatgatataatgacttacattgtgaaactgttggtactaacaaattagtctacagctataagagcaagtacaatagtatagccaactactagctccaattcatctatagccaatctaatagctcattcatacaatagttacatactacactattaatacctggtcccacctgtcattcacacactgtgtcttggagtccgtgctacagctggctacaaatctgtagcccgctgcccttctctctcctcgtttatcttcttaaaatatatttacaactggcttatagcctgctattgtacctgctgtaagccagcacacatcattcatgttttatttggttaatccctcccccaaatggattgaggaggatttggagggaattgatttcatatctattatgatgtgtaattattccccttcaattccccccatcttcttcaattccctacanaacgaatatgtaaatgagatatgtgcttaccgatgtgtaagtggggtccgaaattaccggaattttggaaatcgcaatccctgccacaagagcatcagcttgtgacgtacccggctcagtcacgtacgtggaccgtgctcaaagcgctagctggccaagcacaaacacagctacgtcggttggcaggtatgccatccatacgaggaagcggttaactacgacttgatctactcctttcatctaattcaagacgcgcacacatttttaaaattttactcctaaatatttgaccaataatattttatcaccttatatatgtgggtttgccctcattatctgtgttagttaatttgcaaagttagaaagatggacaaactggtaagatatatatatatatatatatatatatatatatatatatatcaaccagggttaggctgtttgactgcttgcctaacccagtttggtgcataatatgtagacatttctcgcgcaattacaagactaaatctaatagtttaacgtacgacatatatataaatataataatgttcaatgtcacaacccatcttgatttctcagcaactaagtccgtgtggatctcatgttcaaccaaaaatgatagcacctatatggcatgtaattaaagccagtgctttgcacaactcacatttacgtccttcgcctgatacccatatataatgtcctcatcaagttccacctgttccatatagaaataaactatagtaaccaagaaattaattgtgcatctcctaattataacctacaagagaacataaattattccagagagaaaagaaaggtaattctatatgtaccaaattcatgttctgtataacaagaaagatcagtgtagataaagcaagtggtatatgcccactttccactagcaactagctagtttttatcatactatcatggatgaataacaaaatttcaagggctgatcaggttattattaataagaaaggtaggtgtaatggaggtgacaaaatgtatgatgccctcagagaaagaatgatatattgtgatggttgatttacctcagttggcttcttggattttttccctatatttgatctcaaatcagaacctagaactttgggtttctttgctatccgttcatccgaaagatcatcttcattcatctcacctgccatcaatttagatccttttttttcttagcgaaggtcacattggaaaatggaaatcacatgctattaaccttttatctgataaaagaaaggaaaaattagaaccatgccattataattttgcaaaatttgagatatgccatcctgaccctactgatgacatatctcaaactttgcaaaattataatggcatggttccaaatcacctaaaaaaaatccaacatctgtaacgtattagctggccaatgcatattaaaattcccttcacatcatcacacggtacgctgaaaattatgttcaaattaaatcaatactagcggaagtcacattaccataatcaccaccagggaggccttcaaagtcttccatatcttccatgtcatccatatagtctcttcaacatactcttccacctcttcctgtattgacaattgaattcacgatacatggattagttcacgaaatgtgagatgagcatgtctgcgccaattaacgatcgatgcttacttcttcatcttcctcaggatctacatcacctttttccatgtcaagaactttgaagggataactatagatcatgccgtcatcgccgcaaagacgttccttcaattccctccgcaaagacgttccttcaattccctttggatagcctgcatgccaacaggtatatcagaaataataaggcaaactatgaaacacatgaataacatcagaaataaaaaccttttatatttgagcggcatgttcagctttcgccattctcctgagatctcgctgagtctgcttccggggcattgtcatcagcttctctctgacagggcgagataggaagatgattataattttcataaaataagagaagtcaacaaaagaaagtccacaaaaagaatatacatcaacaacacaaatcagattataatgaaactgctgtactatatatgtaataccatcgaagttgaaagttgcggtctactgctacccatattatttctccattagtattaaaagaagttcctataacgatatgacaccacatagaagtgtacataaataattactattttctctttcaacaacgatatggtgtaatatgatcaaaacaatataagcagaaaactcataatgaaaacactatggaaaataaactgaagagctagcctacctcactttcagtcgaagcttcctcattcttatccgatactgagtcatttttgtcaggcgctgcttaatcttgtgcacaagtaacttgggccaaaattcctacacaatgaaggaaagagtgaaagacaagctatgagactaagtaaagttgacatccagatggggaatgacaaaatatgtacgctcgaagtgcatacaagatgcctgttgatgacttcaattgctttctcataattccttggtagttgaccctctcccataatttatttggatgatgagctctttcagctgttttcatgtataggtagaaaatacctgcaaggccagaaaaaaaaaaggataaatacaaaatacaaacagaataatgtaacaaaaaagatcagatgataggcataatttctatatgggaaagaattgggagcatatatcacaagtatgcatgattcaattgaagattagactgcaatatatctgcatccttggacagttagacgaagagcaattttacggtccttgagaaggtaccataaagtcctattttttctattattaaattggtacctcattgtacctaggtactatgaggtaccaaaatttacactaaaattttggtatctcatgatacctcctcaaggacagtagaattgctcttggactaaaggattctgaaagcctataagcaattcactcatggaaagaaaaaaaaacactttctgcagtactatggagtatattcactttaaaattaactaaatgaatggacttttaggcaaaaaaaacattaactaattaataagcttccatgctggctagaccaaactaaaaaaaaacagtcatttgttgtgtttaactttgaggttttatatatccaatctactcacaaatcaaaatatcatcgatcttataagggaattaataacaattatcagtcacaattaaatgatttccttcaaatcaaaagcaacgcatctcctaattgcaactgcgaatgtcagtcaacaagggggagataatcccttatatgccactgaaaattggtctgatcccttatataccactgaaaattggctcttcccttatatgccattggtccaaattgcgcactctctcatgccactacggtcagttgatcgtgtgttgaccgttaacttttaagtaaaaaagacatatttgccctctctgagttattaggcatgccctatatctcagaagggtaaatacgtcttttttccttgagaattaacggtcaacacacggtcaactgacgggagtggcatgagagggtgtgcaaatttggatcaatggcatataaggaaagagccaattttcaatggcatataagggatcagactaattttcagtagcatataagggattctctctgtatatattcaccgtcatggtcgcggatggtggcgtagcggctgttggcaagagggcaggagctccggttgcatattccggtggcgttgtacgggttccggcagaatatccccgtcgtgatcctgccgcaaaaccaaaaccatttatcgtcagaaatcaaagaacaccaccacagcgaacgaaagaaagaagatgattgctgctctgctcgcatatatacttggccatgaagctgcagtggttgtgccggatgcagtgccatatcacgtcgtcgctcatccttggatgccttcctctttgcctgctaggtgcggttgcgggtgatcacctcaccggcggtggaagccggcctcagcaggaggacgccggcgccgctgctcgcgcgtggggtggaggagatgggcgtacgcaggcggcggaagaagatcgatcgactagggtaaaaataaaacctggtgttggccttaggcccagcacaaagcccaccgcggccccaactagatgaactctaggcccatatcaatactgcttgctccttatgcatttcactcagccctgacccagttttgaacccttgaactgtggaaggaataagttcactttgggtccctctatttgtcgcccagtccgattttcgtccattgaccgcaaaaccgggtacgacccgtccctcaacttacgaaaaccgggcaaacgaggtctctcggcggttttgaaggcggttagcttcatcgtgctctgctcgaattcctgcagactgctgccagtatattatttgcccttgcatgcccaatgggggtaagagagaagaattgaaaatttggataagttttcttggaaatcaaattgggcaaaagagaaagattttaaggaaatctgaagtcaaaaattgacatttgaatccattttagggatttaatggatgtttttggggcagggatttgatcatttcggtgaatgtgaatattcatatttttggagaattccaaataccacctaccttctctctttaatagatgatgttgttgatgttgttgacttttgaaataacgtttgactattcgtcttatgaaaaaactagtgtaaatatactaaaatataaatcatactcaaagtttctttctggtaaaatatgtcaacaaaattaaatattatctaaaaaatgtcaacaaataaatgatatttatatacaattttttaatatgacgaatggtcaaaagatcatgtaaaaaaccaatattgttatctattaaaaaaacggagtgcgtaattttgaatccaccataagcagactatccaagcaatccaaacatgacttattagaagatacacaaatgtagtaaaatcacatgagaaagacaacagttctgatccaattccatcccagcaatgtatatttaattgcagagattattaatagatacacaacttatctatacatcctatatagttggaaccaaacactaaacatacattaagccactagaaaataatatcctttgaatccttatagcgctttcatcataaccatcatccatatatcatattcatttacaacctacttagtgtaattattatcataaagcttaacattaatgagccacatcaacttagaaaaataatgcccattacatttctctcacgcttgattataaccatacatgcgtcatgtataactgaaattctacctaaattgcctaaactgtgggccatccttttaacattatttctaaattgttttatttgagctttcttgtaattaattctgagatacccacagcagcgcgtggggtatccactagttaaaaggatggcccttcccgctacccattgcttgatattggcataacttatggagctgaagcagtaggaattggtagaaaaggtcctagaaaacgcatgagaaggagaacatgcgtgatgaactccccaccggtgctgagatgctcatagtggaaagcacccccgcaacgcggtgcaacatagtaaagcatctctagccaaatctcagatatgagtttccatcgttcagcttcattgccgatgctgaaaagctcggcggccacttggcatgcctgtggcatgcaacactggatagttaagagcttccgcaatactttgccagaggtccaaatctttcagttcttcatttgccatcgaggctccttgttcctgttcattggcttcaaaaaacttcttgacagcttccttctcacttgttttagcctgttgatcctgttggcgataaattttttccccaatttcaccaagagctctgtcatgtacaagctgggagttgactgtaagcatcacgccacacttgaagacaaggtacatgatatagtttgatagctctcggctcaccttcttcttcttgtttacttcggtggtgctatcctcggagtagtagcatatatctgtcgcaatgtgccagatgagcacagccgtggggaaatcgacatctctgccaatgctatcctgcaacttcgtcatacttgtctgttccaaatcttctgatttgcatctgtcgatccgcttctgaagtgttagctgaccacgggaactggcgaagttccagtcctctttaacttttccgaattctaacaatttatcgagcaccagctccttcaagtcttcagtaatggatatgtgtgttaaagtcgaatcaagcaactcaacaccacaagtattggaacactcactgatccatttctgcacggatgacaacaaacctacggtaccttgcatggtgtacttcgtgatcatgttgtactgtgctacctcttgggaccattgtttcctgcctcgtagtggccgaatggaattgactgcccacaagattatgcttgtagttctttcagaaggaagtttggagatcaagtagggacaaacatacatggtggcagcgaagacatctagaactattgcacctacaagtaatatgtaggagatgatgatatcggctctattatgtagttggccgcccttttcgatcggcgcacatgaagagcactagggctatgggggtgaacatacactggacaatgaccagcaaggtaataaggagggaacgaaatgatatgtggcagggcacaatagtcaagtagaaggctcgacgtaggatattttttttgtgtacccacgatttcatatgccctgcggcggtttggattgtcataaaactctttgagcatggatggtatatcctttgctgctaaaatgcacttcacatcatcgcgtggagtgtccactgaaataacttcactttcagtatatccgatgttttctgcttcggtatgtataatttttgagcttgacttcccatccaatgttgactcaaatctttctttgacatattttttggcttcttcttctactctgcctttctcaacttcctgtagcacaaatttcaaatagtgcagggatgcagccctgagactccttggtctggcaaggataaggcagaaggtacgcccagtgtaccttaaacacccacagaggaacataagcaccacagcagcctgcagccggcggtctgtccaagatgatgtggagatgacgtagccagccacaactacttggatgaccaagttgagtaggtgccgcttccacaagtcattgtcctccttggagaaggtagtgaggttttcctgcccaccaagatggacgagcagaaatggcgcccagaagagtatgagttggtgctgcggtccgttcacatgaaccgcgaggtggccaagtacgaaaacagcaatggagtgtcacgcccagaaattcacgaaccagaatttctaagctgaatgtgcattaaacccctgtccaggaccagccagggtacacaaacgacaattgttgacatacagatccacgtcttacaaaaatataaaagattacaaatgcagcggaaaagataaaagcgagctaagcctgaagacttgactcctgcagcgagcgattccattccacaggcaatccttgacagcagcgacgaaaccaacctcttcgagacatctccagctgagaagaacttcaactctggtgagggggaaaagagagcaagactgagtactacccactgtactcagcaagtcataccggaagaggaggtatgatgcaagatatatccaagggaggctaaaggttcttttgcataaagccggcatttcaaagcagtagttgaaagcagtaaaacaattgtagtaattaatcaatattaaccaatcactgctcaacgctacaccacgttgagaccggcccaaaccaccacctgaactaaccagttccaaaagctaactaggggtgaaactaatcacggtgaatctggtcgaccgcccataaccgcgggcacggctattcgaatagctttactctgatcagaggtgtacaactgtacccacaagacacagccccacgacacgttcccgtgcgccgacatgccaccacgacataccagaaagaggccgtgacaggacccttcacataaccccctctaaccgatcgcaccacaccttagggttcgcccccgtccccagcaggcaacgggcagcctccctttcgtgccgcggtgaatccggaagccgatcaaccggacaccccggccgacccaactccatcacgcccaccctcgcttgggtacgtcggctagagaaaagttacactacaagcctagccgttgcccacgctggcttgtggtaagtacgataagttcttccggggcatcccgcgaaccggtccttaactgccatgggcacgactagcaaaaccatgcacccacagcccaccatgacgtgtattttaattaaccaacaccattacggtggcactaaaccaaagctatgccgataatcaagtctatgctttaatgtgatccccctttgtgcactagttgaactaagcagggctaagcatctcctaaaccaacatctagtcattttaatacccaagttatcaatggcgtaagggaaacaacatatagctgagtaataggacccatcccacatgatattgtaaaacaatgcaatatttaatagaaatgcgggacatttgtaaattgggtacaatatgatcaattgtaatgtatgacttgccttgctctcgcactgatggaaccacagcaacgtcttcgagaaaccgcgaatcgacgaaacggccgaaatctacgcgacaaacaaagcacacaagcaaaacatgctataagactactgaaacagagaacaaaaccatttttaatggattctatacatttttatgaatttactaagacttgaatggacttaaacggagctcggatgaattagttatgatttttagaagattctctgtgtttttactataaaagaaaaactcttaatcaatttattgcgcaataattcctcccagggctgacgtcagcaaggggtggggcggcgccgacatgcgggccccactggtcagcggcactaagagagggagaagggggtggctggcaggcggggccccccgggcggcggctcaggggggaggaggtggcaacggcgggtgggccccaccgggcagcgtcacaagggggtgggaagcggcgaggcgcccggtcggcccggctcggcttcaaaccggccggccggttaggtgatgcggcggcgcaagcggccaccgacggcggcggccggcgagaagacgacggcggccggcgatgcgagcgacgacgcatcatggcgacgcgcacacgaggagcggcggcgcgcgcgagaggaagagaaggggagggagttctcaccggggattcggccggcgtgggtgaagacgacggcggccggcggcggcaagcggcggatggtggggcgcgcgggatggacgagatgggcctcgatctcgcgaggccaacggcggcaacggagcggcgcggcgacggcactagcgacggctagcggcggttggaggcggcggtaggcggcggcgcgtgggaagagcggtgcggcggtggcgcgcggcaagcgaggggcggccggaatagcccccgcgacggtgaagctagcggtggcgacggcttcgcgcggcggcggctctagcagcggtggcgcgcgaccggagggcggcggcaggcggcggagctcggtgcgacagcgcggcggcgataggaagcacaggagggcgcgacaaaggagggaagcgcgagaggaggttcgggggagcgttttatgggcgagggaggggaggaaacggccgggggggtggccgatttggccggcgacgtgggggtggagagagagagagaggagggattcaaaatgaatccgaccattctcgggcgcgcgcgagggcgggaaacggcgggacgtgggcggcgatgtgggcgtgcggcacgggcggagtgggcgcggaaagcggggaaaccggcggcgtgggtggtggcactgccgtcggttggaggtggaagaaggggctgacaggtgggccctacctgtcgatgacccagagagaggagggagggaggtaggacttcgggggaggggagaaggaacgggccggcccgacaaggagggtggcgcgggagagaggttgggcagacggcccaacaaagaaaaaggagaaagaaaagaggaaaaaaggaaaaagatttttcctaggattaatatattgcacattgctaattttaattggttaaaattatttacaatgctctgaaaattccgctaaaaatcctgttagcgtattttgacatgtagaatccaagaaaaattccacatgccgattctgattattatttgcatttattaatttagggtttctctcttgcctttaaacaaataatttcttccaactatttattaattgaatttttgttagggaaaagaacttctgggcgcaacatggagtcagctgacaagtatgccagccatagaaggaagcgtaggatccttgacgcgctgcgtgtccgcatgctcgctgcgaggaagaggaagacttgaaggaagaagctcacaaggatcaggcactggatctcccactcgtcccacagctccttcacatgatgcccaaaactacattgtaggtaagtgagaatcaatcctcccaagaacaacaacaataaatcatttattcatgccactctatgaatttgtttctcaatactaattagagatcgaccctctttaattccaaaagaacgaaagatcagaaaatcacacaataatcaagagaagtcgagctggatggtgattattacaacgttagtgattatgtatgtattgtaaactgttctgcagtacagttggaaggtgcaatacaatgttcagttgtaaatacttgatatttcatcgtatacagatggattaaatcatcaactgaatgatgattaaaacattcagttgtacttggactccaagtagaaacaatgttcgatacaaaaatattgttctttcttggagtccaactgaatgaagataacaacaacggatgagtgtgttttgcagtaattaggagatagcagcaggagacatgaaattcactagtattttgatttgttccatttcttttattcaatgacaaaggaaaaggatgaacacgagttaatgataaatgccttgatcattaaaagttgcttgctcttcacataattggcagatcaaaaggaataatccaaatgaacgaagccgaaatccaactacgaatgagagtggtcaatgaagtgcctataattaaccaaaaaaatgcatgctttcagccgaaaatatcaatacatacataaatatatacaggaaaggtatatatatattgcatatgccagttttgaattgccatttaatgaacactatacttaatacgctaattagaacgctgtaatataatatgttgctaggcagcatttatccacacaaaaacgaaaccaaaaagtggcatagcatgttaattacctttgtttctccttaagattgcgcatattgccgattccctcaccatttctcacaggtctcatttcagtcaggttgtggggtgatgcaagttcgaacagaatggaatgttgctttgctaagctcatttttagatcagatcaaaatgtagtgaacctcaagcttgtctttttttaacttttggtgcgacaaatggatgcttgcttcaatggtcagcaagtgtttacacacggaagcatctaagctgcaagcaacatataaatatgaaaaaataaataccagatgaaaacaccctggatttttttcccctatttaaaaactattttctaatgcaaattttgatttcaaatgtggctcttgttagcgattccaatcttgtgccaagaagatctcaatccccgcctatctaaaattctcgcccaaaaattcaagaaccattaaggccgtgttctgtcccatatgttcccaactcctctcatttgttttccgcgtgcgcccttttcaaactacaaaacggtgcatcttttgtaaaaagtttatacatgtaagttgcttaaaaatatcatattaatcaatttttcaagtttttttatagctaatacctaattaatcatgtgataatctatcgctccgttttccgtgcggaggtgagggttcccaaccccttcaaaaagaacacaagtccaatttaaaatcaactaaatatacttctgtttctccttccttacgcctcaccgcgctaatacaagccgtgttgtgcgtccccgtgtactgctggagcatgtagttgactagggttgcactatattcatttacattagcccactcttttgaggagcagaccctcgtacgcaaaagtagggattataatttcgcttcaaaatttcgctctccccccactccctcctttgacaagcaaatatctcttcggacctgcttagaagcccaatttcagatcgaaaactagtgtaaaatactagcctgtatttcttgtccatctagactgtaaatggcacctagatggaccgtttctcgaaaaaaagttccagctgaaaaaggcccattacaccagaaagaaagtaaactcctccagaaaccacacatgaaaaccatggtagtcaggcttctctcttccttgcttgagcttgcgtagccctctcctctgcgtcttctatgtggacccccgttttataacaagaatcattcgtgtaaacagtaccaattccctggatcaagtagtctggtacacacgagttcatagctgaaataccagatgcacatacacgagaatctagtgctaattattacatcataaacccgcaggcattgtcttaaattatcggaccgagcgggtccnaatacattccaaagcagaaatagatatgggcagcgga

SEQ ID NO: 18563 - DNA, 729 bp, Oryza sativa
tgaattctatatcggctattttattcccgaagtggaattttttctcctcctaagatgtttggcgtttcctaagaaattttgtgatttaaaattatgtcctagacttcatctaattattaagttcttaattatatctaaagtactaccggcaaattgattccttatggagatgactaagaattaatctataacaatctataagaattcatctaattatattttcattaatcctataattaaatgctaatatttttaaatattttaaatctccccctaatttttcctttcttttctctccctctctcttttcttttcttttcttttcctctcctttctttcttttcctctttttcttttctttccctcccagcccctttctccctcggctccttctccctctctccctttttctgcctaccgagaccggctggggaaagggaaaaaggcggcggcggcacggtttaccggcggcaacggcaacggcggcggcgcacggcggctgcgacggcggcggggaacgcggcacggcctaaaagggtgacggtggcgcggttgagatggggaggggggggggaaaattggggaaatggtgtggggaggtttggagatgaaggggggcttttataggactttgggggcaaatggccggcctaatatgatgtaaacggcggtgcacgggctcggaacgacggcgacgcgcgcggcgcgaggcaacgcgacgacggcgcg

SEQ ID NO: 18564 - DNA, 20387 bp, Oryza sativa
  unsure (1)..(20387): unsure at all n locations
aatttacttttagggtttgttcctaaccaataacccattattcgcgatttataaactccgaaatcaaatccaataaaataatggagcaaaatcggcatgatgcaatttattcaaaaagtttttgaggccccatatttttggagtttagatttttgtcggtccaatttttagggtgttacaaacctatccccctgaaataaatctcgtcccgagatttcttaccagttttcgaataaatgtgggtattccgtctttaagaactcttcactttcccaggttgcttcatcctcggtgtgattactccattgtaccttgtacatatgccacactttgctcctagtcctcttctcggctctatccaatatccggaccggatgctctggatacgtgaggtcattgctaaggtgaatttcttccaacagagcttgttcttccggcactcgtaagcatttctttagttgagatacatggaagactgggtgcacatcagcgatattttctggtagctgcagctgatatgcaacttctcctcttctagccgtgatttgaaagggtcccacatatcttggtgctagttttcctttaaccttaaaccttttcggtcccctcatcggataaattttgagatatacgtaatctccttctttaaattccagattccttcttcgagtgtcggcgtaacacttctgccgtgattatgccacttttagacggtcccgaatcaggcgaaccttctcttcggcctcgttgataatgtcaggtccaaataccgcccgttcacctgtcttcgaccacatcagcggagtccggcatcgtcgaccaaacaatgcttcattgggggacatcttcaggcttgcttgaaagctgttgttgtgggagaattcggcgtagggcaaacacctctcccagtctttactaaaatccaatgcacaggctctcagcatgtcttccaggacctggtttgtcctctccgtttgaccatccgtctgtggatgatgagccgtgcaaaaagcaagataacttcctagggcttcatgtactttctcctagaagtgcgaggtaaactgtgtgcctcgatcagatataatcctcttaggcactccatgaaggcacactatcctggtcatatacaactcggcgagcttagcactgttatagtttgtcttgacgggaataaatcttgccgtcttggtgagtcgatccacaatcacccagatagaatcgtaccctgttgcggtcttgggcaatccaactatgaaatccatacctatctcatcccatttcattcgggaatcatgagaggttgcaacaaacttgccggcctctggtgctcagccttcaccttctggcctacgtcgcagagtgctacgtattcggccacatctctcttcatgttgggccaccagtaaccctccttcagatcctggtacatcttggtacttccggggtgcaacgaatatgccgattcgtgagcctcttttaggattaatcctctcagtcctccctgttcgggtacatagattctctttttgtaccatagaacacctttttcatcggttgaaaattcctttgcacgtcctgcggctaggcgtccctttacttctcggatttcctagttgtctttctgagcttcctctatttgggtcctcagaagaggttgaatgtccagggtgtttatctgtccacgaggcactatatgtagatttagctgggccaattcctctttaagctcaggagccatcccttccattctcagatgtttgcaatggctcttacgactcaaagcatcgaccacgacgtttgccttaccggggtgatagtgaacctcgagatcgtagtccttgattaattccagccatcgcctttgtctcaagttcagatctgactgggtgaagatatatttcagactcttgtggtcagtgtagatatcgcaatggtttccaatcagatagtgtctccaaatctttagcgcatggaccacagctgcgagctctaggtcatgggtagggtagttttcctcgtggggtcgcaattgtcgcgacgcataggccacaacctttccgtcctgcatcagtactcctcctagtccttgccttgatgcatcacaatatataacaaagtctttcctgatgtcggaaagaactagaataggtgccgatgtcagcttctctttgagttgctcaaagctttcctggcactgttctgaccatacaaactacttttcctttttgagtagttgtgtcattggccgggctatctttgagaacccctcgataaaccttcggtagtatccggccaagcctagaaaactccgaatttcggtcaccgacttgggtgctttccatcccgtaacggcctctactttagcagggtccactgctactccaccggctaagattacgacctagaaaagcgacttccttcaacaagaattcacacttgctgaattttgcgtataacttgtgctttcgaagtttctggagtaccaatcgtaagtgctccacatgttcttcctcatctttggagtagatcagaatgtcatcgatgaataccaccacaaacttgtccaagtaatccatgaacactttgttcataagattcatgaagtatgctggggcattggttaaaccaaacgacatcactgtgaactcatacaatccatagcgtgttgaaaacgcggtcttgggtatatcctcggtcctaatttttagttggtggtatcctgatcgaaggtcgatctttgaaaacaccttagctcccttaagttgatcgaagagatacacaatccttggtagtggatacttgttcttgatagttacttcgttcaatgaacggtagtctacacacattctcatgctaccatctttcttcttaacgaatagcactggggctccccatggtgacgaactagggcatacaaaccctttttcttgtaactctcggatttgcttcataagttcctccaactcgttgactggcatccgatagggtctcttggatatgggagcagttccaggtaaatcttccggaaacacatcaggaaatcgttgctctaccggcattcctttcatgggtagcatggtgaatatgcctccggcacattcggccagtctaggatcttgatccatagttgttctcatatctgatccccagggggtggttaaggtcacttctctacgcctacagtcgattacccctctattctttgttaaccaatccatacccagtatgacatccagggtctgaggtattaagaccataagattggagggaaacaccacatccctaagacgaattggtacgtctatgcaagcatgattcacagttatctcgcccccaggtgagtgtactatcataggctttctaagtcccactagggttaggttgtgcttttgactagccttcagagatataaatgaatgcgatgcaccagaattgaagagaactttaaccggggtagaattgatagagaacatacccattagtacgccatgatcttcctaggcctcttcagctcggacatgggtcacttgtccgtgcccaaatccagtagcggtcctgttagattgcggagtcttgaatagacctcgcccggcagcaggggtagcagtgccacgaacagtcattgcattcgcgccagtccggacaggagttttgcgtggatgtgggcagttgttagcgtaccgcccagattccccgcaaatgaagcagtccacattcttcttggctccaggggcaaccaaagttggagtaggggtgcggttctgaattgcaaccggcctgttgaagttgctaggtgcagcgggacgattggtcgccacgatagggggcttccatccggatggagtggctcccttgagtcgctgaggcactgtctgaggtgggcgactcatagcaagcctcctcttgcggttgtgttccaccgtcctttgatcgttctccagcctaacgactttgttgatcaggctctggaagctctcatggtcttgcccaatcataggtccacgcaattcatcattcagcccttctatgaacttgtcgatcttttcctcttcatctgcgaggtctccaattgcatagcgggccaactgagtgaacttgttcagatattcctgcaccgttgtattcccttgtcgcagccttctaaactcgttcttcttcatgcgcatcactgcagcaggtacgaagttctcgcgaaacgctgcagtgaactcttcccaagtgggttcttcagcatcgtcttcccaagcttccttgtaagtatcccaccaatcaccagcgggaccctctagttggtttactgcgaagatcaccttgtcggcttcgcgtaccctgacaagagtcagtttcttttctatgatgcgtagccaatcttctgtttccatgggctcgtcggccgtagcgaacgtgggtggcttggtcctcatgaactctccaaagcttgaccctccacggttgccttggttgtttgcgatggcttgcagaagttgagtttgggtggccataactccggccagagtggttaggtcgggtgtctgtgtttcatcgttgctagttgatgcccgacgtcggcttgccatctgtgtaggttgattgattaagtatcctaattttctaaccgccttttacggctttatcccattaggggaaattgttttgatgtgaactttgttttgcaagcatggtggaataaactcatttataacacaacaacaataaatatcataaataacatcacagagtttcacaaatagtacataaatcatgatgtaatcgactgcatacatacgcagtccaaataaggttcatccaaaagatacatcgaactaatcatcaatctactcgtcaatctagatagggggggtgcatctcgcatgctatcccaaaaaaaacatctgtcgcgagatcgaaactgcaaggagtccgtcagtctagtcctccaaccatccgcaggatcccggggcaggtagagggtagtcgctggcacgggcaaacctgagtccccacggctcgaagtagtggcctctggatctggcttgggcttcttgctcgggggtcgggtgctcttgcgggcagtgctgagagtgcgggggcctccgaggaacgtgatgcggggaacgggtgtctcatcctccgaaggatcagtgatgtctggctcgatctctggcttggtatcggtcctctctgcctcggagtcaatctggatcggagtctccatactgtaacccagctgcggtgacgggacagtgaccaggggagtgtgtacaatctccggtgcaggtggctgggtcactgtagtgtccaccaggcagggtgctgactcagtagatgtcatgccaacctctcccagaagggcgtggaacgcgggtgggtatggcggggtgaggaagaagtagcagttatgccctgctgctgtggaagtagaagctcctggggtgctgatcgtggctgctcgaagctgctcctccagctggctgacgtgctcctgactctctctcagctgctcctcaagtgagtccatcatcccgcggcgatcgttgtactgatcagatagctgcttgaactggtcgccatggacctggagctatgccttcagtgagtctatctcactgccccaagtctgatgctcctcctctagctgaagctgctgcaccgagaggtcagtcaactcagtctccaactctcccatacgcctctggttgtcgtcaatctccaacagagcctcctcgtagaagtcatctactgcctcagcccatcgtgacagccgagtcaccatcgggttgtagcagcagggtgtgtcctgaactgtgcagactgagttgctctcctcccggaacgggtgatgattaaactcggtactcgctaactcagctcggtggatagagctgagtcggaggaaggcctcccgggctgcatcctgcatcgcggtctctggcaagtctcggcggtgacgtgtcggaaagctgtagtctaactccgaagaaactcgtgagtgaacctcgacccaagcctcccaaactgatccacactgtctcactcggaaggtcggaaatccggagtaccgcagacgcctcatcattcaatgcagctcaacgacatacccctctgagcggggtaagcccaactcccaggtagcgggtgaatcctgatctgccatctaagtttaagaaaaacccaaagtcagttgagagtaaaaactggttttgtgaagaaaatagttaagagtaaggtgtaaaatcgtataaagttttgtaaacatagcatttttatttttgaaagtgttgctaaataggaatttctcccttggccatcttaggaaaggggtggggcgcctttttggtctttcctacagtcgtatggctctgataccagctctgtggacccccgtttttataacaggaatcattcgtgtaaacagtaccatttccctggatcaagtagtctggtacacacgagttcatagctgaaataccagatgcacatacatgagagtctagtgctaattattacatcataagcccgcaggcattgtcttaaattatcggaccgagtggtccggaatacatccaaaagcagaaatagataaggcagcggaattaaggcagcggcatgccattgccacaggcaacgaccgtactaagacctactgagcaccatcgtcttcatctccctcctggtagtaggcatagggatcctccggagcttcatctcccgcttctgattaattttatatttgcaagggtgagtaccaaccgtactcagcaagccaccacatcaacaatgcatatgatagggtatttcaaaggatggctatggttttttttgcgcaaagcaaattttgtaattcttttcacaagcctaagacctagcattgactgatcaaactttagtaccagtgtttgtattaaaacaacgacggttctgtccaccatccattgtgatcccaaggatagctttccgccgttgagtcgttatggttttctgaggatgcccaccttcccccatctcaggaagtggctccaacaacataaaaattcatcatgcaataacccatcccacacaaattaagaatttaaagactaaccaagagtaatacatgtcccggtgctcaataaccgcgagcacggctattcgaatagatttggtttactcacactgcagtggatgtacactttacccacactccgtgactgcccaacacatgagccttgtcttaacacatgagacacgtcacggcaaagcttttcgataacctcgcattggcagtacccgctccatgaacttttgcatcctcatgcactctaggcgtacacagtttctagcagtgagaggagttctggcgcacccgggaagggaagatttacacccatgaattaagttataattaggttccactcaacacacgacagtcctaacaatggcgacaccattgtagagcccctgccttacacatgagaaaccactatgcatggatattgcctccgctcggctatttattccgctaggtctatccccattcaagaagtgtggtcgtacggggtcgtttcatgcttaacttcatggctcggtccttaattgaccggggacggtactagcctttcccggataccacccaaatccaccgtccgccccggtctaaaacaaatgtttaattcctttcatgtcatcattatcatggcaatgtggcgctcatgtctccacatgccgcatctcaattaccttcccaaaggtaattgcccaagcatataatatttgataaatatgagtatgcaagattctaaagtagcatttctaagcaattgtcataattgactagggactcatacgtaatcatggttacaaggatttaaaggtgaacaataaacaaggcatggcataatcacaaataggatgttcatcattgcatgtaatcttatttgtaaacaagaattaatttcacaatagggatcaacgtggtcaaagaatagtgatgacttgccttgctcaaggtcttgcgggtcttggccttcacccggatccgcggctcgctcggtctctatagttacgtgcgtaagaacaatttgaattcgattagaattcaaacaaaatccaaataatgaccgaattgaaaaacgagcgcgagaggtgaattctatatcggctattttattcgcgaagtggaatttttcctcctcctaagatgttttgcgtttcctaagaaattttgtggtttaaaattacgtcctagacttcatctaattatttagttcttaattatatctaaattactaccgcgaaattgattccttatggagatgactaagaattaatctataacaatctataagaattcatctaattatattttcattaatcctataattaaattctaatatttttaaatattttaaatctccccctaatttttcctttcttttctctccctctctcttttcttttcttttcttttctctctctctctctttcttttcttttctttcttttcttttcctctcctctctttcttttcctctttttcttttctttccctcccggcccctttctccctcggctccttctccctctctccctctttctgcctaccgagaccggctggggaaagggaaaaaggcggcggcggcacggcttaccggcggcaacggcaacggcggcagcgcatggcggctgcgacggcggcggggaactcggcacggcctaaaagggcgacggtggcgcggttgatatgggccccaggggggaannttgggaaaataatgaaaaggagatttggagatgaagggggggcttttataggactttgggggcaaatgcccggcctaatgatgatgtcacgacggcgcacgggtctcgaaacgacggcggcacggcgcggcagcggcgatggtgacggcgcgcgtcgacgcgacggcgcgacacgctgcanatggccacggcgcggcagcggcgcggcagcggcgacaagacgcgacggcgacggctcgcggcgcggcaacggcgacgcgacggaggtggcgcggcgtggaacgcaaggcgactacgcgacggcggcccggcgggtgcgggacgcgaggcaacgcgacagcgacggcgacggcgacgcgaccgcgacggtgacggcacgcggcgcggcacggcagacggcagcggcgcgggacgaccgacggcgacgcgacggcgcggggcgcgaggcagcgacggcgacggcgtggcagcggtggcacggggctcggggcggccacgcgcgggacagggggaggggttttagggctagaccgcaatcgaacacctatggggcaatgaatagtgacgttgtccatttaacccgatttaagcctatttatttatttaaacttggttcgataaacttaaattttgtacaaataaagttcacttaatatttgtgttattcccactaatggatccacccttgattaattttacccatattttatttttatataattttcttgaatttaattagagttaattcttattccattacttttaaatttaattgatacaaatatggttgtaataatattttactcatttctatcctcgccaaatcttattttatattgcactttaattatttactttgtcaatttacttttagggtttgttcctaatcaattatccattattcgcgatttataaactccgaaatcaaatccaataaaataatcgaacaaaatcggcatgatgcaatttattcaaaaagtttttgaaggcccatatttttagagtttagatttttgtcggtccaatttttagggtgttacatccttccatcgccccacccttctctccggagagtcgcaagcttgtgtggtacttgtcatcacatgcatctctctcagccggcccctcccatcctcgagctcgtgcaaggcgcagcctccctccctatcccaccggcgcggtcgccgctgtggaggccatgattcttgcctccactgcatgatgggacccgacgtgatgtgctacctagcacactccatgtctccatgagtcgttatgtgaatagctttgggaatcaataaataaaaaataggtaaaataggttccacggcatcgaaagtttccaagtattaaagtgcaacggaacctttcgatggtgcaaaccaacattcgaaaactttcaatgacgtgaaaccaattttacaaaaagaaaagacaattattgttgtaggacactacaatttgtggttttaactctaggacacgtcaaaagtcgatctttaggggaagacactctcaaaatgtggttatttgttgatgggcaccgcatacactaaaatattaaattccgattgaataggagagataaacaacatgaaaggtcaaaaatgccccgggtcgacttgtcatattcttcccccacatctcactccctctcacactccagccgcaatagcacctccgctcgccaccggcgaccaccacggtcctcccacctcgcctctcctccacctccactgcagcggcgtgacccgtctcccttcaacatgcgcgtgcggcggcgtggcccagctccctcgcttggctacccggcgtgcgctaaggggcgaggcggcaagcattgtgcgcgcgtcatcaatgccgagggcctctacctccaccacggagccacgggcgatggagttggaggtggtggcgtgcggctgctcccctccatagacctgccttcaagcggcgctgccctgaccttagagcagagaaggtggaaggggagaaaagcgctggcagtttgggcggggggggggggcgactgggggtaagggcaggagaacggcaccggtcagtgggtgaggggaggaaggagctggttgaggggatcagattgaatgagagatgggggcaatttggtcatgacgtgtcaaaaagtagacccgccctcgcctagtcagcactaaaatactaaataaatagttaggtgcggtgtccgctagcaaataaccaagattatagatagtcttctctttatgacacagaacatgtgtgaaacatagcacgagactctaaacaaatacattggatagtagcagataaaactcgatgcagaataacgtttgcattgttgacaaaatttggatattcttcagcccatgttgtcatcagacaaatgaactaccaacaagagcatagttacaagaccagaaatacagaaaaaaaaaagatggtggaatacaaggtttaagcttgcatgttcatcagatagtgtaagcagagataataacttggctagcatatacaaagggctcactcttgaaagaatttctgctccagaaaattctctatccctatcaccttttactcctgcacaaaacattcatccattgaattatgctggccaatctgagtaatagtaaactaaagaagtaataaatccccgttggacttcacactttgtatggtttcaagaaggttttgaaaaacgttatacctctagattgtgtaacatatgtgcaaatatatatatagatcctgttatcgtatataatattttttgtactaatagtaaatttcataatagcatcgtatatgtgtacgtaggatcatcgattcactaaaaaatactagcaaatttcatattgttccaccaaattctagtatacaaaacttctataaaaactcctgtggaataaaattgcaagaatatagagttacatggggaagcaccattagtgcagtggtggagccatgtataaaaaaactctatacatcaacattcaatcatagcattcttagctggtgcagagattaaaactaacttgtagttccattatataaaaatatagagctaacgacaatgtggtttgagtcatctgcccaacaaaatcctaggtcaaccaatgtttaccacgatcctagtagtgatatattattgtgcagaggaacaacaaaggaaactatgaaacaaatacctggtcatcgtcgtcgtcatcatcgtctcccttcttaaggcgggtagttccaccctctttgcatataggtattttcatgtgtccaaaaggagtattgacatcaatgtgcccctttatggtgtaaccagttccctttccccttatcatatcccacatagcagagccaaaatccttgggcctgaagctgattggtaaattcatggttgttacctcctgcttcttaatatttgtagtttctttcatctcagcagaagcaatgctcacattagagagccacacttcataatccatagaattcagtcccaggtcaaagtcatttttgttgtcaagattcaaatggagtgttgcggttgcttcctcaaaggagaactgctcaaacttgatcttactcacattaacgtctggtctgtaaggcactgggatctcaccatttttctccagaggtatagaaatccttccgatgaccgggatatctatatgaagcacaactctgatcttgtatggaatgatactcccaggcttgatgtccccatatgtactcttgatgtcatcataaataagtagcagagggattttcactgtctctgaaccatgagcatgtatggttccagaatcagggattgtcccagacatgagctttctctcttcgctttcgatcaagtattcgatgtcgacgagagggatcggcacggggtttgggttggtgatgagaacatcagcaatcagctctaccttctcaaggctgatgtgaggtatgtggatcccggtaacatcagcagtaggctttccaaagcttactgcatcttcaatcttttcaccaatgtcttgaatgaaatcctttaccttgtcgaagaaacctcccccctctccatcattattgtcgtcatggtccttgtcagctttcctttcggtcacttttgggctatccgaagatgacatgctgtgatacagattgaagagttaacatatcagatttcacaaacaatttcctgtcgaaaatgttcagaggtgaaatatgaacgacaaaactgacaagcgcaccaatggtaattggtaaaatattaaatacacagtaaaatgaaaacatcaacaagaatacaagattacataatcacaacaggaagcggtcaaaagatatacgaagttactatactgttgtatgaaacgacccatttgagctgatctcaaagaaatgttgtaattaaccctcagaaccagatgttcagcccggacattcgactatttcgaaatctatgatcatgtgaattcaagcatacacaaggtgcccccatcttaaatttgtatagcaaggatggacgtaaacaaaacaagcaagctccacctgatccaaggagactactaataaattaagatggcagccagcaaaatatttccatggaaacgtgagaggccaatgataatgagtttggaaaatcaacagtttccggctcctgcaggttattgtcaaattccagccttctcaatggagcttcacaaatcgaaatggatgcatgacggatgcaagtaaataaaaaataatacggagaaatcattgtccttaatcttagaatcctgccgctaagctctgtcgatcgagtacctcgcattgttctgacaaatcacaatgctgataaaaccgtgcatttataaacctacacaaactaatcccgtaatccccatcggccattgatgagaatggatcgcatttgttatcttctacatgcgtcttccttcgttttttccccttcttttttaccgttttataaacaaaagacaattgcgtcgacatctcctctatatgtgattctatcaaaaccagcaaataggaaaaaatggaacgaaacagaaaaataatttgatcttcagggcattcgaattcaagaagcagcgcactgcccagctcagcccagattctctctccccacgatcaagagaagagaaaagaaaatgacagcacgagcacatattggatcagatcatgatcatcagtacgctggatggaagaaaagcagctggactggattgatcgtcggtcggctacctgctagggtatcgacgacgacgatcgaagcgaaacggccgcgatcgagcagagcagaggaggggagaggagatgggcttcgcgtccgtcggtggaattgggatggagagcggaagcggaacgccattagcggcttaagcggcacctgcgcctgcggcgggctgatcggcctttaccaccgtaagaattttttttatttttattttttataaacctttttgattttttaattttaaaataaatattttaaaaagttattttcaagagctaaacattttgaggtcaagtgataaaacaatgttatttggctatacggtccggatggtatagaagctttgttttgttacgctgccctgaagccatgacaggactgtcacgctcgctgcgggtgatgttataatattgttttactgttttgtcacgtttgccgggatgatagggttaaaatgttgaaattttgaaaaataagttttggaaaggtttatttttaatttaaatttaaaagttaaaaataatgattagtcatgcttttctttttgtctttctaaactatcatcctcgttgtcaggttttgggtcattgggcttgaggccatttttgtcttctggatgggcttttccaggtccaaagtcatcatacgtgggtcgggctgaaatttttatcttaatgtaaaacctcctttttttttctcttgagatgaatataaaaaggtctgcctaatgtcatccaagtttaaaaaaaaatgtgattgcacttacattttcaaccgttggatgataacatgtatcgccatatcgcccctccagcgtatgttagaccgtccgtgaatgcaggcatgtttgtgttttgtgcaataaataaattattattgctttgtcagttgaaagaaaagcccaaattatctttttttacatttttattgggggtataatatgactgaaatttcagttatttcggtctaaactagtttgaaatttggaacaaaatatttgaataaatatttccaaattcacaaaagttatgaaaaaaatcaaaaaaatttggccaaaataatttcatatcggagagtacgatagacaaaattttcaaaattctgacatgaaagtttaaggagcaattgcttatttaccatgtttcgaaggataactactaatttgatcttgctatttctagtttgcttatttgaacctgcttttcaaaattgaaccaactgtttgaccgtatttacaatacaccattagtgttttatttaggaaaagaaaaaatctatttattatttcaactgacaaaaataccctccctttaaacttatccatctccctacctcacaaccgacattatatctctctcccccctctctcgctcttgcgtctctctcggtggctcagcacgagcagcggcgcaggtgcatggatcggcgacgcaggcgtgcagagggtgaaacagcagcggcagcggcactgacgcgcggaggaggggctggtagcaacggcaccggcgcggagggaggaggtgccagccgcgcatgtggcagcgcggagggaggaggggcggtggcgcgcatggccacctacgcctgctgttgcgccacgaagggagggaggtggcggtggctcaggcgcacgaaggtgaggcagttgcggcggtgacagtggcgacaacgctgacatgtggagggaggggacggcggcgccatggccgcctaccgctgcacctcggagctaacacggacgtggttcacgccgtcggtggcgaagccgtaggatcttgcaccaccgctcgaagccggtagagtttactttattgtgtcaaatttctatcaaattgattcgaatatatcaaatttggtgccaaattttgtttatttcgttttgccgaaaatctttcaaaattttcaaattgatttgattttagcagattgaagctaaatctatcaaacttgtgtcaaatgtgaaagatatgtcaagttcgttacaaatatatcaaaagatctgaacatatggccgtcttgatataacagggtcaaataaacaagggcaaaatataccatttacctcttagttaacattgttaagttgtcttaacagaatagagttagctttcatcttcgattttgaaaaatatgatcaaataagcaaactaaaaaaatataggatcaaattagtagataacattcaaaataggatgaaataagcaattccccttgaaccaggggtgaaaacggagcggatattatccggtccgatccgctccgaatccgtccgatgtgagaatatggtaaggatttttagatatccgaccggatgcggattttgtcatgcggatgcggatgcggatatggtatcaacgatatccgacggatacggattatccgatattttaatcggattattcgatatactatttggcggataatccgcaactttcagaccacacaacaactctatttagcacattttacatcgggcggcccatctagcccatctagtgtaacctaatccaatcctccccgaaatctctctctctctctctctctccgtgactcttctcttggccccttctcctgctcccacacgcgccgctacatggcgccataggtgtgccgcgccgccgccgctccttcttccagtccgccggcaatgtgttgtgtgctgtatgctgtatgcagtgtgatgtatggaactagtgtgttgcttactatatgcagtgtgctactgtgttgtgtggctgtgtgttgtatgcctgcattgtggtatgcctcattgccttgtgcttgtcgtactgatgagtgtgaagtactaaactactgcactgaacactatatttttaaattttaagcaatgcagtgaactgctgaactgaacacttatattatatttttgatggatgtgttatattaagcaaaattatattattgatatgttttagttggttttttctagagaactgagatcatgttcatatgttgttttgccatcgtattgcggctaattgtattgccgctctcttgttgtatggattgaatacaaacttgacatccgacaactttttatccgtttttgaactgagtccgcaccgaatccgacgtccgaaaaaatccgctccgcatccgtatccgcacgtcatccgcatccgtttaaaaaaaatggtttaggatatggtatagctattatccgtccgaatccgctctgttttcacccctatcttgaaccctggatctgctaacgtgctagagctttggtccgtccggagttgaagttctaatttaactggtaataaattttaataatttcagtccataataattatacagtagctaggaaagatattagtaattactacataaaaacgagcgtgtagcgtgcaatgggtaattttcacagatagcgtgtgtaacaaaagactatattcggatatcctatgttaacaaattggttatcctctcctcgcagttcgcttaaaaattgtctcagtttaagttaaattgataaataaatcatttagcgttacgttacggagtctcggttgggctaaacaacaagcgagccttcgcacgccttcgttggccgatcgatctccccgtggacggacggagggacccacccatccacgtcgccgctattttcgcggcgcgcgcgccgccgatctccgatcaccggcggctgggtgcgagccccgcaaccgcaaggcgtccctgctgctactcccgcccgcatcctccctgcgcccaactccaatctcttctccgcctccaactccaggaggtcgctctcctcctcgctaatttcgcccgcctccgccgatttcctcggggggaggggagcagcggtaggtgccgtacgtctccggtgagctcccgtgccgacgcgcatcctctttctttcgatttcgccttagcctgtaataacatgtagatctggaacctaggtttttctctttttcttaatatatagaagtatatatatatataaaaaaaaaactgtgggttcaaccagaggtatccccatgcccacgttaggttcaaccctgttcgcagaatacgtggaaattttgtgtacagctgagattgttttgttctgaatatgagtagttattaccatttggttgttatttagataaattgtattccagcatattttgattattttctcttttcgtgttttactctttcagtaacttttgtgtggtagtaatttatgaccatggcgacctcgcgagaggttttcaagtatcaccctttgcctacaccgggagtggaaaacagttttaaggatgagatccaatccaaggttttgggcacgataggggatgtgatgaactcatttgatccaaagtcattcccacagcatgtagaaggagcactgggaacagctggaaacatcatcaattcctttgagtcaaaattggctgagcacaagcaatttgattttggtggcaaaaccaatttttatggctatgattgtgcggacgatggttggggatctgcacccttgaaggcagataagccggtaaaccttagaaatctgctgggtggtttaattgcaatcatcagtcgtggcggcaaaaattctgaaattcaaccgccaaaggacactaagtctagtgtcgcattcttagggtcaggtagcgatggagaaacattcttgcacgcctcagtctatgtgccaagtgctccaccattgcttgacgaagaagctctgaattacaatgtgtatagggttgtgattgaagcagaaccaccagaatggttacctgatagttatgctaactcatgcatgcaatgcgctgcttcttttactgttgttactcgtggaaggcatcattgtcgattttgtggagggatattttgtaggacatgctcaaaaggcagatgtctgttgccagccaagttccgtgagcggaatccgcaaagggtttgtgatgcttgttatgataggcttgatccgttgcagaacttattcattaattctattagcaatgccacacagactgcaaagcatgatgttatggattggactagtaccagggggtggttgaatttgcctattggattaacaatggaacatgagatttacaaggccgcaaattctgtgaggagctatagccaggtttgaggttactgattttgatttcttatcgcctccttacatatttaatcgccactctcatacatgtttaattgcaatatttaggatatacccctactaatgaatcatacaaattttaatgcagattgcaaggctaaaccccgaaaggtctattcctcatgcagtccttagtggagcaagtgggcttgctatcctgacagttgtaaaagctggtgcacttcttacatacaaacttggaactggcctagtagttgctcgaagatcagatggatcttggtcaccaccatcagcaatcgtttcagttgggttaggatggggagcacaggtattaactacattgctaatttcatctctgtctttgatatggacaatttgttgtccatcaatttatgaaatgcgttttttttgtgttgttacacttaatacagtttgcttaattgctctagctttccttgtggtgtagaaattatccacatgcattgcccattatttgtctttgggtaaaaaagtaatgtaatggacattttttgtatttcctgatggaaaatagtacagagtgtgcatgcctgcacaagagctcgtaatatttaagtgcttgttgtggcactcaatttacctttaggtaaaaatagtttttttttggatatgaacatcaggaggaaactgcttccttttgttgtgaatgttacgtgattactggcattaacaaacgaaattatgttttatgtttacttgatgagtaaaaatatgttaatatgatttcagccataattcaggaggtttcctaatatttactttttacatgttatactcttgtatgttgtattcttatgtttgatcaaacaggttggtgctgagctaatggatttcatcatagtgcttcgtggtctggaagctgtcaggacttttagcagccagatgcatttttctgttggggcaggtttaagtgctgcagcagggcctgttggtagagtgctagaggctgacttgagagctggtgataaaggctcaggtgtttgttatacatatagctgcagcaaaggtaatctttccatctgatcgtagttcttaagcctccctagttgcattgaagtcagtctctgtttctattggagtgtataaattcgtaggaagaaaatatgttgcgtcacatgcataggaaaatacatggatatgaagtcctctatatgacagctttgctgatttagatccatggaaatcatttaggtaaaaacctcgaaatttagtttaaggtggaacagaaatttcggtatatatagagattaatatgctggactttgaagatatgat

SEQ ID NO: 18565 - DNA, 5922 bp, Oryza sativa
aaaacagaatcaaatcttttcataggacttcaagaaattaagaaataaattaattgtggtatttgcttcatgttttgtttggatacatcataaaaaaaatatttctctttatcaaatttcttctcctgatatgaatattttattatttttcaaatcctttgttagaaatcttagtaattaaggatcacattaattataagtaattacatagcctcgtgatagtattgatagctaaatgtctttagcttgttccttcttgatatatgaatacactagcaattagcacgaattctgttaagtcttctaatatcaaatcttttcataaaaggctgagtaattgggatataatattattaattcgtttatatcaaatcttttcatagaaacctgggcaattaagcagtacatttattacagatttgtttccttctgttttggttggatacaacctcataataaataaaccgctttaagtacttccttcttgagatatgtatgaatcacttagcagctatcaattcatttatatcaaatatttttactcaaatctgaccaattaagaagtacattaattctagatttttgcactattttttggatgctagtacataattaatggtatcctccccccataagaatatatattttcaacttctcttaatgatgacttttgttttactgaccacaaattttcttccaaagctcagaaccatcaagcctgatgcaagctctcgtgttgctctgatcgaaaaactgcaaagatcgctcgagattaaccacaaaaggtacaaccaaatcccctctgacatgaatcccagcgaaaattcatcaaacttttgcaatcctttttatgatatgtgggcaaaaggagcatgtaagtgatgaactaaccttcattacttaatttttttccttcaaaagtttgttttgcttttattactagtagtagcccagaagtcagggagtgaaagtaatttaaatttgagtttttcaaccttttaattggctatacgtgaggaaatttgttttgggtaagatgaggtggaataaattgatatatttttgtttgagacaaatggtcaactctatataatcaacattttcgaaactagacaaccccatcgggtaaaatgaaattcactctggcaaatcttttcataggacttggagaagttaaacaattaattagttaattgtggtatttgccgccagttttcatttgataaaacatcatgaaaaattatacctctttatcatattccttctccttgtatgattaattttttatttttcaaatctttcgatagaaatctaagtaattaaggattacattaattataagtaccaataaagcctcatgatagataaacattttttaactaattccttcttcatatatgaattaattggcaagtaccatgcatgctattaagtcttttaatatcaaatctttcgtagaaatctgggtaatgaagcagtacatttattatagatttgttttctcctgttttggctagatgcaacatcatgataaataaataaatttaataagtgcttccttcttgagatgtgaagcagttggccattagcatgcatgctattaattcatttataccaaatctttttacctaaatctgaccatttaataagtacattaactctagattttcactgctatgtttggatgcttacataactaatggtatcattttcccctatattactgatcacacatgttttcctccaaagcttagaaccttcaagcctgacagaaactctgatcggaaaaccgcaaagtcgcaccagattaaccacagagggtacaaccaaaccctctctgccatgaatccataggccacagccagaattcatcaaactttcgctcgcatttttatgatatatggacaatagaaaacgcatgtaaatgatgatcactaatcttcgttactttcttttttgttgcttccaaagtttgtttcgctttttgttactggaagcagtcagaagccatggacgcgtccaagaaatccgtcatgacgaaggaggagcaacaactgtcgccagcagcaagcccagcggcagcagtcatgacagccgaggctgatgccatcaacgaggaacaagacaaggctgctgctgctacaaccgcagatcacactgctcctcctcctcctcctcctgctgctgctgctgttgcagatcacgctggggagatggacatggctagtggcagcggcgttgctcacctggcaccaccggcggtggcgccggcgccgcggtcttctctcgctatggcggtctcggggctggcggaccatgtcctggagcgcatggtgaaggtgctgatgaggaagtgccacccgccgcaggcgttgtacccgctgattggcaagtcgccactgcggccgccatggtggccgacggggcgcgagcagtggtggccggagctcggcgccggcgccgtcgtcccgccgtacaggcctgcgccgctgctgtccaaggcggagaaggaggtggccgtggtcgccatggtgaagaacctcgtgccggacttcgagcgcctcttcatggccgtgcgaatggcgcccagcgtcaccagcaggatcaccgacgccgaggcgagggcgtgggacgacggcgtcgccggggagcgcgagacgtacatggcgcggcacccgcaccgcacgacgccgaccagggcgtggaagctcatggattccctcaagccggaggcggtgaggatgaagctcaaggcgcccaagccgaagccgcaggtcaccatcaaagtcgaggacgccgcgcctttcctcactgtctccgctgccgctgaccccgccgccgtcgaggccgccatgggggccatcgaagccatgagaaacagcagcaaggatccagatgctccgtactatcccatgccatctccacttcatgggcataatgaagttggtccaaatgattacccaggtatgaatatgatacgaaattatttgatatttcaccaatatgttttgttccatatatgtgctgctgaattctgaatcacttttgatagttctaataatcctcttttgcaccagaaaacccagcaatctggaaggagttcaacaggaaagaaggtatgtgtaattataaaagaaaataaagataaaattcatggaaattcggtttaaaaaattctttactttcaattttaagttacacattagtcatcacggattctgcacctagttattaacatgcatgcatggtggtacatgtatgatgcgatatattgtaggtcagcttgacttgttgcgagttggcaaaaagaatgaccggatggcgatatccgatagggtggatggaggagccagtggtagcggccccaggaagggctatcttgtgatgaaaacgtacaaaaaggctcaagaatattatcgcgaactacggaacaaaggcgccatggctagtggtgcaggtagtatgatgagttttcgataattttttctcttgtctaaaatacaatagaacatatagaaaatagtatggttggctaccgagaggagtgaaccgcctaggcagataagggtcagggttgttagctggcttaaccagctgagtgcacataggccaacgattgatcaccctcaattatttcaaacaaaaaccacacgttgaaagagtttttttattgattgatgatcgtagatctttgcgtatgtcgacaccacttcctacgccttgctagatatatagtaccgtattgttggcttttagctgtattattttttttgtcggtcactccttgcatgtcgtgtgcatccttagatgatgttagctggtaggttggaaataacattttgtaatgctcacataattttgtttaatttgtcaaataatgcaactgtatctatttttttcattcaaaactacaactaactaacattttatgaggctcacaattaaacttttgcttattttttgaaataatgcaaatgatttgattttttttatccaaaaatataactaactaacagtttatagtgctcacactattcaatgtttaggtgttaaaattgaagatgacagtgaaaccgagagtgacaatgaagatgagaaggcaaatgagaaggctaaggctaaggccaaggctagagctgtgtatcaacaaaataaaggtatccaagaaaattattggtgatgctagctggcaaatgtcatggtacctttttatttttattttaaacatgtttcttgtgattgcattcctatggtcaataattgtggcggatgatcaatatcggaaccatttgaaccgtgatggttccaatctaattcaggttcattttttttaataaatgatttaatagtgcttatatatttttgttgttatcctttaaactttgtgaacagtccttagatgttttgtctatccttagacattagctagtaggtaggaagtaacattttggaatgctcacaatttttcaaatttgagaaataatgcaactgtatttgatttttttttacccaaaactacatctaactaacattttgtactgctcgcagttaaagttttgtttaatttttgaaatattgcaattgtatttgattttttcatccaaaactacagctaactaacattgtttaatgctcacattattcaatgtttaggtgttaaaactgaagatcagagtgaaacagaaagtgataatgaagatgaacaggcaaaggttatggcaaaagctaaggctagagttatacctcgaccaaacaaaggtatctaagaaaattatcggtgatgctagccggcaaatgttatgatattcttttttttatattaaacatgcctcttagttgcgactgcaaatctttagtacttcagtattttcatatggtcaataattgtgcccaatgatcgaaatcagaaccatttgaaattgatgatgccatgctaattcaggttcaaaacttttttgacgaaatgatttagtcatgcttaaatatttttgttgttatcctttttaaactttgtgcacacttcaaaactccattagtaggttattttgccatgcatacatggaaatggtactgagttgatccgttgtattgcacacgggaatttatcccatttctagcatgaatggaattatttgttgttaaactactgcattcagtttagggcatttttagtgtatgcacattaatgataaactaaatgaaattgcggatccttgaactccaagggagttatctaggtttggagactcaataattttgggttgtacccacgaagttctcttgtgcgcttgttgtagattcaaactagggatggttatatatttgatggaggtggtatctacaccattctttccagccaactcatgactataatttgttttccattaacccagtttgtccgcgcacctcacataccctccccccccaataggtgttcttaggacattataatttactaagttgaataaggcttccatgttctaaaaatatatatcagcccccttgcaatccctggcctatccagcagtatggtttgcaagatcacgttggtgacaacacatggtcgggcacaactttcagaagacatgcctatagttaaaaatatagtgttcacttataagtgtcattttagcatggtgttttgttatcccctcatatctgggcacggatgagggaagaaaatgcatttctaaatgtcaagtatgttgactaggtgcttcgtccactatagggatggcaagggctaggtcaagcttaggcagagcaagagcataggtccgaccctagacctggcccgataccgtcttgcctgagctatgcctgatagcctcagcgagcatgaaagacacgccaatgctgagtgggcacctgaaactcaatgagtcacaatcgggcatctgctccttcaccgccactagggtg

SEQ ID NO: 18566 - DNA, 699 bp, Oryza sativa
  unsure (1)..(699): unsure at all n locations
agatgcacggnggaaagactctgggaagtgtgttggaattaatgaatgggccttagcccactcgaagattaattctttggaaaatcacaaaagcccacctcatgagatggcatgcatgtggagtttagtaccaccttgcttattctaggagagggggacctccttaaaagggaggatgctctcctagccacttgaagcatgtgtggtggagagaagaggggaaacacacgcgcgcgctcgctcgcctggcctggcagggcaggcggcgcgcgtgcacgacgtacgcgtcgaatggtccgaaaaattggctcctcacccttgcgcagatgcagcctccttttgcagttttgttttgctgcaaattcggattcggttttgttttggaaacgttccgaaaaatccggtacgtgcaaacggcgtggagtccggataagttacccgcgacttatcccgttccgttacgcgcagtagagatcgtgcgggcgccctgatcaagcgacccttctctatataaaccgacccgccggctttacgcaatatatgcgaaaatcaatctagggtttggcttctactctgtactgcgcccgcgctcgtagactactccattcccgctcggcggcgtgcaccagcgatcgggagagcaggtattccggaacctttgctttgacgttctgcaccggagaaggcggcaataaggtt

SEQ ID NO: 18567 - DNA, 13599 bp, Oryza sativa
ttcagggttctaaccctggccagggattgggccacgtggcaccacgcatagaacaccagccggattctcggctggagaagcgtgacacgtatcccacatctcctgcagccatacgatagcatatcaacggtgagaaaaaggtccaacggacgtaaatatatattgcaagtttgagatggtttttttttttacaaaatgtgtgatctcatctaaaacggtctagaacagtcaggagtggaccaaaaaaatcctataaaaagaatctaataaaaaaatcaacgagtggttagccccccaagtggcctaattccatatttttgtccctaagcatagccatttgattaaaaatcttgttagaaaaaaatccagaaaacatagtactatgcatgagaaaaaagaaatctagagtggagacccattgcaatctagagagaaaatctggaattaatatatttgaatctttgtctccattaaagataaatctggaattaatacaaagcgaaaatacgaaaaggtgttgcagattgtgaagaaaaaatagggataaaaataaaagagccaatcttaccagcccgcgagccgccgtcatctcccatcccacgagacgccatcgccagccatcaccaggcaaggagagccgcctcaattctagcttcttaggatgggaagagaaggacaatggcagatctggtcagccgacgaccttcgctagcgacgccatcccctctctttcttccccttcttccaccggattcgcccgtctcaacggtgcggacctgttgaaccggccaaatccaaggaagtcgatgttggaccgcaagcaacacctccgtcggctaccatctagttttgacctataagtgggttcgcgggtgacctgcttgcaccctaattttgagcgggtctttgaaactggagctcaaaaaataaatagagaaaacaatggaaaattaaaatgtaaaaaaaatagatctctaaaattgaagctccaaaaaataaagataacacaactgaaaatcaaaatatgtaaaaaaaagggagctaaaaaatagagaaacaaaccaaaatccaaaatgtaaaatttaacagcggtgcctcctctactgtgttccttaaaaaaatcacaatgtaaaagaaaaagaaagcacccatggatatcagttgcactgtatagctctgacgatttcagatgctagatgtggtcgattgactatgataataattgaaaatccaacagctcgcaaacaaaattttccaatttatgaaagctacacgtaatttcttactgaacatgcatttttaaataacaagtaggtaacataataaggcatatattactattgtatttccactctcaacctttgataattaaattaattatgtaaagacttgcaaaattattctgatcatgtcacaggctataaattttgaagcacgccaactggcgtgctgatgatttttctagttcttacttatttgtctgttttatcctttcctggccacttcgcatttccaagcagtttggtaagccccaagcagaaaaggagacaaaaattgatactctaatcaatttaaaatgaaaaaaaatcatcaaccacaaagttgatcttataacgtgtatataaaatttgttcccaacggacttcatatgaaacagtttacattttaagaggcagtgacggttctcctatgaaattttttttccacatgcggttttagaccattggtccctcttgtcattatgacaagtggatgttcttttgacccacttgtaaaatgaagctggactttttgaaaaacgatttttttaagtagtgatatcaaggtttggccaagaacatgatgaaagatattcacaatttaatcatgtaaatatataccatgaaatagttggtactagtctatctcaaaaaaaaaaagacaaactctagctacgaacctaaacacgcataagtccaggttcatagctatgattggttttttttgacacaggggcgtatgttgatacattttatctttttttagggtaaataaataaatccttacatcatgagtaatcaatgattgtgtgatgatgtaggccattgagattctcttggaaaatattttttttcagctaccatgaactagaaggtatcatacatttcagccgacgtccttctacaccaatttataccaacagattgaactgtaatataagatcaaattgcagtccaagcttcatcctatctgcttctctctgtacacctacccactagatatattgaactccaaatcaagacccaacacaacacagaatgcaaaaccaaccactgtgacttgaagtacagaggtcgcgtgtgtgtgtctctctctctctctatatatatatatatataaagtttatcaaaatactatctaggtatccacattccttcaaaatctatatattgttgttcgtactgcaagtatgatgccactattcaaccttgttctgcttaggagtgggcggcatcaggaaatgagatagaacttggcagctgtggtaatatgcacgcacaaagtgtaggccttcaaaatcatcaaactttgcttgtctcactaaactttttgttactaaagaagtttgtccatcttagtcatatcaccaattatgtatccaatggcaacatcagaaagagagcagatcagctagccgaatatgtagtgtacgttgtgatggcagacattgcttcctctgttcccagtcaaggtccggcacaaagtttagtctattttgagattaccgggttatgtcaagttggaaaggaattcatctaggaattgttagcgctagcgctgaactccgatcgaacaccttccgggcgaactgtagccgtccggcacagaaactccaagcacagctaactaacgaaaatgaaaacagagcaagaacagagtatcaaggaatttcagaacttagcgaaatcacgaacaaatgtggggcaattttctagggtttttcattcaactgaattgtaaaaccttacaagggaaaaatgaactgattgctacttatactctagaaacagaaagaggaatcctaggcctaaaatcgtgccatcccacgactcagtttctcctggactccatgcagatgcaaaatgccactccgcacgcctgacgcaatcgtcgccaccttccgcagcctcgctgccaacttcgtgcatgcataacaaactccaaacggattttattcctccagccgttacaactgtcaagactggatcacattggggccacagctgaaataaacagcaacaggaatcatgttattgattacatttgtggtgattttcttttgtgagatcagtagagacaacacacagtgtccggaaggatataaacacagactgatcgtatcacaaagcatcttgatatatcagatactatgtgctaccgagtgctgagtgttagaatgatagttcgtcatcctttccagattctgagatagataagattgaagtctcgctgctatatgtacaaacggtttcatacgtaggatcgaatcataataactaagccaaccagaggggggtgaatggttgttatacccaaaaaccgaaaacttttagcagaaataaaagttaccctcgaaatcgatggatcacggtctgaccgaaggtgttgcaccggtctgaccgcctaatgaacgtcggtctgaccgagatcgaactccggtcgaaccgccgagattgcctgccgcgtctgttgccgccgccagtccgaccgcctcgctcccaccggtctgaccgccgccttgccgctggtctgaccgccggtgagtcgtcggttagaccgccgaaacccggtgaaacacaaatcgaagaactcttaaagtagatgacgactttattgattctctctgtgtttacaaagtgcaccaatagcactctttataaaaattttgactaaactcgaaaccctaactcaaaactcaactcaattgctctctaaagtgatatcgagaagcctcacgctccccctctatttataccgaggtaggcagcctaaagccacaaaccaaactcatactagaagtcctaaacactttaggaaaccctctagtacaagacacaaacattacataaccaatcataccaaatttggactccttccaaattcgactccgcatcccatacgcacacagtacctctatcgtatgccatatggaatttacatcaaccacgtgcatcaactctgaccaccacggacgtcgtcttatccccaagacgactcccggtccatcaccgcaaatactcacccgaggcatcgagtcacctacacatgaaataaacaaagaaaccatattccgagaccaagctatctccaacttgactcattagtagcaaacaatagaattacatacgtatagtatccatctagaagccataatcatgaaacaatcacggatatccaaactaacaacccgaaaccaaaaccgacacagcgtcggccggtcagaccgcgggctgcgccggtctgaccgcgtgatacacgccggtctgaccgacagcacatgcccggtctgaccggtcacataaaataacagtacctgtgattcacatgtaaatccaatcatctccaaaaccacttcgtaaataaattccaaatatcaaaactaataatctccaatgccaattgttcatcacagaataataatcaaaaacacctttgattttacatcataatcaatcgatatcttctcatgtttaatcttacgtcgaggttgttcttgtgtgctgctagcttagagtcttcagagccttacgtctggcatatgccctaaaggcaatcatagagatgattgtatcacatactatatttacatatttatccgacattgttccttgaaatagataactcattattggttaataaatatgtgattctttcatgagactctttatgttgtttgttactatttctaaaagatccctgatcaaatatcatatgtggaacaaatatgtttatatgatcagcacatgtattaattgatgatcatgtctcatggatcatggtatagagataccaaattaataatgtggacacatgttggtgaacatattgttggatagacccaacatgagacactgcatgagccatatgtgttgtgtcatcagtgatctcatttagtgttggtgttgaatccttagacctgagattctcatggttcccaacatgtgtagtagcttacttagggactgctaaacgctactccgtaattgggtagtaataaaagtagttttcgggtatgctatgaaacatgtagtaggatataaataatcaagatgggatttgcccctcctatggagagatatctctgggcccctcgatgttgtagattatggaagtgcatggccataccaaaggtgattgaggagtcaatcacaagttatataatatatcaataggttcgagtgaatgattgagctattagaggacggcacatatctaaccttgagcttaatcgatatcgtggcgcaaaggggttcatacaattatacactagaggttcagccgatatgatctttatgtatgcccggtgggtcaatacattctgctaggggccgctgttgacgcgtggaccaaaaaggagttttcgggttacagccgagtatacatgaacctacagggtcgcacgcttaatggaccggaatagggggattggatggagatccaatatgagcttaattcggatagggatccgaataggagtcctacgggccatggaggcccgagtaatggatcttatatattcgtgaggggtgtgatcggcggaggcattgcatcacgtgagaaaccgtagccgtcacttccctccctgagcaagaccctagccgcgcacgggtgctagcacatctgtgcgtggcgttccgtccttgtacgtgtggataccggtagaggcgtcgctggtttgcggtgctgatcggcgtgggagtatggcgaggagatcgcacgaggaggagaaggtcgagccgatgtgatcgactacttcctctacatcaacgcgcgatacttcgcgagagttccttcgacttctcagcgtcttcttccgctgcgcagcgcgtcgagtagtaacgatctatgatataataattgcatggttcctggtttacacgatataaaattttgagttatgctatcgtagcctacgcgtatcccaacatggccaccagtgaaattattctattagctaatttgtagtatatggaaagcaggtaggagtacggttcagttactgagcaccactattttccttaattgccgaagatatggaatatattttcgctaccattcactcgcttccttaaaaatatccttgccatgtcaagcctgtgactctcacaggtgcagatagatcaaaggccctgttgtaaaaagggctgaggcaaccgaaactttgtagatagatcgaaggccctgttgtaaaaagggctgaggctacccaaacttagggccttttcgttttggaggaattttaaaggatttggattcctaactgggaatgagtggaattgggaaaagattgtagacgtatagagcctgcacgagttgacaacagtgctcaagtggtggaaagaaggtaacattcagcagaagatggaaacatggatgaaaacaacaggcaacaaccgatcgtgctgggataaatcattctaaggataaatcaaaagtaataccttgtaccttatagttccatctaaggataaatcattagtaatatcttatagtaccatcaaagacaacgataatacatttacacattactatcaaatccgagtacgttcatcgatggaagaaaacagatgaacaagatctaagcctctgtttgctatgcaggatacttcatgattcttgaggaaattaaacttctcatgtgaaattcctagtttctaatataaaccattaaatcgtatatcttcagaactgataataaccccaaaccctcaactactaagtggaaatttcatttttagtagcaaggacatcttgaggatatttttagttgaatttggtaaatcatcagaattcttaacataggggagggagggtgccttttgtctgacaaaattgacattcagccatcgtctaaagaaaattgcgaggcggaggaatcaatacctcatcgttgtcgacgccgacgaggaagaagagggaagcgtaccgccggtacaccaccttgtagttccggtgctccacgaacgaacactgcaaccgcacgaatcatacaaatcacatcatcacgaggaagagaacgaacacccaagaaccagcacagattcagatcatataaatctctatttaggatctgtttggctcagcttcagctctcaaccaaacagtttcagctccacccaaaatggaagcggagctgtgcggagctctctcacaaaatgaactggagttgtgtggagctgggtttaggcagctccacaactccacttcagacctaactcctgaagctaaatttaagagttggagctgtaccaaccaggtttttaatggcttatatattttaaatcacatattactttttaaaatctatttacatcatatattctactcaaaatttgtgacaaaacgagatccatgcggaatatattcaaacattttattaatttaaaagtaatttatttaaattgtagaagtaactcagatatgcaatagaaataactctctattacattagaagtaattataatataagtgagttgtagcaagaaaatatgtcgagtaaattcacaagcaatgtgtacagaagattttcaagtaaatacatttatgaaagtaagttacataaagtcaaaaaataatttacataaatcataaaagtaactttgcacaaaatggaagtaagttgttacaacattagaagtaaatccgttgtatggataaaaacataagtttatcaagaaattaaacttacttagcacaaattatgaaattgactaaaaacaataataaaagtaagcaacttagagcattatgaatgtataagaagtaatttattcaaatatgaaagtaatatatatatatatatatatgagaaaattttctcataaatcggataagtaatttatgagaaaatttaataagaaggaataaaaaaggacatgcatgtgtagatgtagcagttttttttccctcagcggctcttgctttgtgtatgtgcgtggtcgaatggctttgaggtgcgtcgtgcgataagattaaaacgagaggcttcttgatttagatgttacgctaatttttctatcatatcgccaactataaaatcataagcgagaggcaatcgatattaggcgttggaagatgttcgtattggtaaactccaccctccatggcaaatctataagcgaaagaagaagtgaaatccggctacatggcatctcaaaacagtcagtattatatcaaattccacataagcaagaaggtgatcgtgttaggctaagatcaattatgaaattggagacaacaagaacatatataacaaaacgcaagcagtaattaattgcccagcaaattgaatcacaggacggaccgacagggccggttagagtatagctaactagctaggagttgagttttgcacttggcctgtaggacatcaccgcgaacaccgtctgcacgagcgtgcagaggaggaggacggcggcggcgagccaggccaatatgagccacgggttgtcgaagtggcggcgcgccacccacgcgagccagcggttgaggcggcgtccgtggtgcctgttgagctccagccccacccctcgcaggtagtgatcgccgtcggtgtcgaaggcgaggcccctcgcgagcccccggaacagggcgcacgcgtcgccgtcgttcccgagcgagtgctccatgacgcccgaccgggacagcaccgccacgtccccagcgctccccagcagctgcgacatgaacaccacgtacgccgtcacgtacgcgtcgcgctccacgccggcgccgctgtcctgctcgaacgccagcacgttgcggaacacgcagctcatcttctcgtcgatcacgtggcgcgacatggtcaccacgccccacgagaagtccacgtcgaggagcccgaaacgaggggcaggctctgaatctgacctgaccctgaaccggacgcccgattcactgtactccgtcgccgtcctgaaccgctggatgtgaccaccacccgccgccgctgcctgctgccacccggctggcctcaggtaggtgtggcacaggtcgaccagatgcttgcagtcctccttgacgtcgtcggcgttggaagccgttgggatgtgttgcatgaagttcctcaccgcattccaggccgttttggctagagttgtaccagcatgatcgacgagcaagccgaagatgctgtgcacaacgaagaacgggatctgattctccagcagcaccaagtcgagaaacccgtcgacgagcaccctcttctgcgtcctgctgccagtgcccggtccagaatcctcttcttcttctttattagcaggcgcgtcatcctgttcctggatgccaaacgcggtgagcatcgcgatcaggaaggccccgtccaccagcagcatcatgcagaattcccccgaatccatggcgacatcgccgtcgtagcagcgcctcgcctcctgctccagcgacgccatggacagcaggcactctctctgcagcgacgccgcctgatcggcgtcggcgccgagttggagcttcatcaaccgaaccttggtgagctcgttcctgcccatctcctccgtgccgtggcggtggtaaggcccaaccgagaacaagctcggctggtaagcgtcctcgtcggccagccgatgcctccccgggacgcggaagatctcgcgccttgcctccacgacttgtgcttgtgcttctttctccgcggcgtcgagacgtcggatgatttcgtcgatgcgaatgtgcgccgcctcactgccacccatctgctccccgccgttcgtcctcatcatcggcggttcagttccatctggatcaaacaattactagttaaattaatcacaaatggaaataataagaaactaaatctcgaggggaaaataaaattaactataaccaaatatggatgagtttctcgaacaacgtgaatctgagaaacgtacgtactgttgggtgaagccggagcagagtccgcggaattcgacaaacccgtcatttccacgctcaaccgcagaatttccggacgaaacatggtgtctgatgaactcaatcggtcccggacgacaagagtagtaatcaatatctcagggaagtccagatctggtaacaggtctgacgacggatgaacaccacggcttgcactgcggcagatgagctagcgatcgagtatcgaggcagccatatatggcatgcggtcatgactcatataagatgagatgatgactcatgaacatatcattctagagcttaaattaggagggaagaaattacttactaacttatccgtttcacaatgtaagaaattttatcatttctcacatgttaatgaatcttacatcaatataaatgtaaaaaatgttataataatttatattgtacaacggacggagggagtatggagtaacaaatagagtgtgatttggttctagtacgactgagcacgcgcggtcgaaaaaaaaaaagaagtggccctccaatcatcaacagctatagcagatcgttatgatattgcgaaccacatggcctgtactaccaaaagtaccgagtagctccccttcaagaaaaaagcaccaactagctagttttaaaaaaaacaaaataaaagtgtaccaattagcaacactatattaccttgttttaaaatatgtgacgtcattgactttcacataacatttaatcatttatcttattaagaaaatttgtataaatattattctttttttgacttgttttttataaaataaaatataatcttagcaaataattttacatatacacattaaatttttaaataataagaaattaagaatggtccaatgttctctgaaaacttagcgacgccgtacattgcatgcagtatttgcaaaggccaacccgatggcttgagttgaaccaaaacagcacattgcactattggagaccgggaaagctcccgtgtgcttcctactgctacatttgcatatggatacgacaagtttatgacatgccaaacagtacacatgcatcttttccaattgcacccaaaactatttgaacgtgacctttttttcatgtttatcagctaaaatttaaattttccaccttaattttgaaactgattttaaggtttttctcatcaaaatttatttttcagtttttacttttaaaacgctaaaaacacatatataaaaatttattcacagatactttttatttgtaaatatatactccctccatccaataaaaaaccaatctaatacactggatggatgtatgtactatgaatttgactactattttttttacggagggagcatatcgtttcgattgggccgttgcatggcccgacgcgacgacttgacgactcttgtcttggcattccatgcgcgacagaccacgtgcggccttagctgtgtgtccatgctactctggacgcattatcaaatgctccggatccacgattccacgccattgagcatatatatccaacataccctgtttagttcacactaaattttatccaaactctcaactttttatcacatcatatcacatccaaaacttttctactaacattaactctcaacttttttttttaaactaccaaatttctccaaatttctccccatttcagacactaaacacagccaaaaagtatgatttggacagttttgttaattataagcggtgctggtaatttggatgtggacacgataaaatctgataccacaatagagttttgttaatcataaggtgtgctggtaatttggtgcaaggagttgctgtcccactctccgagcaaggaaaaaaaaacccaaaatatatctatctattatatactaaaagtccattaaacttcctacaaacgctcttaagccgtcacgtggcactcctacaaacgctcctaagtcgccacatggtacaatctaatctcaccgttcattttcacttaaattgatagacctgttattttacactattagattagatctattattaaaaaataatatcctcatgtacgtatgagtttgagtttatacgttacaaatgccactgctttctttccatacgtacaaacgttgtacataattgaaaacaaaactttcctaatcttcgctggaaaaaaaacatatacatgtacataaaaatgacagaaaaaacatacattcataaaaatcaacggtatttaaaatatgattttctactatataaagataaaatatattacttcacacatataaatatatttagttaaattaagatctataataaatatcctatcaatgttcttttaaaccatcttctaaatctatctattatataaaaaaagtacattaaactttctctcaaataaattagagaaacactaaaaatctattatacactaaaagtctattaaacactccaacattgtcacgtgatgctctaataaaattagagaaatcctaaaaatttagagtagaaaaagaaaaccatccaacctttaattttcacttaaattagtggacccactattttaaacattggattagagctcttaaaatttccgtgctgctaatctctatcccggaaaaaaacataacttgcttacgtcgtacgatcgtctcctactcggggaaaaaaacttaaatacctacaccatatatgatcgaaaaaagataaagccaaaaaaataaaaagaaaacatgcacacgtacatagtagtatcggaaagaaattctaatcatgaaaaatcatcagcgtcagcactgatttgttgtcaacatcctttaatctacgattttattataaataatactacacaaatatgcacagctaaacttaatcgtaaacttattgtagtgataaatatatcatgacaaatgacgccaacatgtaatagttaatgcgataataatgttccaaataatttcatatcgtattttatggtgtcaaatatcacgtgacaaatatacaacgttaatttgaatctacatatgtaaaaaattaaaataacaaaacctatagcattgttttttgagtacatctatttaggtttatttaattttggaagagattgagattctcaaagtattaggaatttttcaaaacttttcttatttgaggtgtgagaagcacaattaatagattgatgagaaaacataaattaaattttagccagtgataataaaacaatagaatttagctttggtttttaagtggatctttttaggtttattttgggtgatattgagattctaaaggtatctgaaatttttcaaaactttttgattgttatttgaggagtgagaagcatacatgatagatagatgtgaaaaaaaaataaataagattttagacagttattttgctagaatacaactcttaattcatcacgagaagtatgtattatctttgccaagtagtattggc

SEQ ID NO: 18568 - DNA, 18599 bp, Oryza sativa
atacttcatccattagagaggcattcatgtttatttttaatggtgttatcatattattcggtagatatgatatatttatactaattgtacatatgattgaaaaaagtgatgaacaccgggttatgttgtgtagatgaattttttagtgtattaataatgtatcatttgtttaagtggtgctaatacagattcatttattaaaagtcatctaactcttaaaacaattatagtaagtagtgatgacaaacaaccagtttatatatgaccaggataaagggatttttatttaaatctaagagacattcttatcacattagtagtatattaaaatctaccatctattttatggtaaatatattcctttttttattgtaggatgatctaaattctcttacactatatatatagtgattatatatatagtgatgtatgattccttttagcattctttttttaataacaaataagatgcctgtgcatctatgcaaaattcttttctgatttatattccggaaatgttctacaacttatattccgtcgttatagagtttgaaacacaaactataatacatgcccacgcgaatgcgcgggctacctttctcgttgaaaataaaaagcacttccaaagcatcttcttctaaagggctaatagcgttattccaacggatgtcacttatgacaagtatctaaggtatattggtaccgcagcacctatggtctattagaacttcactatgtcccttaggacaaagatgttaaactagataagacctaatgccaattgtaaaatcttaaaatatcttttctaccttaaaagctaaccaataaggtaagggctttctctcttatacattggttttttatccttcaacaacaaatgtgggaccgttcaacataatccatcatcaaaattacaacctcaagattgctaatcggattttgggttgggaatagattcctctttatttttcagaaaaaaaatctaaaaattgactgacagtaataaaaagtgtgtccaccctactaccaacaattcaaaaaactagaaacaaatatctcatcctccgtttaaaaaaaaactaatttgcaaagatcaatttggacaaacaaataattatctggactcatattcctacaatttttttaatcgaaaggatatatatctgttgtgctctctctctcctcaattatagattctctctaggaacgtgatgatatagcagaaattgttttttagcctgctggcttgtacttcctgctttaccgacgttgcttctcggaagcacacacccagtcgacgacgacttgacttcatccttatcactaaaaacgccgcctgagtaatacaaagaggcgtaggcctgcctgactataattggctcgatgatcgactgcaactgcatcaaaacattcagcatatctcttgctatcttgcaattgcaaattagttatactcgtagctactgcgcgcgcactaattgactacacaagcaaatatgggttctccttctgccaagtacttgctgtttagccttgcaatcctgctggtcctgagtagccagcagcaagctctgctgccttcggcattcgcccgccagttggttccgatgcccacgaacactgccgccggtaagaataacatcagtgttaattaccagttccatctgtatatgttttgtgaaatatcatgtggagaaactaaccactacatctctttgaacatttggagttgcggttctttcttctagcgtgtgtttggccctcccctttttaacctctactctcttatttctacttgcatgtttctcgaactattaaacgataatttttttaaaaagttatgtatataaaaaaactatttttaaaaaatattaattttttcttctaattttgataagctaatacttaattaatcatatggttacgagtccctccatttttgcatgtgcccaagaccttcattgcgaaacaaagccttaattaagtatagctagctatgtctacatactttctctatttaaaatataataattgcctcagatttaaatttatcgaggaggaattactttgaacgttttctggtttagtatatatttttttatatatattggatttttttttgaagtaacacatactcctacgtacattaattaactgtttccattcgcatgcgtgatggagcaatcgacaggccacgcagatgtcacggaggaaaagcctagcgtcccgccgtcgagcgtaacaaagatctgccgagttttacgtatctgcaaacgatcatcgtcggccgcaacatcggccaagccgtgatgtgtcaacgacggcaaatgcatgcacgcgggaataaataatggaggcaccgattaggatcaacaatatggttagtccattaaatatgtgtgtaagctcgatcgatatggaataatgagaaacaaataaacaatgagaaacaaatattcaccatgtttattactacctctgttttcaaataaatagtattgattagtgtaattttgaactaaccggcatcaaacaaaaagaaacagagagatacttgtttacgttacttcttttgtatacgtatccagccgcgatgttcggaaactgtgtaggatcgagattggcatcgatcagtaagggcatcaacaatgttactttttagctgccggtaagaagcattaaatgctcttttcctatccggtagcaagctctgtgagagtggcgaagaattaaaatctggtgataatatctattaccggtatattactaccggtgaagaagagataaataatattatttatatagtgttttaatagaactttaaaaaaatgaaagtggctgttgctgtggggtgatgctcggatcgagatgacatcgatcagatggtgaaagaattgtttaggctgtgttcagatgcagttcctaacttcaaacagtgcgcacgaaaaacgaagtgatcaattagcgcgtgattaattaattattagctatttttttaaagaaaatgataatatgattttttaaagcaatttttgtatataaattttttttgcaaaaatcacactgtttagcagtttaaaaagcgtgcgcgtggaaaaggagaggtgagtgttgagaacttggagtacccaacacagcatctaaacaatagtttcaattatccctataaactgtggcaacaaaataaattcactaaatatatatgtttgtaccgaacaaccttagaaaagactgaccagaaaagtgcatgatctgcaaggtagccaggtgcatttttagtgataataagtgtgtacttcgaggtaaattttgctacaggacgcttcgacttcgtggagttagccgtgggataccgcctgaactcatttttagaggaaaacactccataaatatggtaatttgtcaatggacaccgcacctattagaataataatttctggttgaagaggagagagaaatcacgtgaaataccaaaaatgcctttgggccaacacgtcagctctcctatctctcttctctctatcttctctcccagagggggcatcggtcgccggggcggaggacggcgaggacggtaggagcggccgccgcgggcttgcggcgggagcagcggaggacggcaaggacatggcgaagcggaggagcgggagcaccgggacgcgaagctgtgggtcgccggcgtggggtggcggcgcggccgcatgtgggacgtgaaggtggtcgccgacgtggcgacggcgatggggacggcggcgtgtacctgggtcgtggctggctgcggttcgcccgcgcccacgacctgcgcgacggggacctcctcgtcttctgctaggacggcaaagacgtggcgaagcggaggagcgggagctccgggacacgaagctgcgggtcgctggcgcggggcagcggcgcggccgcatgtgggacgtgaaggtggtcgccgacgtggcgacggcgacggggacggcggcgtgtacctgggccgtggctggctgcggttcgcccgcgcccacgacctgcgcgacggggacctcctcgtcttccgctaggacggcgccaccgtgttcaccgtcactgtcttcgacgacgggaccatgtgctgccgtgcctaccatgacgccgccagtaatataacctcgccgcgcgtcctccgtcccggcgatcgactccccctatgggagagaagatagagagagattagaagagagagaggaaaactgacatgtgggcccaagggtatatttttgatatttcatacgatttctcactcctcttcaaccgaaaattattattttaatcaacacggtgtctattggcaaatcctcttcaaccgaaaattattattttaatcaacacggtgtctattggcaaatcaccttatgtttatgtagtgtttttcctcaaaagtgagttcgggcagtgccccacgactaaagccacgaagtcgaagtgtcctgttgcaaaatttatcttacttcaaactcaggtagacgcaagaaaatatgattcagtgaggacaatacatatcaccgcaggtcaattgcaatagagctataacagctcaaatttcaagcacaaggactgaagcattactaaggacagtatgagcccagtactacccaagtactaccacgaaattcagattaaataaatacaagtaagatgcccgtgcgttgcaacgggaaattttattaagtttaaagaaattgagtgaaaatttgttaaactaccagaagcaagcagtcaacacgtacatttgtaatatctccaagcggggctgctcatatccaaatagattagaacgtatttggtacaaaacacctaacaaatttctacatgtgaaatattacacatcaacctgaaacagatgaggatgtaggagtagccattttggtcgtggaatcttgagatccatgatatgaaagagttgaattaattcaataataataaggtgttgtgttcaaaaagtccaaattttgataacaatagatgtgttaatttataaaaaccaattgattcatccttcctccgctttctggaatcacgtctcttcttgtttctatcttcctttagctcttttgtcaataatgggtacctctctctagcacacttcctttttagttcagccgtactgggattagtaacatcttcatgcatgttgggtgtaccgtacgacagttcagctttgtctgtgcatggtagccgcacatgcctaatgacagaagcgttattttcatagcctgcaccgcaaaatcagaatgctgatgttagcctaaaacaaatatctcatatattaaaaaaataaagccaatataagtatgataccaaatccaatagttgaggttctctgaatcttatatgtagagttcttgttgatctgttgacagttctcacggtcttttggaacattgatttcacttgggataaccgcgcggcacgcttgtttgtcaacttggcattaatcacattagttatattcacaaaaggacctaaaggaagagtgtatgtaaaattaggaagcaaaaatatatcaattgagtaatggatatgaccatggctggatggatgaaacaattacatgatcttttggacgatgttggtgctgaaccgccaccattgttatccattgcagaactaacttgattagaagttaaccgcaactctagaaaatcattgttcggtttcaatttagttcttcacaccaaaactggcacctaaaactgaaaatcgtacatcatgatgtggggataatgacatgcaaaagctaccagcaaagtagatgagtagactgtactgcagaaaatgaaaaaaaaaacatggtgcatgtactgaaataggtaagatacattgcaagaatgcggatttctgaacttgaactaatgttcagaatgtggttttcaatactacaaaatattcaagataccattcttataatagtattcagttttaatgtccatggtgttgtgcaacaaattataatgttgtttgagtgtccttaggcaaattagtgcaagatttgcagatccaagaatgtacaggttaagaagtgcaggccttcaagttagtagtagtagactgcattctgtatctttgctacctaattaaattgtacagataaatcctattcagggtaataggttatttcagaaatacttgccgcaaccaaaattgtagttactcaatccatgatgctaggatgcctagtgatgcaagcaacacaacatgcatggattggggatataacatcagaacttcaaacttattacatttttttaaaaaaagaagaagagcagagtccagatttgacctgttatctgaacaactccacaaaccataccaaatgtcaagaatggattcaaaaaattaaaaaaaccagagttattcagataaagggatgatggtctggataaaggaaatgcccttcattttctcatcattttatcaattttaggtcatgttctccaggcaactacacaacattgtagtgcttctatcccgttagaatggctaacggattaatagtctgaaacccctctaacaaccaaaccatgataaattctgaagcatgatatcttaatagataaagatttgtgatgaacgagagcaattgtttttattctaaattccagcatatgcaaaaaacagaaaaaataatatcttctcatatcaatcactcaaggaaaacagggaaaaaaagagagaatagtcccgcagtagttcatcattaataatttactgcccctttttgagatcatgcataatcacagttgttatgcatgccaatgatcctgaagacgcagatgaagttattactatgctttgcctgagagcctgacagctaatctctaggtacgctgttgaaaaatcatcacaatgcccagatatgcatggtgaaaaatcatcacaatccaatcagctcacatccctccccaattcatctatacgcacgctgttaaaaaatcatcacaatccaatctgctcacatccctccccctttcatcacacatggaattcagcggtttgatgcactcaccgatgcacacgaccttactcaaccgccaaaaacgcaaggatttttcattcagttaaagaagaggaagggggaagcaatggatgagtacctgcttggccgccattgccggtgaagcatagaacatgtagcacggcctgcccgctgacccgaacatgatggaggagcgggaggcctcggcggcggccgtccaggcgacctcgttctgcggcggcggggtgaccggttgctgctcttcccgcggccacgtgctcccgcctcgccgatccggcgccggcgcggtggagaagccgtccgcagggggaggtggaatgcgggcgctgggggatgggggatggggaggaaggaggatgaaggcggcggcgtctggacgatggatcggtgaccgctgttgatacggagggtatcgaggaggaagaaggatcaaaggcaccgctcgggagagaggggaacgcgtgcgcgtctgcactcggcaggatcagagcattgcggaagcgatctgagccattggatttcacgatcctacgtttagtattacgcgtgtctatcaggattggagtcaccgctaccactacggaatttttaagtagcagagattacgaatctcaactctaattgcgattgccactaaatattaggggtataaacggagcggatattatccgatccgctccgaatccgtccgatgtaaggatatggtaagggtttttagtatccggccggatacggatgcggattttgtcatgcggatatggtatcaatgatatccgatggatgcggattatccgatattttaatcggattatccgatgtactgtttggcggataattcacaactttcaggccacacaacaactttcagacccatctagcccatctattataaccctaacctaattcactcctcccccagatccctctctctctctgccgtcagccctcagccgtcacgaggtcgaggagtctgagagtggcggcgcgacggtgacccagcatggcggccgctcctcctcagtcttttgctctccccaacacgcgtcggccgctcctgtatgcctatggaactaccgaactattgtaatgtgtcctgtgtggcagtgtgcctatatgcctgtgtgcagtgtgtgctgtatgcctgtgtggcagtgatgacttatatttttaaattttaagcaacgcagtgaccattgaactactgaactgaacacttatattattgataatttattggatgtgttatattaagcaaaattatattattgatgggttttggttggtttttcctaaagagctgagatcatgttcagatgttgttttgctatcgtattgcggctaattgtaatgctgccctcttattatatggactgaatacaaacttgacatccgataactttttatcctttttcgaattgagtccgcaccgattccgcaccgaatccaacgtccgaaataatccactccacatccgcacgtcatccgtacccgctccgtatccacttaagaaatagtttaggatatgatagagctattatccgtctaaatccgctccattttcatcctctccttccctcccattctctgatctagtcacaacttgctgagttgcttcttttcatatgtgcgacgggagagattggatcgattttttcttcttttctttttcatgccacagaattggatgattttttttcttcttttctttttattttttgggacaaaaaccgtgatgacgtgcatgcttggtgagcacatttttaccattatttcttaattatgtgcacgtgaaattttttgtcctttccaaaaaaaaatattatcaacattgttttgcaagataaaaagataatatttcttgcataaaaaatacaacatttcagaggtttttaggtgacaaaggaaaacaaccttcacaaacaaaatgactaaaccatcagtgcttctcaaattgtcacaaagtcattaaagatgcgaaagggcctgtagcctagtggttacaagagtctaagtatcacttgaggttctgggcaagacgcctgtgatgactttgtcaatctgaaggatagcggctattgtaagtgtttgtattgtactgtttaattctaaaaaaagtcatctatctatctatctatctatctatctatctatctatctatctatctatctatctatcttctatctattttatactaaaagtccatgaaacttcctacaaacgcttctaaatcgtcatgtggcactcatataaacgcttctaaaccgccacgtggcactatctaatcttaacatcgattttcacttatattggtggacccgttattttagatcgttagattagatctacacagttaattttcacttataatttagttgctagaccattattttagattacatatatatgagaatatatagatgccaacagttggccgaaaaaaaaggcaaaagtatttactgttcgtactatggaaaaggaaaatccatacacgttgatttccagaccgttgttttagattagatatgtaagtgtaataccttcctccgatatatacatacacgagaggaaatttagatgtaacagttggctgaaaaaaaaaaagcaaaagtacgtaaagtaggtactactttgtggaaaacagaaaagcttgcgtatgtacggttcgccaaaagaaaaaaaaaacgtaagcaccataaaaaaatatgccgtcgcaaaaaaaaattaaaattatatatttaattggatcttgttgtattccttttatctaaatcaactattgacatattataaaagttatattatagtcctactaaatacatcacgacacatagagccgataaatagtaattaatgttatgataattttttaaatgattttgcatcatattttagggtgtcaaatatcacttgaaaagttttttaagtagatatgatttaattttaatttttttaatctcaaagtgtttttttgaaattttccagaactacttaattgttattagagaagtgagcagcacagatggtacatggatgtgaaaaatattataaaaaatatttcaaccaatgatcctgctataacacaatcctttaatctatcatgagatatatggttatatatgtatattttgtttatctggtcaaatagtttgataacaataaaataatatgtaaaataaactactcatgatatatttttcttataattgaggaattccaacatatcaaacataattaatagatttatatcatacaccccaccgacatgactaaagtatgctcctacgaattagttattatacaagtttgaaaaagaaattcttaaaggtgtctcatatgattatcaaaaataggtgttgaaaataaaccaattgctacgctatagatatttgtcaaaatataaaaataatatagtgctacgaagattatcctggtggtatgtctctttagttataatttttttattctatcgaatgattaaaatcgcttattttcaaaagtgagtactctatctatagcataaaaaaataaaaaaaaatattttgatcatctccatttcatctttgtccttccttgaagggcaccaagcatcgataacagagtttgctacgatatcgtaattagtacgggcatacatatagctgaattgagacggccctagtggaggccaccgtcgccaatagtgcccaacttactacttagtgatgcaatactatatgagggtatgatagtgaattagacattaaaattatactccagactggtctagatgggcacagctacatcaatgcaggacccatgtttcaaggcacaaagaaataaagtcttgctggctacaatgagcttcacactttataggggcatttatgtttaattttaagatgtatcctataaattggtacaagtggtatttttagaatgtttttatatggaattggaaataagtgagacaaaaacacttaggtatagtggatatttttagtgtattaataatatattagacttattttattcgtacatatgcagtttcatttattaataggtactcaactttagaaagtgataataaattgtagtgacaatagggaagtttatatgaaaccggaacaaagtgttttttttaatttagaagacatccttatcatttaaatatattaatatatatatggtagaaacagtgaaatgtgactttttttaatcattattttcataaaacaacaaataaaatgcccgcgcatctgcgcgggcttcctttctagttaaatataacaatctagtaagccatttacaacttagttgccgaggatatagaatatattttcgctatcaatcactcacttcctttaaagtgtcctcggtacggtgtaattcttaaaaaaaagtcattaatgataacaatctaataagccatttacaacttagttgccgaggatacggaatatatttttgctatcaatcactcacttcctttaaagtgtcatcgccgtgtctttacatattgcaaagcctatgactcaagtgtagactttgtcaatctcgaggataaggatttgctggctattgtaagtgtctgcgttgtactgtttaattctaaaaaaaaagttattgaagataacaatctaataagccatttacaacttagttgccaaggatacggaatatattttctctaccaatcactcacttcttttaaagtgtcctcgccatgtctttatatattgcaaagcctgtgactatattttcgctaccaatcactcacttcctttaaagtgtcctcgctttgtctttatatattgcaaagcctgtgactcaagcgtagatagatgaaaggcccttttgtaaaaagggttgaggctacccaaacttaactgggaatgagtgatacccaaacttaactgggaatgagtggaattatgaaaagattaaacacgtatagagcctgcacaagtcgtcaaaagtacttgaccagtggaaagaaggtaacattcagcggaagaacatggaaatatagatgaaaacaacaggcaacaaccgatcgtgctaggataaatgtagttcatcaatcaagatcaggaagatgaaaatgacattgcagcctcgtgagatttgggaattatatcatggtcgatagtgttgacccaatctacacatttcctctgtttgccccactacctcatctaaagttagatatcacgatatctatatggtcagagataggatcatgcctgcttacaacagtccaaacgttccttttcccttcaattacctagacaagatgctccctctaatttaacagttctacagcattatagtactccgtatgaagtatagtagttagagtaaaaaaatggtgatcaaattggagcacacatcaattcgagttaacatgattcacatcaattgcaccctctgacaatttaagccgtagcacttattatgatctcacaatcagtggctttgtaatcttcacaaatcatgtgtaaaaaatcaaaatgaaataacatgaagaaaagtacatcgcatctttgtattcagcatataatcatctccagtcagctcatatcaataatatgtgcaaacagaaattttttatactccccagtagatgaaagataaagcaccacagagacaaaaggattaaaaactagatagttagagaatgctattctaagaagttttctccataagctggattggtgctaagatgttctgtttacttgtctctactatgcagccattcatcaccatctcttccagcatgaagtgcaccttctctagatggaacatgatgtcgagttcacactggccaaaaggataattaccatcagcttgtcccatgtgatatatgtgagcgtatttacagtcacaagaaaaataattgttgggattactgaaaaataccacatttccgaagtggcggtccatagtttccacaaaaagatgaatgaattcgagaatagctagctcattctgccaaacaaaagaaaattgaggcattttaatatgaatcaaggaaaacatggtgcaggctgtagttatgattgacatcccagaggaaaactacaatgcaaattgcaaccaaaacaagttgaaggaagatttgacttcggcaattgctacaaaattcattgagaaaccaggcagcaaacaatgaactgcagtcaacaggcataagatggagatactgagattcgtatgcagagatgtaagtatgaaatagtgttaccacacagaatcaccaatataacaaattttcttactaaagagttctatctaatgataaataaatagtaatagcgtatatcttatagttccatcaaagacaatgataatgcattttcacattactatcaattagcaaatccgacttgtgcatatattcatcgaaagaagaaaacagatgaacaagatgtaagcctctgttgcgatgcgggatacttcatgattattgagtaaattaaacttctcatgtgaaatttctagttcctaatagaaaccattaaaccgtatatcttcagaactgataacaaccccaaaccctcaactactaagtagtaatatcatttttagtagcaaggacatgttcagaaactatgagctaactgcaactgcaggagcatttcggtgccataaaatggaatttaatggcaaaatttggtaaatcatccgaattgttcaacaaagggaggcagggtgccttttgtctaatgaaaattggaaggcggaggaatcaatacctcgtcgttgtcgacgccgacgaggaagaagagggaagcgtaccgccggtacaccaccttgtagttccggtgctccacgaacgaacactgcaatcgcacggatcatacaaatcacatcatcacgaggaagagaacgaacacccaagaacctgcacagatccagatccaagaacaggaggcttcctttccccgctcccccacccaccaatccggagcccaagtttccgcgctgggcaatattggatccaagaaaacgaggaggaatcggaggggggatcgggaattggggggttaaccaaaacctgctggtcggtgcgggcgaggcacttgcggacgatctcgccctcgagggcgcggcgctcgtcgatggagaggtgctcgtagtactgggccagccgcgtctgcccctgcttgttcacgaacagcacgaaccggatccccatcgcctcgcctctcctcgcttcttccttcgctctgttccaaggctgcttcgtcttcaacctctcgacactctgctctttctttctttctctctcccgtcttctgtttgactcttcttgcccatactcgtcttcaacacaaggcaaccctcttttcgtttgccctttttactatttctaacggtggaattattttaggtacggtgttcgtaatacaattcgtatattcagatattttattaatttaaaagtaatttacttaaatttaaaagttatttttttgacgggaaaccgcaggagaggctcctactgcgataatatattaaataagggatcgacatatacaaagaaaaagaaagaaagaaagaaaaagaaaatagattacaggaaaatatattaaatttaaaagtaacttagaattaactctttgtactattagaagtaattacattaggaccgaattcaaataaaaaatatgtggagtaaattttcaagtaaagtttacacaagattttcaagtaaatacatgtattatattttcaaagtaatcactatattatttttgaaaacaaaaattttgcatcatatagaaattaactcttcacgatattagaaataacttcattattagagaaaagtaatttttataagtaactcttcataataaatacactcctaaagggaagtgactataaaaagataatatataaataactaactctactactagatagaattaagttttcacggcaactacactgctataaggaaagtaactgtatacaaaagtaactcttcacgttattgaaaatagctacactgctagtgaagtttatcggtgatatggacctggggatatcatctttacagggaggaggctacccccgaacccacatgccccccctccagggagatcgggccttgggtggagcggcggctgcccctctccagcttggggtaccgagattggagggaggaggctgcccttagacccacgttgcactttcccgagtagggtcgagcctagggtggagtggcggccgacccctcctcgcttgggggtcgggccgtcccgaccccctgggcgcatcagcctactcctgcgagttgggtgggcgcgcccaccgcccacctaaccgcatttaaatcagaccgaacgggcgtgtcacgccgcatttaatgcggcgtgctgcgcgcctaaccagtctatgaacggtcgaatgactgatgggactggggtagtgcgcctacgcattgaccatgtgtcaggcggtgtgcagcctgccatgccccgtcacgtcatgatgatgagaggctttcccagccggagttggttcatccgctctagtcaagcagggttcccatttcccggtgcaaacaggaacccagaagtcttcacccattaaatgatgaatgaaacgggcgtcccctatgtcagccggttcgatttgaccggtcccacgaccgagatgacgtgcacgtgacttccaagtcaaggaacaagacatgcattcaatgcaaagattgtactccttcacccatagacaggttcttgggcccatgtggtaaccccttgaggtataaaaggaggtccatgcctactaagggagaggatgagcccattttctaacacacacttcagattcactatctcaagcatctacaatcttcacagattcagccaagcacaggagtagggtattacgcttctcagcagcccgaacttgcataaaccttttttgtctctatgtcttcgaggggcctgacccctctctttctctcatccatcacagggatcctcgaatctcaaccgctgcccccggccgaactcacaaagagagggggggtctcacggtcccccgctagaggagttcatcctctgacatagttaagaagaaaggttaaataatttaaatatattcaatattagacttgttttgtcatatattttgagtagagtatgatggttcaaacggatttaaaaaaaatatacagtttaagagatatacatcatcaaagattctattaaaaaagaatatatattagtgtaactatatgttagactcagtagcatgcacgtgaatctatgtaacaaccagcagataccatgtggtcctctttttctggcaagtgatctcatttctctatcacttgatcagtacaacatccacgtgttcatatcttagccattacaactgatcggacggcttacgaaagatgtttggataaggtcaaatagtgtgtgtgcactgaatacattttaccataaagatatgggttaattagattcatgccattataacctttatagttttgaaatatgccattactatttaactatttgaagtcgtgccatttagtagatatttaagaaatgccaccacatacccctccaacacactgaaatttatttttggaccaaattacctgagtcttttttcctccatcccctcctcccattctctttctggatctgagttcccggtgtaagcgtggtggagaggcccggcgagcagccccgaaggagtcaaagtgatgttgccggcgctgtgagatcgtactgccgcagtgtcgtgttatcgtgtgagccgcgaaacgccacgcccaaatcaattttgagaaaaaaaagataaagaagtaaaaaagagaaaacaatgcacggatgaaagaacacatatctgttgctgatagtcctatgcacaatcaatgtaaaacgagctttaagaagacaagaacatatcggcggaaggtgatcttggagcagccgaggtcgtcacgctcctcgcctcgcctgcgcggtgcttcgctgcagccggaggaggggaggaggatgctagttgcagctgctgctttcagtctggtcgccggtagttctaaggccgccggccaccactgaatcaagccaaccgggtgtagctccaaatccgaagagggatgggaagaagaggagtagagagagaaggagattgaggaagatgacatggaaaatttggtccaaaaagaaattttattatattaaaagggtagacagtgacatatttcaaagagtagttattccaaatagatgaatagtagtggcattttttaaaactgtaaaatttataatgacatgaatccaattaaccctaaaaatagatgctgcaagcaaaactcaacaaaataaccacaaattaagacaagtaagcacgtgtatgaagatgttcagactccatgtagacacgttctctgatcgatctgaagcccaagcagtcgagcttgtgcccaggggtcaataccggtgaaggtcaggagcaggtaaccgaggtttgagaggaagaaaatacatagtaactgcggtggagatatacaggtggtccaaactatgctactagaatgtaatgtttttattttgcatgaagttgctccagttctttcataatgttcgtattcgattaaaggtatatttttgtggaggctccaacttcttgttgtaaaaaatgattatttgccgagataaaatggtttactatttcaattataatattattaattgtaaagaagatgttttgcccttaaaaccatagagtgttctcagctccaaggctccaacttctagagttacgtttcttctaccaaccttataacaatcctaaatgacagccctaaactatgcgttcagtcttgtctaaatttaatggaaaaaatgcagcagaagattgtgagaaagtttgtttcgttttccatgcgcacgcttcccaaactatttgcaatgagagtggtgattactttactaatgtgtctctgggttttgatcctctcttgggtcggcaatggtgactcctgctcctttgggaggctgggatttctccctggggatcacatcagggatgaaaccctactcaggttccgctctcctgttcacttctctctttttctctaatcgtccgttcaccctggtggtagactttcctcactcctctttttggctttgttgctcttcggcggctctcgccctcagggcttgcattggtggttcttctggtgatctccatgtctctcatctctctggaaggtgttacagttttacagtttgttctaagaaagttggcctttggatctataatcttagatccttcacttgcaaggattatgttgctcggtttttcctctagagagatgggggccctaactggcataaggaatatgatatctggtcggcagctcaagaggctgattggacaattgttcgtcacaagaaaaagtctaagattgtttccaagactatctctagcagccgcaaatcagttcctcgtgccaacaatgctctagtgcctgtaaaattggtgttccatcggttgtcttctttcttctggcgatcaccggaggtaagatggataagaatccagttaatgtgggggcgg

SEQ ID NO: 18569 - DNA, 5776 bp, Oryza sativa
ggagggagtaatattgattacttgtggatttcaaaattataaatttagagcccacactattataatgcatgatttattttacacagactcgcaaccccatgcatggctcaagctaatattgttgatattaaaaatattaagattgctttcatatcttatatgtcttggtttctttcattattctggctttgctgaaaagaagaatccattccattttcaattttcttgttattatttccgaatttaggatatattaaaattttaggtatgtctataactaaatagtccatggtagtaaaatttgaagagtccatgatattataattaatcaataacacactacatttaacacgaatcctctcttattataaagttataacccactaactcctaaagtttaatatgcaaagatgccacatcattgtccactaacaatatgccacatcctcatccactaacaatcattaaatttaaacatcatacaaacatattatattatctataaatttataatttgttaaattttagagcttttaaaatataaacatgttaaatcatcatcccgtataattcacataatatttcaatatatatcttcattatttttacaatatgctatgtagctatatagtttatcctcacttagttaatgttatttctctcttctctcattgagtcatatcacatcaattgtttttagtgcttaaatgattaatctatggtctaaattatcacctcaattatttttagcctttagaagattaatctacggtccaaactatctcaatatttttcttctttcataaagtcatatcaccttacttttacatttgaatcattattgtatatactatttaaatttaaattatcataaaccacgttaacttatataatattatattgtctagttatcttacacgttatttttacttattattatcgtactagactcccgcagcaacgcacggggtttcacttagtatttagtacggcattgataaccaactaacaaacagtcgcaacttcttgattggtattgcttagattttaataaaataacacattgactttcgagcatgtaaagtaaaacttcatatttgttgttttgaagaataaatataaaattataaatttaaccatatgcatggatgaataagttggcattgtcatccttgaagaactaattaagaaagtatattttttaattgtaaattactttttggtgttttacaatcttgaaatatcattggcgttttattttagtaaagaaggaatagtgagttaattaaaactgcaatgtaattatttatatatttgtacaaacaatactaacttaaaactataactatgttactcttctaaatctattcatgaccatggattattatgctgtggttatttctggtagttgtatcgatcgtgaaatcagcgaatacatattggatgccaggacaatatgcttatatttgttggcatcttctcagcacatttagtacatgtcctcatcgagggttcgcatcccctgcctttgggcataacggcaagtttggatttcgctggtccatacatacacctcaaaaatcacttttttctcgaacggaagacctcttagacatcatggttgtggcccactgtagctcaattttgttttatgtccatcatgaatacctgcatcttcaagatttattatccacaatacatatcattagggaatgtatgtgtgtattttaacaaatgtatcagttttttctcattggacatggaacaaatggaattaaatttaaaaatatactgttcatccaattttttgtcaggaatattcgggatgcaaaaacttgtggagaaatattgtaacatacccgaattttaggtcttaaaaatttcttgttaaaatagttagaaactaacttttctaattttgagagccaaaaattgctactttaacctaggtgaggtcaacttaacttgtacttaaataaaaatttgagaacaaattaaaacctttccattttcagcctagcacaaaaatgcaaaaaaaaaaagtgtacatgcatatgcatctagcattagtttgatttcagtcttttatgtgcatttggattttggtttgcatatcatgttaggttcatgaacatgaataaaaggacaacttcactagacaaacccatggtcattcttgtgacgtaattataaggacatgaaagtgaattcaaataataacaactcagttcaagtcaagtcctaatacaagtctttacaaacatttagatgcatttatataatgagaacacttatataaataaacgccttgctaattattgaaaataatttatgcaaggtaaaatcatgggaaaattcatgtagtctctactcaacacatacaattcactataattttattaaaattttaacacttagaatgatacctcgaataaatcagtcaaaccagttaaatgatagaccaattataatccttaatcggctaaaacctgcctcaccataatgtgcattaaactgcataaaagtgtatagggtaaataatttattaaaatactaggttatttatcatgaataaatagaatttttacagaatttatctactctgttcaaatctcctaaaaattcaaacaaagttctaccgagcccatattctccaattttctgagtgcaaaccacataaaatttttaagagaaacaaaataaaatggaaactaggtatcttcagctacctccagaaaaatccacatgaatttatcgtgcccacaaattaaactatagattaacaaagagagaagagagattcaaatcctgaaaatcatccaaaatggattaacacccaatctcctacccacctctctcactccagacttgttcccttcgccctggacccacttggcagcctccttggcttgcccttcctctgtctctcctctccaaccgaccaagaacacgagagagaagaggggacacgccctgggcgccggtcgacgcgtggccgagacgcgtggacgcccagttctgcatctctagctttctcctcctcccagttgcatcgccacacatcactcaccacccgtgagccaaagaaaccgagagggagagctccagctctcctcttccctctcctcttcgttgccggccgccaggaagaaggacgccgcaacccatcgtcgagacatcgccaacaccaaatatttcccgttccgtattctaatcttcatgccgaacaagtttccttttgacaccatctcatttcatccactgcagcgacgggaacgccatcgtgcccacgggagctccagagcgcgcccggagcgccgccgccacgacctcgtcgctgtcccggcttctgtggagcgaatccggtcgagccgtcgcgctaacatcttcccctcgaggtcctctccaaatgccctcaagaatccccaagatctgagcactgaggagagagatcgagctattcttctccaactccggccgccgagctccatctttgattcttctttctccggtgagctccaagtcgattccatgcatttcctaggccctctttaacaccagagacatacatgcatggcacttcttgtagtgagtcaagccgacgccgttcatcgagaaggagcgccgtcgccgagccgttccgaacgccgtcgtcgacgaccaagcttcgccaacctcatccaatactactgtgagcaccctggagcttctagagttgcatgcatgcattttatccacctagatccggcctctaacgtgacatgcatcactaccccgagacccaaagccactcgtgctgccgtcgccattgattccggtaaccacagatcacgataagaccaccattggcttcgaaaagaacccctattccttttatattttggtttcatgccgagatctgccaccgttcgccgccagaaagctcgagaacgagctcagccatggctagctctgtttcagctcgaaccagggacctctgtggagaagaaacaaaactgtagatactactttgtaaaaactaccacacacatggaacagtcataggactgcggattgatttcctgaaaagccagggaccttttgcatattggtctctcactgacaggtggaccccatgagcttaaaatctgaaaatctaaggaaaatcctctagagctttatattttcaacagaaaaacatgcaaacttgtaaaattcatacaaagtgaaatatagctcattttgagatgattcaagtttctgtgaactcatagaaggatgaaatttaatatggaaacataaaacttggcacttgcagtataaatttcacctctaaaatttgtctaagaaaaactatacataaagcatgcacaaatttacaaaatgtatagagaattcatttcaacttaaattgaagcaaactcaacttccacagattcatcaacttactctctaaggtaaaataaaataaaaagatgcacttgctttacaccaaatacctctaaatgtatgttatacaaaataactaattttagacaagctgaactttaaaaatttatataaaattcatcttacttcctttttgagtaaactcaagttctgtagaatcatcaagtttagcactttagatatataaaataaaaatatatacttacagtgcaataaaagcccctaaatatttatataaggaataaacaacttagagcacccttcaacttctaaaatttgtagagaattcatctttagtccaaatggaatgaaccaaatttctttagaactagcaagtaatgaactttaattaggtaaaataaaatgtggcaccttctatactaaatatgtcactaaactttaaatagataacttcagtgctagtcacatggtataggttaggcaatacatatgtataaatgtatatataaatgcactctagctctaagtaaccaaaataaaacttgatagaccagagaggtcatagttctatccccaaccaccaaaaacttagcacacttagctcatatatcaatttctagattggtatgttaagtaactaacatagaacactcccctagcgtataaaatgtgtagtagcgtaatataatctctaaaattgtgaactaagattatattggttaataaaattagtcattttatacatcacaaacaatatgaaacatgtactggacataaaactccaaaaccatgtacacatagaagctacctacctacaacacgttaaaacttgtaaaatacataagaaattcataataactctaaaagttatgaaaccaaatgtgttagtcttagaaaacacatctctacacccctgagaaatcaaacctaataaaaatcactttgcaaaaatatttcataacactacctaagtaaataccaccctgtaccgagtaaacttctaaaactcataactcacaaataaaaagagataaaatataaattctttcacctaaattcatcttagatcagtacctacccactgtgcacaaagcatgcattttagagcattttgaatttttacctattttggtgtttaattgcataacgtgtattttatatagataattgcgtaaatgatgaagaagtgaattaggtgctaacatttcccaggaacaaggcaagttttctcctcccaatctttgatcacattgaatcccatgttttgaggaatgaaaatatatttgtttgcaaagttgcatatgaatttagactataacggtatttgaaacttggttatggtagctatgacctaattgctgcatttacttctttgaataattgtgat

SEQ ID NO: 18570 - DNA, 658 bp, Oryza sativa
actaagcctcatattttcgatggaacggatttttctcattggtgtagtaggatgcaatcttacattatggctgagaattatgatctttggagaaaagtttctcatccttatgtgattcctgaagctattaatactgctgctaaaaaattgtttttgaacaaaattgcaaagctcgcaacattcttttgagtggtatttctcgttcggattatgatcgtgttgcttatcttcaaactgctcataagatttggattgctttgagtaattttcatcaaggtacaaataacattaaaaaacttcgtcgtgatcttttcagaaaggaatacattaaatttgagatgaaacctggagaagctttggatgactatctttctaggtttaataaaattttgagtaagcggtcagaccggccggcgctgtgtcagtttcggtttcggttggttggttggatattcgtgattgtttcatggttatggcttctagatggatactacacgtatgtaatactggtgtttgctaacaatgagtcaagttggagatagcttggtctcagaatatgggttctttgtttgtttcatgtctaggtgaactcgatgcctcggagagtatttgcggtgatggacccggagtcggcttggtggtaagacgatgtccgtgg

SEQ ID NO: 18571 - DNA, 1127 bp, Oryza sativa
aattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttggattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggtggccaaatacgcggccctgc

SEQ ID NO: 18572 - DNA, 467 bp, Oryza sativa
cgaaggcgaagtcctcccagcggtagacgtagccgtgatcgatgttgatgacgccgtttcggtccaggaaggcggcgggacgcatcagtcgtgggcgcggatgcggttgacgagggccgtcgtcgaatagccatcgacgaaggggatggcgcgcgcgtcgccgccccaggaacgcaccaggcgcgtctcttccagcttctccatgtcgtagtcgccgcccttcacgtagagctgcgggcgcacgcgcgaaagcaggtcgcaaggcgtaggttcgtcgaagaacagcaccgcattgacggacgccaggccggcgagcacgagggcgcggtcgacgtcgcggttcaacggtcggtcgggccctttggccgagtccgcgcgcggaggcgtcggaattgacggccaccacgaggctaccggcgagctcgcgcgccgcgtgcagataggtcacatggccgcgatgcagcacg

SEQ ID NO: 18573 - DNA, 17306 bp, Oryza sativa
  unsure (1)..(17306): unsure at all n locations
cggacccagagtttgttcatttctatgaaattctgaagaacaaactcaactgcgacgttaatgctgtcagcatccctgtgtgatgaaagttgcaaaaggcaggtataaagaaacaattaggtactgtaaaagagaagaacataaatgtgaagtagcatatactttcaggacaaaacacttttgcgctctgcatgtcctaactcccagatataataaagtgaattgaacttcatgttgcctctagtgtactgatacatgatcaagcagcgctactggcaaagtggcaatagttaagacttccaatatacagttggtcctaaataaggattggtaaattatatatgagatagatagagcagcgatgacaaataaatgaattaatgcacaggaagtcacagaatcaatgcctacaccatagcatgcacgattcaaaacgaagagcaagggaactacgtacttaacattaatttgtctatcagttccctttcatttggattttgtgattacagcctgttcaaaaggtactatatgaatgccaaattaatgttgtagaataagacaacattttacatacatatgaaacattagtttatcttcagttactgaacatttaaacagcatggcatggagtgcattacccttcatactcggaaccaatatctggcagtttgtctcggcttatctgagataggtagcttcttaggaaaagcccacgaagaggatgttggatgcctcgacacatttcaacaaggtctttaagaacgtctttcgcaggagcctcttttgatttaatgtacacagatcctactgtgcagaggagatagctaggacatgaacaacaccaaatcaggttcataccataacagttcttcagcaatttcaaatgagtcaaaatcacatcccattgtacatgcaagcatgattaaccgttggcctcacattcaggtgtgacaagtgtattcaagttggtcacagtaaaatcaccagggatcagtgttctaaagtcagtgctaggcaccgggtagtcatcgtgattaggcattagatggtgcatttaggtggctaacctaccttgggtggtgttttgttgctattttagtgttatattgtctgaatttaagtaatatacttactaatttcttgggtttgactagttggtttgacctaggcgccagcccttccaactctctagcaccttcttgaaccatgtcggcaattgaatgatatggcttatataatgtctactggtatgagcactgatagtcaagcaataagactaattaagttcagttgtaccaagtaaatatacagtagttcaaacttcaaactagtcttttcaacaaagttaaagttactcgaaagttaaactatcgaagtaccaagttctgccattgatctagtagctacaagttattactagatcgtatagagttgtaatgatctacaggactgcaatacccaccacaaattcggctccagaaacctcacagagcaagtaaaacagagctaacagcacataattacacaaagttaacagctgtttatgcctgacaaggggtgcattagtcttacagtctgggcagtacgttgccagcatgctgcacaagctcatacaaatcaacaacggagcagctgccacgacgggtctcctccctgaagaacatctccagcttccgcatctcatcaaacgccctcatatctgcagcaaaatcaataaacccccatcaaatcccagctgaaaccacagccaaaattgggcgcactgaggaatcctgacacataagaaacactcacatagatcataatacttgtgcggcgagagccgcgaggtccgcagctcggagagcatctgcgccgagtacttgagcgcatccttgaggttgttcgaatcctgcgcacgaattgccgatcggggcagatgataagcgagagggggcagtcacagaccgagggagctagggtttggcgggccttacgagggcgcggtgcatgtagaaggcgttctgctggacgccggcgatgccctcggcgagccaccgctcctcgtcgtcggcgccgccatccggcagcatcctgaccgccgccgtggccgccgtcttcgctggctgcgggggtggatctggtcggcctctggtggctcgggttggggttggggttggatctcgcctctcgcgcgtgggcttgtcccctctcgggtttggatcggggcgagtgtttgtgttcttcgagtgtttttttatgatcggttttttcctcttttttttctgttttccgaagtggttcgatgattcgatctggatcagatgagttgacggccgaactgggtctggggtgggctgacttgtcggtaaaggccctgttagtttcaaaaactttttcccaaaatatcacatcgaatctttggacacatgtataaagtattaaatatagatacattaaaaaactaattacacaattagggggggaaatcgtgagacgaatcttttgagcctaattagtccatgattagctataagtgctatagtaactcacatcgtctcgcggtttccaggcgagttatgcaataggcttttcattcgtgtctgaaaactcgttccgacatccggtcaaacgtccgatgtgacactcaaagatttttcttttcacgaactaaacaggcccaaaaacgaatttaggcctctttagttcccaaataaattttttcacgctgtcacatcgaaatgtttggacatatgcatggactattaaatatagagaaaaaccaattatataattcgctgggaaattgcgagacgaatcttttaagcctaatgacgccatgatttgacaatgtggtgctacattaaacatttgctaatgacggattaattaggcttgataaattcgtctcagattcctagcggaatctgtaatttattttgttattagactacgtttaatactttaaatgtatgtctgtatatccgatgtgatatgcaggggcaaaaatttttgccaactaaacaggcccttactatctaagtgggtttaaaaatatgaatttactccatctgaaacctgctctattttttttcttctaaaaaagttagctatagccttttatctctactattataaaagttgaagatgtttttatcaatactttggtacgtcctccgtgtatgagtcggtttttaagttcgtttacttttggaaattcaaatatgtatttgagtcgagttttaagtttgttcgcttttggaaatacaggaggagtcgtataagaaatatctttttagaaaaacttgcatgttaacttagatttatcggactcctaattgtagcttatgattttctacaaaataatatatccaagcgatgatcgaactcctaattgcagttcatgattttctagaaaataatatatcaaagcaaattctcacagtaaatttcaccttaactagaccgtataacaataataaaattaaaatagccttcacccgttgcaacgataggcaatttttctagtaacaccaaaacttaatacgatcctttagccgatgagagatttattcttaagagacggagttcaaaaataatttaataacttttttttatctttagaaagttttgtctaatattcaatcaggactagtatttttttcttttatttctataaaacttgtatggtattcgattaggactagtctcaacccgagagtataaatatatacacccagattacacccggagtctttgtaatctatctccacatatcaatacaattgcttttggcccatcgtcacggactagtctcaacccaagagtataaatatgtacacccagattacaccccgagagtataaatatgtacacccagattacaccccgagagtataaatatgtacacccagattacacccggagtctttgtaatctatttccacatatcaatgcaattgctttcggcgcatcgtcacctttattccgacgggactagtatcaacccgatgagttcttagttttaagtttgggttgtatcggttaaattcgatctccggcaagaaaataaattctgtcatgcaaggaagtaaattcatcatcttcgcttgtatcagcgtagttaaaagcccagaactttctcggttaagtccaatattctatagttttgcctatcagagaagacaaaactagtcatttaatacaaattatgcctaactcatctttgaactgaaccagtagtaggggcaagacactgggataacacatcagaataccatcaatgattttgtcacacgatttcattctcatttcttaacaatctcgagtgctaaaatacaccgccatctggagtagtcccaaagggaccatccaagagaattcatgcgtgaaatcgcgttgttgagagaattcatgcgtgaaatcgcgctgttgagacatcacgcatgactacgtagtagtagataaataaccacaggacgagtgttcaaataacggaatatatagaacacctaattattacacttagtgcccatacggatcttattacatcagtgcatcggaaaaaaaaatcttactccatcaatagtatgtctgagacagtccagacaagtaacatggccatcgaggaaatcacgagcttcatagttatatcaaacctaaatgtgagaaaatatatatataagaattaatatggttagttaacaagtactagtaaagattaatggataggattcaagtaatatatgctaagggttatcgcaatcatcgacaagttgcaaaataccactgcgaaatagaatttagcaatggtatctatgaatatgattgcggtaatactttgtattgtcccacttacaatgggtcctctcgcttgatagcttccgattctttaagattctttatcaacgagagtagcttaagcttctcttcatcttgcattctaaacagctcctctccctcctcagtttgccttggtgctcttgaagattcttgcttaggcgagggactctgggcaataaaaaaatatatttgaattaaggtacaacttacaagcaagcagtttcttttttacttttatgagaacaagtaatttcccacgaataaggatcatactccgtgctagcaataagaatcgtaagaagagctcctgtctaattatgtcaagataacacaggaaaacaagatggctagatagacaagaaaatgaactgattatcataatttaacctatcgtgagtacagatgggagcactaattttggttaatctaaaaaagaatcatttatttagatccagtaagagagagaagcatttaccgtgccacgtgactcggaaacactggaagagaagaaacgatacggggtgagcggcggcggcggcggcggcgtcaggtgtttccggcggagaaggccgccatggctaagcaaccttggcgggataaccgtggccgccggctggggctgaatcttgggtagagcgcggaggcccatcctactcttgctcgccagagaccgaagagccgctgccgccatggtcgctggcgaaatcgatctcctctgtctatcgatccctaatcccccctttgtacttctgtgttaaccggaataagactatgagacatcttagagttggacttggacttgggagtcttggacacgaacatgtgggctgtggctgaggccttcacctcaccgtacaaaggaatataagttcactttgactcccagtaactgaatcggattcatatccctctccctctctctttctctccccttcggccttctgcaagaggcagtcagtagtgacggcgggagggtgggcaccggagcggcggcggcggcttgggtggggaatcttggattgctccgcctagaaatttccccagcaaaaatcaaagcaacagagtcaaaatcgaagcagtacaagcaaacagatgaagcagagaagggtcacgtcctcacgtcggtgagccctggaattgaagagcaagcaaatcaaggcagaaggaggcacaccttgagctcaacgttgaggacacagcagagcagatggcagatcgtagaggcgcatctggttgtcgcaacttggttcatggacccctcgacctggaacccagcacaatcaagcaaagcaagccaaaatcagagcgttggccctcgccgcacgccgcaggagagagagagggaggggggaggggctctgccgctcgctgccgtctccgcttgcccaccgccgctctggcccttgccgccgctcgccgccgtcttcgcttgcccgcgccgctccggccctcgtcgcacgccgcgggagaaagagagggaggggctccaccgctcgccgccatctccggttgcccacgccgctctggccctcgccgccacctgcgggagaagggaccggagggagggggagagagataagagagagacggcgccacaatatgcgaatgacattggggtcccacacatattttttttatccacctaggcgtcacggcaacgccatgtgaaacgaagaccaggtcaataacaccagtaaacgccacatcagcgaaaccattctccaaaatcaccaatggagtcaaattgcatcggtattaatatttggggatcgagatatctgatattgtggttgagggatatgaatcaaatttgatcagggagttaaagtgaacttagggcctgttcactttgatgccattttaaccttacaaaattttggtaaagttataaaaaaagtggctacatttagtttgctgccaaattttggtaactatataagaaatcctgccaaaattttggtaagttgccaaaattgtggtaaggtttttttggcatcaaagtgaacaggcccttagactgtgttcggatgtctgagttcccaactctaacagtgtgcacggaaaacggagcggtctattagcgcgtgattaattaagtattagctatttttttcaaaaatagatcaatatgattttttaagcaacttacctatagaaactttttataaaaaatgcatcgtttaacagtttgaaaagcgtgcgcgcgaaaaacgagaggagagtgttgggaacttggagttttaacacaaccttattccgccgtacaaaagtggagagggagagaaagaaggtacgcagtagcagctcgcttcctcccctctggttgatcttctacccttcggtcggccgaatcagcaagcgggaaggctggggcttgctcgatcccaaagccctagcctcctcgtcggcagatgcaaaggtttctgggtggattcgtcggcggcgatgcgcgtgaggaggcagtgaggtggatggtggaggcgggggatagatgagcggatgtgggggattgagactctgatgagcagaactgaggtgtggcaacgggcaatcggatccagaacaaaacgggtccaaacccaaatcaagttgcgggcccgataatagttgcacgaatcatggagcgatctacttcctccgtttcacaatgtaagtcattctagcattttacacattcatattgattttagtgaatctagataaatatatatgtctagattcattaatatcaatataaatatgggaaatgctagaataacttacattgtgaaacggagggagtagtggttaggaattcagctgaaaaaacaaaaaaaaatcagcaaggtgttacgtagcaaatccttaaaatttttattaataaattacttttcgtttgcaaatatgttaagccaaacgattgggtccacgaagcgtacattttttcctccccaacatactaggaaggagctttggtttggttcggtttgttattaggaaggagatatttttattattatatatacttccgtcattccatattgaaaaaaaaaaagagggagcgatgatgtggacacactgacatactccattgttaacgaccaaatccctcctcttcccatctctcctcctcctctcttctcccttactcggttactctctctcattcttctttgggcaggccggcccacgggcacgaggcgggagaaagggagggcggccggccggcgatggccgacgcgggagaaggcgagacgatggctcctcctaccgcgggcgcgaggcgggagagagggagggtggccggtggcggccgatgctggggcgacggcggccggtgatggccgacgcgggagaaggggagacgatgggtcctcctaccgcgggcgcgaggcgggagagagggagggcggccggtggcggcgccggccgacgctgggccggcgatggcggccgacgctggggcgaacttcgcaagcagacgcacggccccacacaggcacgactcctcccttgtcgcgaacttcgcaagcagacgcaggcactagcgagcggcagcggcgagtgagcccttgttggcctgttctgctgcccccatcctctgcaacctgcagcttttcttgagcggcacttgtttaagggagtgtttgggaactagggactaaatttaggcctctcataaaaatataaatccctaccataaagacttattcttttataagagggactaaaatttagccccactttagtccctctaaccaaacaccgcctcaatattgtttatgcatcgggtgtcatgtgctaaaacaagctagactgctgttgtgcttctgcaaacaaggaatcgcccaacagtagcaagaaagaatggttggagatgctttgctactgggtttccttccgacactgtagcggagctcaataatgtcagggatttgagctgatgagctttatctctgccctgaatgtttccttttgcagctatggttttggacttttggtgttactgacgtgaacatgttaaatgtatgtttgtggcttggtgaacctgcttaatggctgctataaaaccgttttgttcttttcatttggtgttactgatatgaagctaactgtaactgagtatgatgtacaaatacaagctagcagcctagcaaagcttgatcgatagcaatggcggcgaaggcgatcgactgcccgccagcgccgaggccgacgccggcgtcgacgcccagcaccgggttgtcgtcgtgcccacgcgacgcgctgaagctgcgtgtgtgcgccaacgtgcttggcctcgtcaaggccaaggtcggcgcggtggcgccgtacgagccctgctgctcgctgctcgacggcctcgtcgacctcgacgccgtcgtctgcctctgcacccggccctgcctcctcctccgcgcccagcaccgcggcgcccgcccgcgctgggccgcttcgccgccggcggcgactcagcgccgtcgacgccattcgagaccggccgccgccctcgccttctcccgcgtcacagccgccgccgccgccgcctcctcctctcccgcctcgccccgacagcctcttcccagccgccagccggctttgcccagagaagataagagaagagaagagtgagagagagaaagaggaggaagggagaggaggggagagagagagaggaggtgatgatgtggcatcctgacacatggggtcatgtgttctacgctgacttagctgtcacgcaggataaaaccgggtcaaaaccaccgaataagatattatgatcggttttgattagttaagtgacatcggatatttggttttgctgtttggggatgaatttgtaactcgatgataagttgagggatcttctgtgtactttttccttccatatcattatctaagcaaatagtgtatagagataaaaaaaaacaattaaatcttagtcgttctgaaataatcctcgtcggtccatactgcatgatgatcggagtgccaatggagtcgcgaatgaacgatgtcgtgatagaggaaactacatgccacggacaggtaggactccatcgtttaggttatcgagggaataagcgtaatgacatatttataactagaaaataatttactcttccatatacaccttctatacacctacacctaggtgtatgtattccatttattagtggatgatccattagcattaaattagccatgaaaaagaataaaattattaatttccaaatcaccgcatgcatatggcctagctgcccagcggatttggtgcaaatttgaacaagggcgttggcatgcatttgctttcaaatttgataacgtaccatagttatacccgtttttttgacaaattgacccttttggaaaacttatttcgaaactaacccctgccaaaaacttcaaccaaaaataggccgtcgcctcagcgccaaacacattggcgctgacgttggccgtgtcagcgccaacgggactggcgctgacattgtgccaccgtggcggccgggccgatccccagctgacgtggcagctacctcagcgccaaccggactggcgctgaggtgggacttggccgcaacccccaaggcctagaccagcaaggcttctggatggcttgcgggcttggacctcagcgccagccataatggcgctgaccgtgggacactcagcgccagcccacaaggcccagaccagcaagcctgctggatggcttgcgggctgggacctcagcgccagccataatggcgctgaccgtgggacactcagcgccaggtgggccttggccgtttcgagccttctggatggcttgcgggctgggacctcaacnccattcataatggcgctgactgtgggaaactcagcgccagcccacctggcgttgaggttggacttggccgtttcggccgtggcccaactcagcaagccttctggatggctgggctgggacctcagcgccaggtgcactgacgctgagtttggacatgtcagcgccatttagcatggcgctgacgtcccagccctgctaaactttagcaaaactttgcacacaacatagggaaacatcaaatcacagaaatttacaggcagtaatatatccagagaaccatacaaaacatacatccatccatcaatcccaacatcattccatacatccatagaatccatcaatacatccatgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggtcggaccactccttcctcgcccccgagggccgaggcgccccgacccctcgcgtttctactccacgtgtatgagttaggtgagcacagcggggctcacctaaccgcatttattgcgccgcggctaagcgtgtcacgccacacgaagtgcagtgcagtgcactcgattatccggtctgtgaccagtcacagaccggtcaaatcgcgggttaggtggcgacaggcggtctgacgcacgcttcgccccgtcccgtcaagacgagagcttctaggcactcgtccccggctggagctagcgtgttacatcccagagatgacacgttagccccgatcaatatatgccaggcttcatcctaaccattacaagcaagatgttgtttgaagaagggcgaacatgcatgttgctaagccaacgcgtggtggacaagaatgaccgatttgtgactggtctgacactgctcatgtcgtcagcacacggccaccttcccacgatgtgcctgtctcaggcagaagtggaggtaggtgtgtgccgtcccgtcaggaggatgttcggaggacgaccgtgcaaatctccgtccatttatgaagagaagaaaagtccagtttggaaagggaaaggggcatgtggtatccccttgaaatataaaaggaggacctggcccatagagaagggggatgatctttttctagattgagaacctagaacgagggttggatcttttacagattcgggacctagaacaagggagaggttggctcacactttgtaactccttcatacacaaatccaccaaaacacaggagtagggtattacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcaatccatatatgaagtccatatatataagaaataaaaacatcccatcgatcctcgtctatacatccagtcgagtccatacatccagtccatacatccatcgaaccatgcatcaagtccatccatctatccatccatccattgaaccatgcactcacctcctcctacctctagtgcgaggacgaggcacgtcgggggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccacatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcaccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtccaagccggacgtaggacaagacaagacggtaggtcctgtggagccacgccaagtacaactcgaactccgtcccgttgtgctgaccctggtctggtactccattctcctcgaacttctcccattgcgtgatatgatcctgatggtagtaagcccaatcagtcaccttcttgttcttccgacggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcgagcacttcctgtgcctgatatggcatccacaccacctgcagcaacaaaaataaaacacattgaagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacatcggtctgcatcctggtgcggccaagcctgatgggtcctccacatgggccgaccaactggaagcctcatccacatccaaacctgcgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttcccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgcgccgtgtgacctctgactcgaagggtcttcaagcgctgcatcaatagacaaacataataacataaagttagcgacaatatatcatatacaagggttgtggaaaatacatcatgcaactaggaactttaattttgggattgagcaagaaaactgaaaagaagatctgtgtgtttacatgctctgctttgaggctcctgaactttgatttgagatatctctatgatggatgatctatctgtacaaactaaaatcaaagaagaaaaaataaattcgatcataaaaaaaatggaatattgttgatgctaacctctccgctggcaatctgtggggcccggtgcttctcctcgtagaaatcctccaaccccggaaagtgctccatcctgcaaatgaaaatggaatcattagtaattgaaaaaatattaaatggaaaaatcacaatgagaacggaaaggaggacaacagaaagtaaacattgaagcaacaatatgaacttagcaaatgaatgtcatccaatcccacctgtgtgctaccctcaccacctccccccgtcctacggcgctttttcggtcgatccttagacttgtctcgcttcgggcacctagttttcttatggcctagttcgtggcatagcgagcatctattttgcatgaccggctctgaatttgtattgttcggcttttgtgaccgtcggttggctgagcctttgtatgctttgtccatatcgttcttgaaccttcttgtccttcttcttcctcgtgtgttgttctttaacgacaagtcgggcacgaagaactctccatcataacttggccactgcgatggatctaggtaaggttcaaacctaggggagtacgagtcctgcacagccttattggaagcttcataacacattcgggggcccacctccacatccaaacctcgcaacttacaacggtttatcatgtgggagcatggcaagtgatggagctgagggaactgacaactacatgtgttatctctcgcaaccacgacgtagtgacgtccaccccattgaaccccagccgccgtgactccgccttgctcgctgacctcatattttcatcgaagggaaatcaaaacatgttgctctttgccccaaggttcgtttttgctgctcctccaacatgtccttaacttttgtgggccacttctttccacacaggatatctacagttgcctctttgtgtctatcgacaaaccaactattgcacttcgaaaatgtgtatgccacaatagctgtaaccggcagtttccgaatgcctctcaatacattattgaaactctcggccatattactagtcatgatgctatgacgacgcccgttggtatcaaatgctcttgcccatttgaccttaagtggcatatggtcttctagccacttctttggcctctctccgaccacacccatgaggcgttttatctcatctaggaacaatgctttctcatctatttgacatatgcgctcaagatctttcatctgatcagtcgtagctccagctgtgtagaagttagcacagaagtgcctcatgcaccacctgtggtgaatggttaggtgatgaggcatgatgtggatgatggagttcaaaatgccagggtgtctatcagaaattatacacacttctctattaggaccgatcaacttgtttctcaacatgttgatgaaccactcccagttggatgtattctccttctctaccagagcaaacgccaagggaacaagatgtaacccggcgtcgacccctattgccgtgagcaatgtaccttggtatttaccggttaagaaagtgccatcaattgctagcaccggcctcaagtgcttgaatgcttctatggactggccaaatatccaatatgcacgtccaaatactcgcctctgtactccatccaccatcctggacttctcgggatgagcctcaacacggaaatgcatggtagggttctttgctttgatggcacgcatcagtgtaggcaagcgaacatacgcctcgtcccaatctccccaaatgaccttcatagcaacttgcttagcacgccatgctttgccatacgtaggccaatagtgccatatttgctcaactgcctcgacaatcgctgctggagataaagttggttcagctcgcacaaatgcctgtaacctgtttccaataaaccttgaagtaagttgcaaatgcttgccggttacttccgcactacagcatgtgtggtcttcgcccaccctagtcacccgccacctatctcctccactcttccttgcattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtcctttcatgctctgacatcttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagca

SEQ ID NO: 18574 - DNA, 11114 bp, Oryza sativa
attcgatctctccattcaagtctaacataaatttatgtgacatgacaccgccgcccacatagtatctcccttgcataccaaccgactcatcattccaatccaattcatgcttgatgcgagacattaactcctcaaaggtaggcttcgcaaaaaacactaattgtctaactgtcattccctcaaattggcttccatgtgtactttcatctaccacacaaccaccataatgaagccggaccaatctatccatctacaatttttaacccatgcataaacattaattacttgaaaataatatgtaattaccattgcaataccaatacttcaaaagctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacatttcatccccacccatattatccatctaataatccatccttagccaactattatcaaaccacgtctacaaccaaaacaatgcaaaatatccaataaaactttggggaacttagggtttatagaggggtttaccttcttttccgatcccaaactcaatgccgcacaaatcaccttcgattagagaggtttttgggggagattgggcgaggagaacgtggtggcgaccgaaccctatgcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctagttttggttgaagtttttggcaggggttagtttcaaattaagtttttgaaaagggtcaatttgtcaaaaaaacggtagttatactctcttttctagtaagcaacagtatatactgttttttaggccagtatatacactctttgtagtgatgagcagtaatatatatatactagtttttttttgtgtattagcagtacatggtaaggattaccttatatttttgttgtagcagtgtatacttatttttgttagcagtcgtatatacttacttcagaattaactagtatatatactgattatttctttttttaatggtacgtgcagtatatactgttagaacgactgaatgagtagtatatactgatttttcttggaatgagtatatcctgatttttttggaacgagtgagtatatactgaattttttttgggaatgattagagaaatccgattataaacattgtagtatatacttttccccacttagtagtagtagtataaactttactcgttttacttaattagagcagcacatactaattttcttttggttcagtatatactgatttattctccgaaagagtatgtactggtttctttcccaaagtatatatatgaatgtacatatgtactgctttctgcatactctagtagcaatgtagtatatatagtatgttcacatactcttataagtatatactgtttactgtttattggaacagtatgtactgttttgttaccagtatatgctacttattcctttgaacagtaactgttttcttgaattttctggccagtatatactacattagtattgacggagcatatactagtgttttcttaatttggtcagtatatgctgctatacttttgttcggtcactatatactgcatctcatcgctaaaggagataatactgctttcttgtttgctcagtatctgcatatactactctttttttcttcagtatatatatgatgcatatactgcttaaataagtatatacactatttcttagatttagtagtatgtaccactattacttagataaaccatatatagcttttcatgtgtgcagtattatatgctttttcacgagaaaaatttagaagtatgatacaaaattcatctacaaatacaaaaaacaagaggtatatatgagctcatgctcacatgattcaaaatcaactagtcgatcgaaaaataaagaaaaaagaaataagaggtagatatatatattgctaaaaaattcagaatctattcagttctctgggaggttggaacaaatgccttaggtgtcgcctctgatttttggcagatcgatattagctctgaacctgaaatcaaataaccataggacatggtgcagtacgcgtttctaccgggcgttgcggccgtgattcattgactagacaccatcgtcgatcgaggatccgtgtgagcagctgccatcgttggacggtttgcctccaggttacggccggaagcccggaaacctctgccatgattgatacggttcttgtacgcctggctcactgcaaaagggggaaaggatagcagagatttagaagcgatcatgaatcagaatatctggaatcagaatatatatctagcagtcaaacttcaaggattggtaccaacaatgaggaggacgatcggccgatgaaccaccacgccgtcgtcgccggattgccagtagccaccgcgcctcgcgtcgtggccgaatcgccgatggatcgtgccggcgttgcggccgaatcgccgatggatcgcgccatggccgcacgccgccgcgtctgtatcgcgagagatatgtgtcactttagtgagaaaaaaatcggcgatggttagttaaattatccctgaataattatggattaaatcttattcaaaatattaacgggccagtgcagctatacccgttagggggaggttcgatcgggtagatcgctggttgaatggatggacggtagatgggagcaggtgtacttactcccagattcattttctctcactctctctctctctctctatatatatatatatatatatatatatatatatatatatatatatatgttcatgtgtgtgtatgatgaaaactccaatattaactctaaatttaaagttaaaaatttaaattttggcttatccgtgttagtacaagccaaaaagataaggctagtaagcacaccataatctacacagagatctcgtccgtgtcgtcaacggtttgttacttgagctgtaataaataaatatattctacgggagacttttatgtgcttggaatatatgagatccgttgatcacttctatgtgcgtccgaatgactcacacaactgacatcaatgaaaattaatctttgagaaaaaaaagatcaaaacagtaattatttgtaggtttaaatgtttaatccctgtaaattggcgcacctatatactccgactgcagatctaatagaaaatcatatactccctccatatcatattataaaagtctttttgacttttgttcctagtcaaaattatttagatttgactaaatttataaaaaaatttagcaacatctacaataccaaattagttttattaaatataatattgaatatattttgatagtatgtttgtttcgtattgaaaatgttgctatatgtttctctaaattttaagttttaagttttaaccaaatttagagaaacatatagcaacattttcaacattttcgaacttaaaaaaagtttaactgaaagaaaaaattaaagtgacacatggtatgaaaccgagggagtacattctaattaagttcgaaagaggggaaaaaaaactcattgtcgacatattgaagaaaaaaaaagcagctgaaatatcgtttttgacaaatataaatgcagcagcagtagatgcaaatagcaaaagtatacggatgtactgaataagaagatgaattgagctgggaaaattgatgagtatagccactcgtaaaaatccttccttacatgcagatcgtgtaccccatcgatctaaatccctttatgaccacacacaaactgtcatagaaactaaccaaacaacgagatttgacaaccaccaaggcaccaagtgaccagacaatctgctccgagtgacgatcatcgttttctcagttcgagtgataatccagagtctgcggagaagagtaagatcaagcttcaataagcactccagcaagaaaattaagaaccagaacaaaagtttaacacaatgatctaccagtatgaagatctatttgaaatagaatggctatagagcttcaatcatattaaatcgaatgcatgtatattaagctattaaccaacaaaatggtggcataaaaagacaaggaactactttttcccatcctatctagtacttccatagtagctgttgcaatggactcataaacaaaatcaccatatttaacagaataatatggacttcttaccgcccgtacctatttgccatcgattctggacctcatgagggcctccagcaatgttaggcagtaatactccgaccacacatcaggacgagccttgcatttctggaatgcaaccactgaatctgccctaaattgagcagacttagcaagctctgaggcgatctccttctgcatcgcgttggctgctgcttcaatctccagctttacttcagcacgaaacttgatcatatcctgcttgaggttagtctccatcttcttcatcttgtaatgaagagcaaggtggagagtcaagcaagcaagtcctaggagcataacatactttttcctgttccaaaaaatccagtcacatgaactatctacgactaaagttcaaaaggaagaagggggaaagagttgcggacttacataggtgggatgtcctggaacttcgtcttccagcctttgaaagctgcatggagaaccaaagccatatcctgcatttaacagaacattaatgcgcataaacagacctttgtggaaaaataaagcatgtagagcttttcttttaccttgagaatccccatgtcctcgaaggagtttgtaaagaaggcccttcgatatccccttggcgcagacgtagagaaactacagattccagccccaatcgcctaccacggtagaaaataaaagcattttagatgcatgcgggatgcacggccctcagcttgaagaggcagagaaagaagagataattaccctagcattgctgagactagagcatatgtttccggcaaccttcttggtaatagtgtcttcgacctaaaaacacagcagttagaaagagttaacattaggagaagaggagacaaaaggacaagttgcggcacccccagctagttcaaaagcaataatgtgttaccatagtcatcagcagaagcttatgcggattaatacatatggtcttttccttcatgagagagtgatagtactgcaaaaaaaaaaaaaacataacagtgcaatgtcatgaatacagacaactattctttcaaacctcacaagacagtgaaaaaccagatttactggatgagttgaaatccctaaaaccaccaccaccaacacattgacgattttgggggatttcaacctaatctatgagagaggagccaaaaaggaagccaaatttcatttctggatcaaggtaaatggtttcaagcaagtaatacaggaagcatggaacaaggctgtacaaactgatcatccagtaaacaagatgctcaacagcactgcaaaggccctgagaatttgaagcacaacacaatttggccaactacaagcttcggttcatatagaggctagctaggccttgcacaacaaacaagattgctgagtcctgaagaaaaggtatatatacaggaaatatttaaaagccaggaccctagtactagtagcagtgcccagggcaatgaaaaagcaatcaacaagaatttcatggctcaaacaggggacgcaaacacatagattttccacacaagagctacagccaggcctaggaagaaccacataaagcacaatgggagacagtattagtatacacatggcaagacacagcaagacaagtcaaaaagctattgacgatcactttcaacagattttggggagaaggtttacagatcatgcacaataaacgatcactttcaatagattttggggagaaggtttacagatcatgcacaataaataagttgggacctgattcacatgagatgagcagactccaaacaacagacaacaaacatggatgaggttttcggcgatattgtgacaatgtgaccaaacaatcaaatgatttcatattaggttctcaccctcgtggatccaggaagaaggaagcggtggaacatggcaaagttcaaaggcggagaagggcagaacagctgcacaaacaagagaaactcgtaaagtgagagaaaccgagatggggaagacggatcgagacatgcaacgcgagatccggcgccacgcgtgcacctcggaacccctcctctttccggctgtcgcgatcaccttcacaaacacaagaggaggaacagaataagtgagaagagaccgagacgggggcggcggtcgtgatcagcttcacaaacacaagaggaggaacaaaataagtgagagagaccgagacggggagagataataaacctcggagcccgcagccatcttgagcacctttttcgccgccgccgccgccgccttcgccatggtgagctctcacgacggaatcgaggccttggacttgggagagagagacgaagtgtggacttgggcgagagagagagacgaaatggaggggtgtttggtgatgcggattaaaccccagttctacttgagtcacccgaacccaagtacccaacccaaccccatcgcggcgtctggattttttttacttttaggtcccttttgaaaacctattttataaataaaccttttaaaaaacttatcctaagaatgttacccttttcgcggcccaacgggaagggtcaattcttgaaataagtattttagggatctatttgaaaaataatttttcagaaaggtctaaaatgtaaaaaaatccggtctcctcgcctctctttccaacccactcactctccttcttcctcctctaaaccctaaaaccacacggttcctgctccctcacccatcggaagcggcggcggcggcggtggtgggcatgggcgccttggcggcggcgacgtcgtcggcgatctggctcgtcgaggacgacatcctcctcaagaacgccgtcgaggtagacgatccccccctcccctctctcgccccggtcccttacaattcggggcggctcgaagtctgttcgtctcgccgcgtcgcttaggttaggcttcgattggagagttcgggcttcgttcttaagttgtttatggcggaggtcgacggagccatttttctttctttaaattttttgtcatgatagtcaggtcgtcagggtttaacactttaaccctcggccttgcgaaattgctcagctgttagtccgtatctaatttgggtggttattccctgtgcggagtcctgaacaccgttgtactgaatcgctttgttggggaatcaaaatcttgaagcagcatagggatttgttttcatagcagttcagtggctctgctatcatctagccaagaatttaatgtggcgcgtgtgcaaccgggtcaggtttgcaggacacacaccaccgggtgcaatttctattgaccccacacagagaccagtcgcttgacattttgcttgggagaaatttgcatactcagtgtctgcaggtagatcctatgtggtggaggaaataataatgagtgttatattcctctgcaagagtttttgaccgttttatttgaatttattttcaataaataaagcaaattgtttaggtcttgtatgcacctaccatggtgtgattgatctatagtttttgtacaagactgccctgattaatctatttaatcccatgcgttggtacctgtaattatatgaacacattccatatagtgccatgccaaattctgtgattaactagctttgcaactcaagacaatgaatactgttttatcttacatggcaacttgaccttgtaatcatagtaagtgggcttatcatattaacattattatgcctatctatgaagtatgcgagatatttagtactccaatcctgagttagtcatgttgaatactagggatttgttcaggaaaatttgatctgaagttagttaatctccagtctgcagggtcaggcaaaccttatctgtgagacattcttcatataagttttaagtgtctagctgcatattcgttctgaattctgatgttgtgaatggttccccatctcttcctaactgattgttatgatacttgtagactggtgcctcattggaggccttggcaaaaggagccgtatgtttctcccgtaaattcactcttaaagaaatacaggatcgttggaattctctgctatatgacccagagatctcaacacaagcttctgctcgtatggttgagtatgagaatgatctttccacttccaatcctctgaaggctaaagttatcaacgcaaagcaaaaggatttgtcattccagaaacggaaaatagatagtgtgaagaatcaatattatgcgatgagaaagagagtccgcaatgaaccatgtagtactgtcgaccttggttttcttattgacccttgttcatgtacaatgaatggcgggcagtgtgtatgtggaggcctagataaacattcacaaggtcaccatgtggttcataatacagaaccaggggtaagtacaatgaactgctttgggcaacaggatggaagttacaatggtggacaaactatgtttgttggaatgaatggacattctttccctgcaaagcatgctgagactgatagcatggttaaaggtggagatattgctaatagtgtcccgtatggctattctgatgtaagtcaaatatatgagcaagatgcatacacgcgaaaggaccctgatactaatgaagggaacaatgtttctttaaagggtataacagattttcagggttccatgcagttccagaatctgggctctagcaatcaatgtggcagcaaagtaacagaatcaaagacaatagtgattgctgatcactgtggagttgaacatgtccatttccctgtgaacagcagttcaagaatgcaagaacctggctcactccaggtgattggccaaccagagggttctcaaacaccagttggttcaatctggactgaggttgacgaaagaggcacatttactcttgacgatgataagaaaataaagacagacaacagtgaccctctagcattgcaaccaaatttagatggtgggatttgtgcagctggtttagatcatgcagccataacagaaggtgatttcatggattttccctatttcagcaacagtgaagatttagatctcctgaatggtgaaaactttttgaatattccacatgagacaaatcaggaggatttagatgatcctgatcatgtgaaaaatctgttgcatcctgatgaggccaacatttgctatgatcagacagatcctgatcatgtgaagcataatgtagatgtttctgggataatctcggttcctacttcattggaagtgccttatcctggtcggtttgttgaatgtgtgttgaacacagaagatcctgaaattccttgcaatgacgatgttatttttcctggcgagtctcctctacaatgctctgctactgattttggccagaactctgagcacaatacctgtttggtttcccctgcaactagccctgcatcaaatgtcgaacattccaatgtgagtgacaaagccctaataaagagggaagatatgacaaatactgaaccttcttcacaaccaatgaatctcagcccacccacctcagaacaaaaagaaggttcaacagcacctagtaaaggctgtgtcccactaggagctgaaccatcagaaggtccttcaactgctggtacactcgtgcattgtcacgttgacactaatgatgcaaactcatgtgcgtcaaatttaccctctatcagtgctgctgtatttgctgaaggatcaccttgccatttagaacagcagaataactttgatgactcactgagttttcctttgcccaattcagttgaagtgcccgatcacatgaattacaactcacatgataatcaaccagaattagaagatggggctcctctacagaactgcattccaccacatgaattgccagatttgggtcttcaagaccccattacaactgttcctgtatcaaatcaagtagaagaatgctctgacaatgaaaatgatgttccaaactactatgatctagaagctttggtatgtcccttagcttagctacttaaaagaattgattgttcttctgatttatccctttttgttattcattgcagatacttgatcaagatttaatcccatgggttcaggactctgagcagcatccaggaggtaaatatctccttttatcaaatcagtgtgaaaatttttttggtataagactctaccaacacatgcaaatatttgatattaaagatgtgtgttttaagcttagcatgagtaacgtactaatattatgatagagttgtggaaggaagtactgtgctcaattgttagcgcccttatcacgataatactatgtgtgaaactgaaatattgaccactttattggaataatttacagtcgagtggtagtgcttagtgttagcctcgaaggagactgaccatgataagagtatggagtatgaaatgttgattggctgtgaggcttaaggggtatatattctattcagaatagctgaatgcccgtgctttgctatggataaaatatatttttcatgaagtgtgctacccattgtttgctataggaaatattcatcttattttaattttatatgttgctatccattttgatttgattgtttttaatgttaagaagctcaaggagtgatttgcaaaatttacaatgcgagtacttga

SEQ ID NO: 18575 - DNA, 538 bp, Oryza sativa
attcttaccaacagcctactcagtgtgagcgataaatcgcatcacttttagcaaaggctaatgaactaatctggttaaactatagaaaaaccaaccagcaccctagcattttgatgaaagacagaaagacacgggcaaaggatcagacgtaacaactaaaaaattacaaaatacatgtcacttccaggttttttcttcattgcttgaatggtgctccacttgcattgacttccggcggcgcgttgcagatcctagttcttccactgccttttggcttctgctcgctctcgccaatccagccgctgcggcctacaccaaaggcgttcgatgcccgtggtcaggaggaacgaggaggggaacacggctcgtgctcgccttagccaacccagccgtcgccgccgtcaccgacggcgctcgtggccagggcccaggagggaggccgcgacggcggtagcaggcgagagaagtggccgcatcagttgttgaacggaggggattatgggctaagccaatggcgccaaggagaggcaatcccgac

SEQ ID NO: 18576 - DNA, 115 bp, Oryza sativa
accgtgctgtctcaactcatggacaggttatcaagctatgctgccgcaagtcctgaagtaagcactcactaaaccacttcatcatggtaaaatttgcgtatactattgacaatca

SEQ ID NO: 18577 - DNA, 24669 bp, Oryza sativa
tgactatcaaataactaggcgagcatacatgtgttttctgcttctcatcggctccacaatccccggcgactacgtcgtacgcatgcacaggtgagagaaacggctgtctggccatgtcgttcactaaggcgggtgaagaaagcaccggaatcctggcggctgcggtgcgcatggcggcgatccgatctggcgaaggaagacgaagccagaaaaagatttcgcttttgctggagccgagtccgcgtacggcatccctgccgcctcgaagcgaagccggctgatcgttcgagcaggagccgactcgagcgagccgagatgggccttttcctggtgcggatggagccgtgcagacgcgccgtcagatcagtctctcgtccacgcgtcaccaatctggatcgggtatgcacggtgcggggtttgcagccggtctgcacatctaccaggtaccaccaataaaagcctaaagattgagaaattagtagctattttgcaagatcctcccatggcctgacagcttgttgtttgttttttgaaaaaacccttgttttttcttcgaaatataatgcaaaggatgaaaattccctttataaggatactattgtaaaagtaaagtacatgggtgtttctaaaatactctcttcgtcccatagaaaaccaatctataataggatgcgacgtttactagaacaatggatttgggcagagacatgtttagattcattgtacaagaaaacgtcgcatcctatcctattgatttttattgggacggagggaatatcttgcactcaccccatagccatcaatcccctcaccctgactcacaccgtggcggtgcctctcggttatgttaccttgatactttatgacattttctaagaaacatgaatatagaaaattaaataagtgcaaaaatagtgggtctaatgcattaccactcaagcatccatcaatcaaaatacatcgcatctaacaagatatggcacttgtagtcttgtaccaagaaaattacaaaggggaacaacttttagataagcctggattggaaggagagtagagcagaagaacaaaaaaagtactaggcagtaggtacaatagcagactataagccagctataaacacatttctaggagataaaataggagagagatgagcaacgggctacaaatttatagccagctgtagcacggactccaaaatacatgtgtgtataacaggtgagaccatatacatgtgtatataacaggtgagaccatatattaattatgtagtatatatatttataggtaactattatataaattagctattaagttgactataaataatttgaagccaacaattgactatactattaaacttgctcttagtcccatctctataacattagatgaaagtccaacggtcaatatcagtttctacagtgaaatgtgctaccgtacaccatacgacctgtcgtacataaggttactgtttctaccgcaaaataactatcgctaaagactcaagacactgttgtaacagtgcctttctgctgttacagcagaggacctggttgccgaggataccgtcccccgtgcggcgtgcgcgaccaagccgccatggccgagctctgacactcggcgcgtcgaggcgataggcgtacggtttgacaattcagggcctgagcttgcatagttgcattgcatcctctgctccgatggaagaagctacaaatgccggcccgagaatatccctacgattaattccgtcgcgctctccgcccgcacgcgcggcgtggcgcggcgcggcgcggcggcgtctcctacaaatggcgagcgcccgacggagaagagagctgaggcttatcgagtccgaggcttctgagcctgcttgttgccgccgctactggctgccgatctgctgcagttgggggggtctcccatggcggcggaggtcgggattggaagggcgacctgcgcggcgtgggcgcggcggcggggcgggggcggcccggcacgcctcctcgtcgtgtacggccgcgcctccacggcatcgtccccgccgcgcatcgacctccacgcgttcgacgccggcgcctccgccgtcgccgccgaccccctggtgagcgctccccgtccgtcctcccgcacgcgcgcgctccggcggcgttgtctgctcttcgcgtacgttcggtctgagcttgagtcgcggcgttgcgtttgtgctcgcgggttttcgcaggtgagcttcgtgatgggacacgaggaagacgacgccccgcgcgcgatcgccgtgcacccgagcggcgacgagttcgtctgcgccaccgcgaaagggtgcaggtgagttctgaatcgctcccgctaactcagacactcattctgatcagcttgatttgcactaacttttgtcagagtttatacttgctgttgctgataaaaagctcatgtttcatactcccaaatcacttgaaattcagatatacctgtcagcgttgttagatcatcagccaactactgttgtaggttattcaagctggtgactgaagaatccagtgttcaccttatttcaaaggatgctccaactctgcaatcaattggacctcagaaatgtctgtcattcagtacagatggtgcgaagtttgctgttggtggtgaggtaccgtgttatccaatctgtttattatgcacttcgctctttgtcagtagaatcataacttcagattctgcagtcacaagtttggcttcttaattcttatacaaggtttcctgataccattttttctggcaactacaggatgggcatcttagaatatttcattggccagatctgaatttgcttctgggtgaaccaaaagctcataaatctttcagagacatggacattaggtgagaaaaagcagaagcattgcctattcttttgacaaacataagcataaatcgacagaatcctccttgacattgtccataaactgaattagtcatatcaatatcattcaatatgttgcattgcacaagtaacaaggtagttttaaatataggctctgcctaagagttactttcttgggtgtaaggataattactgcccaacgtttttaacataactttatttcacaaaataaagtcattttggcagatttggatctttatattgttcctccttcttgcagcttagactccgagttgttagtctcaacatccactgatggttctgcaagaatatggaatatagatgagggagcgccgcttgtcaatttgagtagatcttcggtatcgtatgataaattactgcacttttctattttggtagttgaaactgagtcatttatttgactctcttgtttatatttgttcccccctttacaggatgagaagattgagtgctgctgcttttctagggatggaaataaaccttttctgttctgcacacttgtgataggtaatatattccataactctcaataggatgttaatatgtgcaccaccattcactttaatcaaatccttattgcttgaataggtcataacgttgtgactgtggttttggacataagtaattggaagaggatcgggtacaagaggcttttggaaaagcatatctccacactttcagtaagcttggatggaaagtatctcgcattgtaagttcattgtttctgcctcttactgtcacatgccatacactcatcctgactatagcaatactgttatgtagcatttgagagcctttttatggtgttatggactggtcataatagggtagtttccatttctcgcatttctcaccactcaatcactcatccatattgatgtatacttctttagctgacttctccttttgacaaatttatgcatgttcttagagagaatttacagaatacttgcacatcattatatttatgcatgttctgacaaagctgtggctgatgacatttgtttagtctcatatttctggaaaattacaaaaaaaatgtatatagtagtggggagggtaccagaagtgtgttcaattgactgaagaacttgttagctggccacctcataattaatcattatatgttattgttactctcttggggagttagatattgaaagaaacctagatacctgttttgttttgataaaaataaaaggaacatatacacttgctattctacttcaccttcaaatttgacacgtgtctgaaatcctaaatctgttgctgtatgtgcattagttcataatcttcttttcgtacatattttatatttttggatgtattttcaccctttgttattagaggaagccatgatagtgatttctgcgttgtggatgttaaaaagatggaagttttgcacttgagcaagaaggttcatcttggctctccaatttcatcaattgaattttgtcctacagaaaggtaattataaccattggtctttgttggaagaagtagtgagacaaaccgaaaatctctagcagtaaaatagttggcttcactaagcatccaagcacttagtaatggtctctggttgtaccaatgttgaaatttttagcagtaaattgtcttcactagtaatttgttcagtgctagaattcttgaagatactctgaagatccagcattaaggtattagattgcccacattgccttctcaacatgttaaaaaatggatcacacaacccgatggtaggtagataagcgagctatggtatcagcattatgcatggctaatttgcatatacatggaggcaggatggaccaagatttgtcctccaccagttcaccttgcccctgaaatttaaaaggaaattgtggattggttttactctgcatttctgcagtctgcactgcaattgcagatccatatgtgaatgaagatttgtcacatcaactctgttcataagcaaacatacggatgcttaatgttgttttctgaaattactgtacattttggatggcaatgctgcagatttttgaagtactgctggatagttacagtagcaattgtctgcttgtattgcagggttgtaatctccacttctcataaatggggagcagaggtaacgaaacttgatgttcctactgattggaaaggtacacgtttctgtcaatggattgagttttgtcctctgtaagtatttaccaatatgtttttttttcccctgcagtgtggcaaatgtggttagtactctcgtgtctgtttgtcacgtcggccatcctattctatgcgttcttcaaacacgtggtccatttggaaccctaaagaacagaatctggaggagaaaaatcataagtttctgacgatcagaaattcagaatccattgtaacaccagcatggctaacagcgatagctccattgtcatgatgagcgcttgctctatttgccactattcatttctgatgactatttgccattattcctttctaatgactgttcacctgttccaatttccaacccttaatccctgaaaatattgtcatcagagctttgtgcctgaatttatttcacaattttttatcgctcgataagtcaatacataacagaactgtctctttcatgacgatgaatgactgaatgtatctccgaccacaataaatcaaaggcgtttggtctttatcactgtgtccatttcgactgatactgacaacaactatgactcctgtactggatctgataagctgttaacgttccaaaatttgttgtcctctttatttccaagacccaacaaatttgtttatgtggactctagagcatgctttgcaatctgattctgggatatctgacgttgtcggcacatcatttacaggtcatctgacactgtgaggtgtgaacaattttctgcagtcccgcagccagggagagcccatgtttggtcacaacattgtcacacagggataagaatgaaacagagatctgcttttgactggtaaactctgcttctgtgattggttagactaaacctatcctgtactaacagtttcttctttcttcgtgtggacagtgccgacgagcatctgcacgcgtgcgtggactagcagtccagactcaggagacttgttgcagctgtgccgcatgcttccatttcctactgttcaacttgtgagctgtgagacttttggggcctgttccattgctctcaaggtatctttcatctcctgaatagcattcttgaatcgcatgcggctgaatgctgatgctgatgctccatgggattcacaaaatgcacaatagtggagttgacatgagatcctactgccattactgtagttaactgcattttctgctcatgagtgaatgacaggcatcacatccttttcccttttagggggtgtttagatatgtaaagttttggtgtcacatcgggtattatatagggtgtcgcatgggtgttcgagcactaataaaaaaactaattacagaatccgtcagtaaaccgcgagacgaatttattaagcctaattaatccgtcattagcaaatgtttactgtagcaccacattgtcaaatcatggagcaattaggcttaaatgattctcataaattagtcgcaatctgtacaattagttattttttagcctatatttaatatttcatgcaagtgttcaaacgttcgatgtgacaaggtgaaaaattttagggtggaatctaaacaaagcctaatgctactacttcatggattgtgtccacccttcatcaattactgtactccaagtaatccaagtacagaaacaggagctgcacagcacttccaaaatgtgtgacttgctaaaagcctaaattgccactgcaagctagagacagatgctagatgacaatctagaagagagataagtgcaagagcctgtcattttcagttgaggtgtctccgtgtctgatgtgagggcaagtacaaaggcagagaccggtatggtctctacgttaattagaggctatcatgttacaatagttaagccaatatggtctctaaccattaatgtattaaaatactttcttactagtcatctttcttttattagactcaatgcaacaaaaaattttctaataaatgctaagagtcgattctatgccattgtcatgcgtagcaaccatctttctctttccttctttctctctcttccacgtcacaaaatatgtttgtatgacaataaagagagaccgctaataaaaaccattgaacatgtcctgatctgttaggttttgcaattggtcaagtttatagcatatttatcagtcctagattttatagataatgacgatatcagagtggaaggtgaaaagggaaaacgcagtggaaaagttccatacttctggtagcactttccacatacaaaaaggagaggattcctctcttctttcgttccctcgtgctgctgctatgcctatatctcttctcatgtacccttcatattatcttccatttgcattaagttattatcttcaaatgattacttcacaactttctttgcaagcgtgaagatttgcatcaaactgatctcctacatctatattgcactgatttgatctaccactgacagaaaagttgtttttgtgcctttatggttgtgtacattcgttttgttcacttgtcagatagcactcagatattaaatgtgaagtaaagacgccaacaacttacatacacaattatacattggataatgtaagagttattagaagaccatagcatgtgttgcatgtgcttaagccgctatgattagcaaagtttggcaaggttttatttgctattgcaaaaaaaatgaaaaaggtagtagatttgtggggctgtgaaagctatatccaatatgcatgtaccagtacgactccacgttttcatgaaactgatatgcatctttttgtttttttttcttcgatggaaactgacatgcatcatgtcgatcgatttcaagaagggaaaaggaactaatctaaacagtttttaaacacgccgaattcgacgcttctggctttggtggcagtcgttttctccattatgatgaacatctaaatagctgtactttatgtgcacattttcaatcttatttcagttatagccattgcatatgattgctctcaagtgcaaatttgtagatacatatggaataatggatagttagagatattaattaaggagaagtccattcattcgccgtgggcgtgtcaatgtgtccttgtcatttccgatcatgcatgtttcgagatctgactttgcaagttgaggctggtcgtgatcacctaacgtcggggtgccaaggaaataaattacaggtaactgcctatacatcatgtgatagattttttaacctcctatcacgcagatttcttacactttagatgaacatctaacggatgacattaatatacacaaacaaaatacaaaacaccaaacaaacgggccatgtggataatctgaagctcacgtgggctcaaatgggctcaagtagatttcagacttacatcgtaaatatactaacattgagtttgaggagaaagagattgagaagatacgcaaaacaaggtaagccattagcgtatgattaattgagtgttaactattttaaatttaaaaaattgattaatatgatttttttaaagcaacttttctataaaaatttttttacaaaaaacacaccgtttagtagtttgggaaacgtgtgagcggaaaatgaaacaaactcactctctttctccagctgccgaacgcagccaaaattacatatgtaattatagtgtaattacgatgtaattagtacgtgtgggattataaacaaattagcattggaaaacacggctcaaatcaataatgatggagtcggcaagaatgctacacgaatcttgacactatccaacgtacataaatctgcaagatatgggactcaaaaatctgtcgccagacagatagcaattccgaaaaagatatacgactttctagtttattgcatagaaaaaaaatcaattatgctcattctaactgaaatgtcatgcatatctcccccatgatttttttgggcaaatcaatattgtgccacccttttgaagataattgttgtctaacaaaaaatatatgtattgctatatatattgataaagatctttgaagatcagcatgtgtattccagattcctatctagaagccatttttcaaacttgtaaacatagaagaatgacttgtactcgaaaaggttattcgtttatttctccaactatctgtatatacacacaaatacgtatcactttccagcactttagactttttttccctagcatatgagcccgatcgatcatgaaatatctgttggcattgtggcattgatgtgcaccgcatttagggatacacgtaattactatccgtcaacaatatagttaatgatggatcagtcgagcctatgcaacgaacagcttaactagctaaagctagcacagtaatcttttttttaaaagcagatcaagtaattgacccggctttttaaagaaagaccagaggtaaatatagcacaatgatctttcatagaagaatccggttccctagtgtgattgtaacttaagcaataagcactctagaataaaaaaaaccagaagggtaaggatgaaaacgatgatggaaagcgccatcattttggtactatagaattagtttcttaaattttaagtgaattacactttaggctagttattttttcctaagttacatggtggaccaattattgtcttatgttttcacttttgactgaattccttaccatttgttgcacattggatcatattggacattgttggtatctctttgccaccatggctagccggtgagggatcaccagtccacagcaaaggacttgagcgtgttcactgcctcatcaactcttagcctaagattcacgacaccacttctttctagtgctactactttctccgtcccataatataaggattttgtagtattacgatgcatgacaggactcaggagcttgccaatatgagggcatggatgatatagtcagcacaatgtgagaagaggatcgccaatccagagagacgagagaagctttgtgtgccatgtggggaagactagttttggatgaatcaggttaagtaaaaaggctattataggcactaacacgtggggttactagtctaaagtgcaaagtatttcttataaaataagtctactccattcatcctaaaataattggggcaattttatttctgcccctactttagtgtccaatattgattctaccatactttttagggttttcgtttttgtccctacttttttgaaccgaacaatatttttgcctctgttttgcatggagaagttaacggtgttaaattcttggcaaaaggacatttataccctctcatatctctattcattaattgtgtttttgcccccattttatgcatggctttggaaatttaaattcttggcaaaaggatatttaaatgacccacattgactaacataacaacttgcacagattctgaatttgatggaatttctacaaaatttcagcatcattttgacaaattgaacaaaactttgacaaaatttcaacgacatctcagcaaccttgccctctcggccttcacatccaagccacctgtaggtcgccgcctggccgacgcccaacgcctcctggccggcgcccgctgccgcctagccccctcctcgccgccgcctgtcactctccctgccgccacataccgcgcgcctcctgctcgccggcgggaggggctacggcattgcgcctggccgccgctcgctcggcgtagacgcccgctcgccaccacctacccctctcctgccaccgagccctctccccatcgcctagaactatccccgtcgccgcctatcgcgcagcctcctactcgccggtggaaggggttgcggcgttgcgcctggccgatgacccgctcgccgccgcctgcaccgctcggatggccggatgggtttcagccgttgttatattcgagaggagagaagaatatgtgggttagatattttccaggggtaaaaaggtaaatcacaaaatcaaaaactattttttcttttatttctctatttctttactgctataaacccggtcccacaaacttccatctaaaccaggggtaaacgcctctttcggttcaaaaaaaaagaagtgagggtaaaaacgaaaaccctagaaagtagggtagaatcaatattggacactaaagtgggggcagaaacgaaattgtcccaaaataattttatctatgatagaatatgatatattctagaacaacaaacaaattttatccaaattcgttgttctgaaataggtcgcattatattctagatttagctattttgggacggaaggagtagtctaaagtgaaaacatatgtcaatgtctagttcaatgtgcaacttgggtaattaatggcctcatcttttcgcttaagcttatacttatcagctaaagttttgaattttcaaccttaaatttggggttgattttagggttttttttaattgaagtttacttttcagcctttgcttttaaatcactaagaacatgtatataaaagttttattcgcaaattatttttcgtttgtaaatatgtcatttcgctgaataagcgaaacgatgggccgtaaatctagtctaaagtgcaatttattttaattttttagtggtgtattgcaatcttcaaatatagttaattccctactgaccgagaatctttttgataggtgctttcgtttcggtctgttttcagtcctacgaaataccaagatcctttctcgataccgtatcaaattactgtagcagggtgttttaggtggtactggtaggtggttggcctgacttgtatgtgcaagagttggctctgaatgctgtcgattgtgttactgtaaagactaactcaaattcataggacagaggtgagatgtggatgctcaaatgtgcaaagaagagcatgaataattctgatggaatctcacaagttttggaatctgcaatacgggtttaatctactcatgttttgaaaaaaaaaatgtgcacaacttcatgggtgctaataccaagcagggtttggcgtcgtttgaatcaaagaaatgcaaacatttcgctgtctccaactcgatctgtatgcgctgtccttagcacgcacgttgttgttcttccaatgtgcccggtcactaaaaaacacagagaatattgtagagtgtactgtgtagctgtgaagatccagtatgatcccgtgacatacatagtgcaattgtttaaaattattctgatgatactaactgataaacttgacctagtaggatacagagagatcatgcatagacttggttaatgatgctagtgagtagtgacatgataattaagccgagacatgtacacatgtatgctagtgtgatcgaagtgtgcactcaaggctaagtagaatactggaatcaactaacctattgctacctcctccgtaggatcgatgcaaacatgatattatatatgcaagttgccttagaagtcaatatgttagggcgccttcggataataatcatctgtgattgcagcttgattgataattagtagggtggcatcagagccatttgatgtaggcaatggacggcccagatcaagctagccagcaaaggagtcagtccagtcaaatagtcaatccaagctgaggtgtaggctagcaagcatggttgaatgcgacgagctaggtcaatcaccgttgcttcaaacaatcacagggcacccggaatccgttgactcgctcacagtggcagtcaacacaggagagagaacgattcagtgtttgctagtgccttggcaacgcagatgattcggacacaaatttaatctgagatataaatccgaattgtgattttgtgcacttgtgcttctaatgtatatttttttttcatatagaagttatcatattatcatataaaagttctcaagtaaaagttttgttaaaaacgagaatattaggtaataacctaatatcaaataattagaaggggtgagacttcgaatccatatcgtatagcccaccatcttgtaaagctagccgaaaaacccttggatgtttcttggtgaaagcttaatgtacataaacaacaatccatacttcggtcggtatagaattgaagtggcatttggaaaacacccatccatttgtgatcttcattagaagaaaagacagtattaaaaaagtccaactcaataatatattcccttcgtttcaaaatgtttgacaccgttgactttttagcacatgtttgaccgttcgtcttattcaaaaaaatttatgaaatatgtaaaactatacgtgtacatgaaagtatatttaacaatgaatcaaatgatatgaaaagaataaataattacttaaattttttgaataagacgaatggttaaacacgtactaaaaagttaacggtgtcaaacattttgaaacggagggaatatatttttatcactgcaacatgtatagtaacaacaaataaattggcacaaaggatactagtgtgaacgtagtagacaagtttttctaacaaaagttatttttgtttatttcaccaagccgccaacatgtatagccgttgtattgtacatgtgaaaatcttcactaagcaagcagtctaagatgcgatgaccaaagatgatcatttctatacaccttgtctacttgttacgccgtccttaacaacaccaaattgtcgcaaatcacggtagattttatttaaaatcattgtcttctactatttgttacgaaagtgcatggttggctccctccccggctactcggcctccaaggttgtaaattagaacatggaaagagacggccatggcagtttcataacgagaagagatacccttgtactttcttattgcttaattaattcacacccttcaccttaattaatcatgccacatggtcttaactataagactatccatatgatcacagtgcgcatctgtggtttattattatctctcccaaggtgtctcagttggaccttcctaatcacatgtatctttgtttattaagtacgtaccaatcacaactatctcaattaatgcttgcatagcactatcagaaagaagctattaattgtgtggcatcaaaacctgaaaatagttgacaactaaccaacatggcaacatgtaagtactgaagctgccgtctaattaattaatttccctcgagtgattgagcatcatcaactcatctatgtcatggtgctacatcacgttgactagctagctatccaagagattggcacttttaccacttatcaaactatcagaatctctttcttctatatctgatactccccccgtgccataatataaaaaattttaaggggatgtgcacatcctattattatgaatttgaactggggttcatcacatcttttcaaaatctcttatattatagaacgaaataagtactatcttgttctgatttttttttctatgacatattctgatttttattttgttctatccatggtaaaatatgggcattctgctattttttttaaagtatctcaccagctgtgagactgtttcacactgtcactgacaaaccggtcccaccgtctagaagagcagaagctccagcggcaaactgccagaactgtagagatcaacaacagcacgccatatatggtcagcagagatcgctttccatcgccattgtggatggtcgtcggtacactcccaagtcaaagtcgcaacaacaattaaagaattaatcacaccatcatctcgactgaaaaaaaaaagatggacactaatattctgcaacatacgcggcctctatgatgccgcatggagccaaccgtttactatacaaacaagcagtcccctttcatgaaaactatagcgattgcgatttgcagagagaccattttctcatctattttcaaacactcttgctttcaaaatttcgttttggaacttttgataccgtccaactcccattaggcgttgcgtttgtatctcatcatccttatctgagaaaaagtagtcaccgtgtcagagtgaaaaaaaaaagactaaataagccaaaaaaaaaactttcattttttttaacggatcttcacctcacgctaatacggttggttgctactgcatcaccatctacagatgtaaaccatcttcatagtgcatccaaaatatcgaatatagttgaaaggttatccatgtcagagtaaaaccaaacttgaggcaaacgagtcaaaaaagaatttaaaatttcgcgcacgtttggatctccacatagcgctagcaccgtttggatgcatatccagaatttccggaatgcatatccaacatagtgggaggtggctggagccacatttaagcagctcaagacaatatttccccctttttttcccgttgaaaaaagaaaaaaaaaacactttcccccctctttttttcccctcctccgtgttgccaacttgccatccacccgttgctcgccgcagccgcccgcgcgctctataaaaacgcgcgcgcgcgccgcgctctcgccaccggacaagccaagcgcgcggcgcgtccacacacatttgcatagccacagccaagaagcgacgcgatggtgacggcggagtcgggcgtcgccggcggcggccgtggcgcggcggcgctgctgcgggaggtggcgacggcgcggttcgcgcggcaggtggtgctggggcggtggttcatggtgttcgcgtgcctgctgatcctgtcggcgtcgggggcgacgtacatcttcgggatctactccaaggtgctcaagtcgtcgctgggctacgaccagcggacgctgaacacgctctccttcttcaaggacctcggcgccaacgtcggcgtcatctccggcctcatcaacgaggtgacgccgccgtgggtggtgctcgccatgggcgccgccatgaacctcgcgggctacctcatgatctacctcgccatcgacggccgcacggcgcggccccccgtgtggctcatgtgcatctacatctgcgtcggcgccaactcgcagtcgttcgccaacaccggcgcgctcgtcacctgcgtcaagaacttcccggagagccggggcatcgtgctcggcttgctcaaggggttcgtcggcctcagcggcgccatcttcacgcagctctacgtcgccatctatggcgacgacgccaagtcgctggtgctgctcatcgcgtggctccccgccgccatctccatcctgttcgtccacaccgtccgcatcatgccgtacctccccagccgccgccgccgcgccgacggcgagctcgaggcctccgccgccaccagcaacgacgccttcttctgcttcctctacatctccatcgcgctcgccacctacctgctcaccatgatcgtggtgcagaaccagaccaacttctcgcacaccgcctacgtcgtgtcggccaccgcgctcctcctcgtcctcttcctcccgctcgtcgtcgtcatcaagcaggagtaccagatcaagaaggagctcgacgactccctccgtgagccccccacggtgaccatcgaaaagccagccgccgccgccatgcaaatgtcagcgatcaccaccaagcccaaaaccgagacaccgtcgtcgtcgtctccggcgccggcgccgccgtcttgctgcctcggttcttgcctgaagcacatgttcaacccgccagcgcagggggaggactacaccatcctgcaggcgctggtgagcgtggacatgctggtgctgttcctcgccaccatttgcggcgtcggcggcacgctgacggcgatcgacaacatggggcagatcgggcagtcgctggggtacccggcgaagagcatcaagacgttcatctcgctcatcagcatctggaactacgcgggccgcgtcacctcgggcttcgcgtcggagatgttcctcgcccgctacaggttcccgcgaccgctgatgctcacggcggtgctcctcctcgcctgcgtcggccacctcctcatcgcgttcggcgtcgcgcagtctctctacgccgcctccgtcatcatcggcttctgcttcggggcgcagtggccgctcctcttcgccatcatctccgaggtgttcggcctcaagtactactccacgctctacaacttcggctccgtggcgagccccgtcggcgcctacgtcctcaacgtccgcgtcgccggctacctctacgacgtcgaggcggccaggcagcacggcggctcgctcgccggcggcgacaagacctgcctcggcgtgcagtgcttcaggaaggccttcctcatcatcaccgccgccaccgtcgccggcgcgctcatctccctcgtgctcgtctggaggacaaggaacttctacaagggggacatctacgccaagttccgcgagaacaccgccaccgacgaagctaccaccaacggtaactccgccgatacagcggcggaaaaaaggtcaaccttagtcaatgacgaggacagtaaaaaggggtagtaatgtagtttactgatataaagattactacaccaaaagacaagagcttgttacttcttattagcagaaaagtcaaaaaatggtaggcttgctgctaatataagtttccagatatctgtaaaaaattttggggctaaaaagaaagaatctactactagtggagtaaacaagattaggcagcagctctgtgcttgtacccattacaagcaacagtaagctgcaagctagagtaaaatactgtcactgtaagaagttgggtgattaaggccctgtttagatgggactaaaagttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaaatttgtctcatgaattagcttttatttatgtaattagttttgtaagtagtctatatttaatactctaaattagtgtctaaagacagggactaaagttaagtcactggatctaaacaccacctaactgatgaaacattggcttctgcctctgctcaagatgggcttaattatgctgtaattaattaccttggcaaaggccggtttgaccattaaaatggatgagacggatgaagcgatggatgaatgccggccacagcctgggctagtgacggtgatgtctaaacatgaggtggagctttttttggctgctgctgaatcactccatcatatgcaaacgtttgtttctttgcatcatgcataagctttgaattttgatgagaaccaggagagatgctcacggcatattagcatcacttgttgtttctttgcgtttcaattcttggcttgatccccatatctacggcgcatatgacgtgcagttcttaccatctgaaaactgaaagctatgttaacttaaccccattggatcccgagaaaattgcaatttgggactgcaaacatagggacactccgagtggatgataattgggcccatctgtgtttatgaaatgtgggtccagtgtcattatagcaaaagttaatgtttgcagtgttataattgcaaatcccccgaatcggatccagaggggaaatattgcagttcagaagagtacagaatgacaacattgactgattgacactagaaatacatagatttggtcatttaggagttcacaagagtacagaaaacggtcatatatatgcttcaaattttataaacctcctggctcctgattctcataccatatgctaaacttcatataatgctgtctctcgtccaaatttgattttgcaaactatagggtagatgattgcagaaaaccactccatcaaggttcagttacttcaaatttactagccctattagctaaagaaaacctgaaacaaaaacatactactccaatttaagcatgttggagaagcccaagaataagcctattttgcctccgtctcctcttgtccctggacgaatcacatcactcaagccctcaaccacaacttcaataacaggtgaatttgacttcttcagtggttttggaagcggtttctgttgacgtggtaagttaacttggttaaaatgtgctgacgtggtagactggtcatcaaagtaattaaaaatagaagtgggtcccacatgtaagtgataaggataaaaataaaaataaggtgtgagccacttgtcaaccccacttctctctctcggcgaaatgcagcacccaaaattacggcccatatagatgggtcggtttgtgtcttcccaaataagcccacatacaggccctgtatacctggatgggcctacattgaagcccatctaaacgaggcatcgggccggaatcttaccggttttgggcccttatgaatattggcgtgtcgcgacgccccacgactcatcggcggcttccctcccatcgccgacatgcctaggaaggagcgcgacagcgagagcagccgccgccggcggcggcggcggcagcgcagccggtcgccgtccgactcggaggaagcctccgactccagcggctcgccgcggcggagccggagccggaaccgccgcaagagccgccggagggacaccccttcgtccagcgacgcgagcgattcccaggcgtcggactccgggtcggactccggcggccgggtccggaggaggagcggaagccggaagaagggggaggtcaccgaagagcagatcgtggagtacatggctaagaaggcgcagaagaaggtattggggcggtggaggttcgggttttccgtttggttggctccattgttgcggctagggttttgatttctaactaacttgttgatggtggtggtggctgtgcaggcagagaaggtagcgaagaagatgaaggcgaatgctgtgtcggggtactccaatgactcgaacccctttggcgatcccaccctgcccgagaagtacgcgaattcgtccccctcttctggcacattaatcggtccattagtggtgttgcttagctaagtagaaatttgggctgaattttgtttgaactgtgtcacggatgacataacagaggcccaaaagttacacttcccttgtttgtttgatgccctaaaattgtgtgcagattgatgattactgtcatttatttacattagtaaggcttgagcttacttattgatcacttcattttgacacctacagccaccaaggatacatatatcttgtatagaaaaaaaaaagaaaatgctcttggttacttgtgtggcccaataaaaaaaaactctaaatgtggtttgtctaagccaactggtaattgtatttggggaagacgtcaagttggttcgttagatataggtagtatttatcagttgcaacattaacacagctaacaacttacaagtaaaatcgaggctataatgtttgtctaactaggtagtgtactggacaaatgtatgaaggattgaattgatagcttagtgaactactgattgagatcatctgactacggtagatgtcttctgacttgtttattcatttgttgcactctctagaatgagttatgaacatttatgagaaatctttctctcaactgtgagaaatctcgtagagcattattttgcatactgttatcagtagacagttttgcagtcaagatttctaatgtttaacaatgttatcatgtgatatgaccatatggaaatgttgttggctgcacttcagatcctaattttatccctacttgttgcgtttgcactgattgcttactttgactgttcaaaagtaatactctcaaccttgtattggtgcagatttgtttggcgaaagaagattgagcgtgatgtatctcaagggcaaaaggtggacatttctgttaaaggtgaaaagaagaaacagagagaaagaatggtacttcttttttccttttattatcctgaacttcaaatcttatgataggagtaccactggcatgctttctgaacttggagatgactcttcattgaaattaacaaaaataaaggactcaaaggacatttactcaatactacttgctttcattttaggataataaaacaatattatctcgtgttaccttgccagattataattatattgttatcatcttatgcaagtgtccaaatacataataacacgttggggtgagaatacctatagtttcacccaaaacaatagtgagaaacaacagattatgtactaaacatttgcatcagtgcccaatgccttgccccaaagaactacagcctaaaatgtggatgcatgtaaatttacacatgagtagagattatatggatctgtttcttgcaagaatgccattggctggttctttgcagaagcagttttatatttgatgttatctttcaagatagagtaatatgtcactagcctgcaactttactattttattcttaatataggctgaaatagagaaggttaagaaaagaagggaggaaagagcgatcgaaaaggcacagcatgaggaggaaatggtctgtatatatctctctggttaccattaatcttctctttgtttcaagtaacacttttttgtggaactaaatgtctataattgtatttcttaggcattgttagccagagaaagagcacgcgctgagtttcaggattgggagaagaaagaggaagaggttcatattttacaacatggcaaatatcatttggtctcatgctgaattaagccggacttcttttatgtaacaatttttgtcttctattgcagtttcattttgatcaaagcaaagttagatctgagatcaggttacgcgaggggcgcacaaaacctattgatgttctcctgaagaatctcaatttctcagaagaatttgatgttgagttaaacgagccctacttggtattcaaggtaaattgaacttctcttacccacttgattatagttaaccaaagagccgctatatggatgcacctatcgagaagttactttgtatgtatctggttctcacatatgatgttcactcaatcattagctgatgttggtgccaggctttctttcatactatcaaacaaatgcaataaatttcagatatacatcattaacattctggattctcttctgaaagaatggctccctataaccaactgtttatccttctataatctccagcttcatccgccttaagcgttacccttttagaacgtgcaggaatactgtgtccttgtattcaaagtaaaaggttcaatgtttcaatatatcctaagataccttacatcttagaaatagccttaaacattctaacgattcatcattaactacattctaattagagaggtggaaacatgtatctctcaatgggtttgaaatttaatcactccatctgttcttactttacaactagcccagatctgaaagagttcccttttccttttaacacttaaacatatgtgatgtgctaaatgcagggattaacggtgaaggaaatggaagagctgcgcgatgacattaagatgcatcttgatctggacagggaaagccaaataaatgtcaaatactgggaggtgtgtctttgtctcaacattcattataatattaccctttacttgaataatcatatgaattcatatgactgatgtgtatgttgcataatgtatattcctgttgattgaggttagtaccaaatggcatatagtccaaaacagtaatgctaaatttttgagattttgataattatgttttgttggatcgatctttggcaaaaatattgcgccgtagtatgtcagaacatattttttagcttgttgtatatatgggttgcctataggccgtaggttttcacaaaaaaaaaactaaatcaagttattcctaatatgacagtaggaactaataatttctgtgatttcatgttgctctcttgatctaattagcaaggatgctcaaggctgttgaccaattgtccactctttatttcaaattcatcaggcactcatggtggtatgtgactgggagctaggtgaggctcggaaaagagatgccttggatcgggctagggtgcgtggtgaggaaccacctcctgatgttcttgcggaagagaggggcttacatgcaagtattgagggtgatgtaaaggatcttttggagggtaagacttccacagaactagaagagatgcaaagtcaaattgagtcccaaatgcgctctggaacagcaaaagttggtgaatactgggaggccattctgaaacgccttcatatttacaaagcaaaggtatgccatgcttgcagacactaaaagacacttttctttttttcttgtagcaaatgtgattccatccatatcacactatcttggttgtttcatttgcattacacaaataaaatgtgttctggtatcttgatttgaccttagttcttgcatcataatcagatcctggtttggattcttatatgaacttgtgaaactgctttgcctaactttctgaatttgcagtttatatggttgcccggtttaaatagtgtataataggtgaaagcttacctttttctgcattgcaggcttgcctgagggaaatccatgcttcgatcttacggaagcatctacatcgtctggagcatcctgattccattgagcaggataaggaatctgaggatgaaatcgatgctaaagagaaggatgcaacacatattgacgatgatgatgatgatgatgatgaaggtttagttttatttctgtatttccagtcactcaaatactcccttccatgctgtaactctagcgactatgagttcttatacctactttatgtgtagatgataagcgatattcgcctgaacctatagcggagcaaacagagagtcatttggatgaagaagacggatccttttctcctgagctaatgcatggcaatgaagatgaagatgcaattgatcctgaggaggacaaggcagaactggtagtgtcctcactcctgctacacttagcttttaatactgcctccgtttcaggttataagactttctagtattgtccacattcatatagatgttaatgaatctgggcacacatatatgtctagattcatcaatatatatatataaatgtgggcaatgctagaaagtcttataatatgaaacggaggaagtaaatgctaagaaaatagtggtagtttttatgtagtgaagtgaactgcaattgttttacaaattggcagacttactatttattagacactatattgtgcaaaaagatgaacaagccagtacaattgtttaggtatcatatagatcttttcttaaggcaccaactggattcccattgacccattcatgtttaccctgagaaaggccttttagtttcatcgtgtaccatagtacacttacggtcatttgtcagtgtaaggtgttattattggcttatatattggagtttacatacatgaaatttttatctcaattcaggattacatcattaggtacattcgtgagttgattgcagattttaaatgttggcaattcatagaatattcctatgcactttgaattaatgtccaggatcgaaaacgtgaagctgtagttatggagcatcaaaagaaagttcagcaggccatcgcagtgaagacaagagtacccgatgagatggagatgaaagcaatgaaagcaatgggagctatggaggaaggagatgctgtgttt

SEQ ID NO: 18578 - DNA, 26753 bp, Oryza sativa
cttgttatttcctcatttaattccaagatcatttgaactggattgtgcacataatattagcccaaagcaatattgtgggggctggcttgcttttacatgctagaagatttatttaacaactaaagtgcattgatctgcttccagtgaacttgaatgcaagctgactttgtttctgatgaaaatatgcctgtttaatgtgctcacaggtatattggtggcacgacaagtatcgaccaagaaaaccgaagtacttcaatcgggtgcatactggatatgagtggaacaaatacaaccagactcactatgaccacgacaaccccccaccgaaaatcgtccagggctacaagttcaatatattttaccctgacctggtggataaatcaaaggcgccaacatacacgatagagaaagacgggagcaccggtgagacatgcctcataagattccatgcgggccctccatatgaggatatagtaagcctctattcccatatcttcaaatttaatcctgtagagtttcatgggcacttcacttaattactctgttttcttcaccaggctttccgtattgtcaacaaggagtgggaatactcacataagaagggcttcaagtgcacattcgaacgtgggattctccacctctatttcaacttcaagcgctaccgctacaggcgataaaatgccacgcaaggaagacgttttgatctccattgtgctgttagaagttggtcttgcttttcttacctgagagccctatgcaaataggtttgctcggataccaactctggagtcgactacacatgctcatccgagatcatatgtactaagtgagaacagggtagcatactagcatcccgtacttatgctgattaggctctttgttagcggtttgaaaatagcaacgaagtctcctgtgtacattgtaacttccttttttctgctttggaaattgagttcagatgtcaaaaatcaacacatctttttggtggcaatcaaactaatagtgcgtatatcattaaacttcttgtttctggaactagcgaaagtgtggagtacttagcacaacatcagaaggcatgaccaattgacttatagctaaaaatgtaatagctgttttttttttgttttttttgttttgctcctacacaactttgtgctattaacaggatcagagatgcaaagtggcagttggtccgaggctcctagctccgaaccactatcagtttgcagctattggcctctacatccatcttctacacaagattataaggacaagagatgattttaaaaatggaaggcaagtattcactcaaagtttagatgccattggatggtagaatctaaactgcttctaaataagttaccgcatacaaaaaataaattaacagagtcccctttttcacaagtgaggtttgctcacttagttcccttcgcactggcaaactacgacagtgtgtaaatttcagaagggatattaaaacaattaccaatgcagcaaaggtaaatagtgcaatgggcaaaattgaattgattctgaggacaggatatctccaaaaccactagccactttggacttggtggctaatggtcgggtttctccgtccaatttccagaacaaaacaggtcaactcctatgaagtcagagactcaggagttgcttttaaaaaacaaggaagaaagaaaaaaaatattttgagttgagaaaatggcaaggcaaatatgatatactagtagagcacaggagcaaataacaaaagccacagggaaatttaaaagacttgcattgtctcaagcagagttaaggccttaaagaccacaaaagctcagtcacaatccggctactcggaaacagcaaatggaactacaagcaaccagctccaaaccaaggacacaaacaagtctaccaaccaaaaaactaccagaatattgggctctccttgccaacaatctcctcagcagtagaacatgacgtccttgacgttctccttgatcttgggaagctggcgcacctccacagggccctctcgcgccacagcctgcccgctgctgccaggggtcgagccaccatccgaactctctccttccacgtagtagcgagcgcggaatgcagcaagatgagcatagtaggccggtgggactgcacaggaaagaaaaagagcaatacatcagtgaacaaatgcaacagatttgaaaaggagcaccacgtagaaaagaatctctgtagttcaattgctagtgcctagaaagtagcatgagagcatcgcatgcgaaatgataggattcagcagatttgaaaaccacatgtttaggaacagttaacatgatgacattgatggtgcttgacaagcaaataacactaggttcgattcacttcaaaaagcaagatcacatgatgtgcattacatacagtagacagacacaatttcaatcttaatgaaatttggtcggctccttcgccgacctggcaaaaacacaatttcaaaacatgctaaattgcacagataggaaaatgagtactacatcagtgaatagaaaggaaaatgtttcggtagttcaattgctagttccagaaagtaacatgggagcatcacatacaaaatgataagatacaaatggaacacattcgaaaagaaaatgctgaggacaattttgaaaagcagatgttgtggaacagttaacaaagatgacattggtggtgcataacaagcaatgacagctgtgcagttcccttaccacatgatgaattgggtgcattacagtaaacaaaggtccaatttttaacacaagctaaataaggatttctactgttgagaacaacagcctactcctagcgcttatcttttccagttcacagttaaaccaatgccaaaaattttggtgtacacatttgcttgctcatcgaaggaggtaaacaaagctaagcaaactaatgcagaaatgagaaacaaagatgcaagaaaagaagactcacccacagacactgcccgggtgcatcgcgcatagctgcattttgccaacagtaggaattatcagagttggggcagccgaaataataagggagctaagcaactaagcagaaacagagaaatgaacttacgtatagcaaagattgttggtcagggactgaagtgcatcggctgtaaaatggttctcatcgtaaaggacatggtaatgagttggcctgctagtaccctgagaaaaggaatgtcaagagcacacattaactgaaaattttgttggctggaaaattttgtgcaatctgcaaacagcttccagcatgggttttacctgtatgccagcatggctacacaggtagaaatcgaactctgtaggatggcaaatctgacggtccacgacagttcctgcaggaccaaaaagaaacggaatacacgatatatccaatcatcaaatgcctgaagaagtagcagatgtatgttctcagtagcaaccaacaagaaactgaccagaaaggatgtttccgctcttgtcagtcatgtctcccctcccatgaacctctggaaaaagccttgtgtgatgccttttctgaactactacaaatgtgacaggtggtagatatccctcctccaaagatgcacaagccttgcaatgtaaaaggattaaattcagaaaaaacaatgaaattggcttgtccagaatagataacacagacagatgtatcatgatgcgaagctcacctttctgatggcatccatttcatgaagaagcacatggctgaactgaccttcacttacaccatctctgcagaggagaatgaccactcaacaaatttcatttaactggacacaccactgaacagaacagaatttccaggacatacctatagaagattatcctctcaggccttctgccagtcttcttgcggaatgcgataagcaactccctgtaaacaagagcatggtcagttcccagttgaacctacaataatatacaattgcaataccacattgaccacaaatttacctgatcatcccaccatttacaaccttcactggatctttaccaacactaaagagatcttctattatctcctgtctatgtggttgagcagagaccagacctcggtatttggtgatttcaggccaatccatagatgccacaacctacatgaacacaaagaaaatataccagtaaagtttgtatatgcaaagcaataaactttgggaagaaaaatatagttcatctattgcatcaagttattcacaggatagcccatgatcttgtattgtaggacaacatcaaacagaccaagtaatgaattgaagaaccattagctaggagggtactaaccgcagcaatagatgatgcagagtcctctccaggtggagggtgtgtgacatcagcgccaaagatgattgttgggacttctgacacaaatggtatgccattgcggataaaggctcgctcaagaacagtgttgcgccctccgacctggttatggcacagaattgtcatacttctgggggagaatactaaaagcacacaagatatagtccacagaattggtatagttctagggaaaaaaatacaagcccagcagaattacagaccttgacattgattttgagtgcaacattttccaaatattgcttgttcggcctgctggcatgccttggcaaacaacattgagatacaatgccaaggtcagtctcacagacccttttaattttccctgtaaaaaccatgcatatacgacatttaataaataaatcagggaatggaaaagttacccaaccaacaatatacataccataagaaccactaacttcaggcagaattacaattaaaagctgcaggcctccctttccctctctggctagcagttctgatgttctcctgtgaacatccctcagagcattctctatattgttaggatttgttgaccggacatccacgactggtcttggattgaaagactacagggtcaagtcaaagttaattgcagcacatataattattaaactgctttaatagcattgtaactatgccagagttaccattccagtggcattgcacatctgaatcaggtcaccacagaacctttgtacctcctcaggacgcattcgtgaaaaactcagacatgtccagttatccacagttcctccattgatcattttctgaaaaaattaacaagtattagtgtcttcctttaaacacatcagcaagtaaattatgttggctcagtagtttgtatctttacaggttctgcaattatgtttcagtacaaggttgtcaatttcagatactctccaacaaaaaataatgctaatggtcaattcataaagaagttaagcaagtgtacctagaattcactttcaaacaaaggcaatacaaaattaacctgagagagaaattgagttgtaataataaagcaaggcatcaccttgttaatcatgttccactgtccaacactgggtgcacaagttttctcccttccagaatcatgatacttcaactgaaaagcgcaaagattaaggttgttagaaattcccagcagtttaaacaatgcgaacaaaagaaatggaataaagcatagtaccatgggtggaggcagcacacgggctggaacagagactaggtcattgcagaccttgataccgaactcctgagcaaacctatcctctgtatacttgttgtggagaaccatctgatagaagatgaaatggaagtcaatacaaatacatgatattgtcttcattatctcatcaagaaaaaaatatagccttatgttctacggaaatgttattctaataaaatgtgcagaaataaaaggccattaaatgtgagcaaaaatccaaaagcataaaaagtttggctctgcatctacatggtattgtacctcatgaatgctctgttccctctgctggggcgttgacaggttgctctaagaatgttggtcacttgtttgtcattaagcttcttggagtacctctgcccttctacaatcttgcacacctgcaaacacatttgcatgaacaaactgcacacagcatgcacaattcaggtagaggtaaatggatgatgaatcaatacctccataggtaagtatacagggcgagaatcactgccagactgtaggcagggccaaaaagcgtacttcagtctgtaattgtacctatcccagaagtactgaacaacagtcttccttgtcccattatcatcaacaggaaatctaacaacatcaaaccaggcatcagtttggtgaaaaacaagttatgttcatgctataaaacagtgaacaagcatgataacaaaatgcaggtcctaaaaaagatgacaaagcactattctcaggacagtaaaattatgtgcacttcaacctttacacatcaattttgttgaacattgaaggacatttcacagcattgacagtatggatatcaaaggaacatacattgatatctaaggaataaacctttgaaaaggattaaaatgtttctatcacatgtccacaaacaattaatgtacttaccatgcccaagatccataaacaaagacatttcaaatattccatcaacaatctatattgattttctgtatcttaaagaatgtaaacaaaaagagagttatagcagaagcagaggaaagataagtacatcagctggctcataggaatgggggtaatccctgttatcttgtatcttctgatttggtcctcttggtggtttgtttcaatgcgaaccccacgtaatgctttctttatctaaacatcatgaaaaatgagttaggatcagtattgcatgattttatgaattccatcagtaggaatattaccttcacacgatcccggtctgacaaaggtcttgaggtgtcacgtatgttcaggaactcctccacaaattggatcactgtcacaggcttaaaaaaggacgttgcagatatatctgaatgaagcataccgaacagtagttagtatctgaaaagatcacttccattcagagaaaactgataaacagtaactgacagggaagtacctatattcagcgaaaggcccatctgtgttgggcgcaggctctgatagtaacctctccaacactcaagtccctcaccaatgtcaccccggtgaccaaactgggtagagaagaaggatctggacactgtgacataactgcagaaaaagtagttatcaatgcattatttgtaccctagtcagtaaataatcaagcaaaagtcaaaacaaagacaagaaagaatcatacttccaagatggtgactccctaaggacaacatcaagaacttgaatggtttcttggggcatatccctctgtcttccaagcaaaaactgctggaggtggtacaagtctgttctgccagcaatccgaattgtgatcttgtactccctctccgccctgcagaagacaagaaagaaaaaataatatgagactgcaaaacacataattcataagaatttaaatctctagtttgcatcatacaaacctttctttatccttcttttcgggatcaattagcttaaccacaaactcctccgattcaaaagggagtgaaccagcagtatagagactctttcttccatcataggcaggcaatttgccaccaagagatgtcttcccgtgcaacttgatgagctcattgagtacttccctatttgttgctcttgattttgactcaggattgattgaaacctgtaacataatccaaaaagaagatcaacggcctttctattggacatgaggggcagattttttttttataaaaaggaagatcttagagcaacttaacaagaactctacagtaaacatcacgtaacaagtagtttagatcagagcagttaaccatcactaatacaccaaactactcaatgtgtatttcgtctagacctaaatgagtaattcagcaccaagttatgagtagtacacacattatccgagccgattgattagggaaatgaatgcaggccgaacaaaaaaacagaatgccccaaagtaacgaaatctaaatcagctagggaccaacagaaatcaaacaacaaagaaggtggtaaagattgatcctctccattgaggtcacgatagaggtagaactacacttgcaatactacgggtacgacacttacatggggcgggcatccatggcggacgctagagcctggagggaatcgccggcgaagcgttcgaggaatggggagagaagcatggggagagttgaagaatagctgtactacgggtcgaacatgaagaatagctatactacgagttctttaaagcccaccaaagcccataggaacagggccaagaatatcggtacagctcaggaatcagaaaccaaacatcaaagcccaaaaacaaaataagaaatggaactactactaaaagccccaaagcaaaacaaaacatatgaaacgagtttgcaagaattccacctgaaaaaacgttattgttttttgaacgaataaaaaaaaagctaggcgtacaagatcatgaatgagaacgacatcctgaagacaacgataaaattttcatatattttgccaaaaaaaagagcagaaaacacaaaaaccaaaagccacatgtatcatgagtttttaaacgtggatccaccactctacttctgcaagcgacaggcttccggccgctggagagttgctgcaagaagatcagagaaaggacagcggtcactagtccgctgctacaagaaaacaagaatcgatctgaccactttggatgcaaaagttcacgcgaaggcttcgcatacagggagaacaagtttaacatgtcccttgcaagaaaatagcaagcgaacgtatccgcttacacaaaaatggcagtctccaaaagacaacaaaagaaacagtcaaaaccagaggtagaaccgaccgggcagggcacagagaggtttcgtcgtcttccaactcacacaaaaaaaagcaaacttgtaaagtagaacaaaacgatgcaaaacctttgcttgcagagggaaaaacccgaccagctcccacgagggagagatcagaactacccttgtacgaaatcagcaaccccaaacacagcaaccgttctgaagaaaacgggatgcgcgcgcatgtacgccagtgcgtttagcagatgagatgcatgtcacgaaaacgaacgcaacgaaacgcttcgaattggtgagctgcgtgtgctgcggccatgagatttctgtcgacatcggccagatctctagcaccaaactagcagcgagcaccgaaggtgtaaatggccaaacaaacggaggggatcaaaaaatcggagaagaaactttatgcaagaaacgaaacgcgacgctccgaccaacacccacgaactggatgataaactttaaacgaaagcagcagagaaacgaacttgcaatcgaaagaacgaaacagaaggatcaagaagcaaaactgaaccgagcaacctacccttgtacgaaacgtaaaacgttcccaactaaacaacgacatgcatgtacgccggtgcgttgagcacgtgagacgcgtactacatatgtacatgcatatcaccaaattaaacaaacagaacgaaaggcttcgaacgggtgagctgcgtgtgctgcggccctctcgacatcggccagatctctagcaccaaactagcagcgagcaccgaagtggagaaggccaaataaacggagaagaaactttatgccagaaaggagacgcgactctccgaccaaacacccacaaactaggatgagatcggaagccctcgctccatgcaaaactgcaaacgaaggcagcagagaaacgaacttgccatcgacacaacaaaaaaaaatcatccagaagcaagcaaaatccatgcatacacacaacatgcaaggtaaatttaacagatctgaccatcacacgtacaggagtacagtagtagacagcatgcatggagtatgcgtagatctaggggtgggaagggaagggaaagagggtcaggggtgagctcacatcgtagtggaagaggttgttgtcggcgacattgacgaggaagtggttcgcgcggatcatcaccttcttcccggccgctccgaaccccggccgcgcagggtgggcgagccccttcttcgacaccggtgccagatccttgtccgactccaccgacgcctcgccagccggcgcggccgcggccgacgccaccgccgcgggtggcgccagcgcggtctccgacacgaacagcttctgctcgaactccttggccagagccgtagcggacggcgccgtggaggacgacgagggagccggcgcggccgccgccggctggtacggagccggagccgacgagtgcgacggcggaggcgcccggatggtgacgggcgtgctgcgcgcgtagccaccgatcaccggaacccccggggagggcgcacggtacacgcccccgggctggtacgcgccctggtggtgcgccgccggcatcggcgcgccgtagacgacggccggcggccccggccgcgggtactgcggctgaggaggccccggccgcggcgtcatccccggcggcggccacacgaagcccgaggcgggacggtacggcggggctccacccccaccaccaccgccaccacggccagggacgtcgccgcggccggagtagggcggccgctgctcgccgccgcggccacctcggcctccgccgcggtaggccatggcagagagagaggtggaggaaggcaacgagatggaggtgagggtttgggaaggggtggggagtgggtgagtgatgttgcggccttgcgggaatggaaggggagggggattttataggcggagggtgatcgacgaggagaaaccctagctagacgcggtgggagggagaagggggtggtgatcttaccgcgcggtgactgtatgcttgtccgtacggaagagtgattaattaggcggccggttaatcaaacttgctacccaagacaaattatgtgtcattatagaaagtgaatttatgtccggtttttttttgtgttttttgaaggaaaattatatgtcattaagttcatcgatcggggtgaactaattaatctgagtttgttttgttattaatttgggtgttaagatattgtatagaaccaagctatgaacgtgaagttatacatatgtatagtcaagtgtacgagtgtagcaattcataatgtttaaagttaaactgcaaatggcaaaaaaggccgtacgtctagtgtagtatcccatttgacaccatccttccgttttgttttctcgtaattaatattgaagttatatatgtttggtgtggtttttgtgatatacattgtccaaaatttgacaaattaaatactatacagatcaataatgcataaaaaaaactagctagaagtgcatgcgtaccagctggaaggatcagactgaaattacttttttgaaaacctaccgattgaaattactgttgcctagtattctcattttcccagcgatcgagtctcgaattgctgccacgtaatgcctctatcttggaccattttgatcgctatgggtagaaaaggtttgatttaaaatcaagtcgtgttctaattaccttcatgaagggatggtcaagacgaagcgtataggcaacattgatttttactgcagttagaaatatttgagaattgagatgtgaatatacatgtgcaaggcaaagcacgtggacgcatgcagtgagtgatgagatgagtccacacctccaagacaagtcacaacccgatcacaccggacggaaagaagaagattctggaggaacgaatgacccatgcatgcatctgtagccagtctctctctcatgcgccttggaattatctctcgtacggcttgggcccacctgtcattctcacactgtattgtacccaaggtgaaaatatcttcactcctaattaatggctaggtagttttaatcatgggtaagataaataatctatatactattaagctagctactctgtactcctgagagaggaactcgatcaatcatgatcgagtagaactttacactggaaaaacgatactatatggtgtgatcgtctatcggcgattcgatcggcatacgtgtcacgtttgaaaaactggatcactgctcgcccctctctctctcgctctgcaaagagatcgtatcagatcgtcttggctgcgagagccacccagcgatcgagccagaggcggtcgatggctgtagcagccgttcttccggtgaaagctgaggctatgggaacatgcagatgcgtccaagcggtcggcccagctcatccatgcatgtatacgttgcggcgcagactgcatgcagtagtcgaaaagcaaaaggaaaaaggtagagcaaaattttttgatcgtctccaaacccgggttaaaagtgtgtgtggactgtgtgattttaactgcagttaacattatctccaagcccgggttaaaattatgttctgtattctgtagtggctgctgacatgcggctcggtttttctgatcactaatataacctgcgagtaggaacattgcatgcagcaaattttactgtctctatcccggtccgttttttatcatagcgcagaacaaaatagaagaagagctgcgcagtgcatgcgtggtggactggtggtaaaaacgacgaggtgtgtacagtacacgatgcgctccttttcccatgccgcttttggcatcctcgcgccctcctcccctgtgcaaatctctgctgccgctgctgccgcaacctcgcaatatcgcattcgactacgaccaaaccgcggaggcgaggagcgtgtaggggaggggttggtggtggactggtggtcaagcgaagcacgcagcggttcgagccgcaaacggcaaagcatctctggcgctgcgatgcgctgcaccgtggggggaggggacagcggctgcaggtatcagagacaggagcagcgtacaccgcggccaaaagcaaaagggtgggtgatcgtgctggcctaagttggcaatactggcaagctgtgaggctgtgaccatgcatacaatgggtaacccaaacccatgcttctctgtttgcgagacgatcagacgagacaccgcgagtgggtgtgtgtgactgcctaccatggaattgcatgagactgaggccttagttctcaaaataaaaacttttcacccatcatattaaggtggtgtttggttggagggactaaagtggggctaaagtttagcccctctctacaaaacgagagggacttatgtttttgagagaggggctagagagaggggctaaagtttatcccctctctcccaaacacccctaagaccctgtttagatgggactaaaacttttaagtccctataatatcgaatgtttagacactaattataaatattaaacatagattattaataaaacccattcataatcttggactaattcgcgagacaaatctattgagcctaattaatccatgattagcctatgtgatgctacattaaacattctctaattgtggattaattaggcttaaaaaatttatctcgcaaattagctttcatttatataattagttttgtaagtagtctatatttaatactctaaattagtgtctaaatacagggactaaagttaagtccctgtatccaaacaccacctaaatgtttggacacatctatgaggtattaaatgtgaaaaaaaaataattacacatttacgtataaatttcgagacaaatcttttaagcctaatcgcgccatgatttgataatatggtgctatagtaaacattaataaatggtggattaattaggcttaataaattcatctcgtaattttctggcggaatctgtaatttattttattattagactatatttaatacttcaaatatgtgtccttatatccgatgtgacaatcaaacctaaaatttttccccaaccaaaacaaggcctaactatgttaacgttgcttattgtaaatattactagtattgtatatttgtatactctagtactccactacgaggactcatctctgcgtgcagtttgaagcaatttgaactcaggccctctttatttcacaccccaaaattttacatcatgtaacatcgaacgtttaaacacctgcatgaagtattaaacataggttaaaaaataactaattacatggataaagactaatttgcgagatagatcttttaagcctaatatctccataatttgacaatgtggtgtcacagtaaacatttgctaatgatggattaattagacttaaatttgtctcgtgtgttactgacggattatgtaattactttttttattagtgtctaaacactccatgtaacactctatgtaatattcaatgtgacacgctaaaactttacccctctaaatctaaacacccccaagtttgaactggagttggaaaaacaaccgcggtaaaagatgtgcccgtgtgtggtaaattaaacatgcagcactagtggagtggggctactacacgtctacacccttggtggactggcagagtgggcccacgcaccggggcagaatgttggatgagaggagagagatgcttcttgttggcttcgcagccaagaaagaagctcctgtatgcctggctatagctacctggaacatgcacggcgcgctgcgccgcctgcgcacgcagcaggcttcgcggccatgcattcgtccaagcggtcgtcccacctcatgcatgctgcacgtatacgttgcatcgcagactgcatgcactcgaaaagcaaaagaaaaaggtagtagtagagtactagcgaaagcgagtgggcgggtggcatacgtacgtgtgcactccaatacttaaccatgcacgtagacgtagggggtgcggattaaactgcagttattctgtagtagtagctgttctttttttttttctgatcggtaattaacctgcgtgtaacaacagttctattaattagaccatgaacaataatgtacatgcagcaacttttacgctccctattatattacgttccgtttttacacgtatacgggtaaaacgacgaggtccacacgaggcgctcctttcccatgccgcttttggcaccacagttctcctctgtctgtgcaaatatctctgccaccctgcaggctgcagctgctgcctcccactccaatggtccaacctcgcattcgatttggagtacgaccaaaccgcggaggagggaaagcgagaccgaaaacgctaatcagcgcgccattgatcgcgcgccctccccccgtgcggcgcagccacgtggcgcacgccgagagactcgtgagcgcggttttcttttttttttttcggttttttcgcttttctttaggttttcttttggttaattcccggttttatccattttccattcggtttttcagtatatatacttatcgtttggtttttaatctatatatgtatatacaaagtttatatatgtgtgtattcgtacttatagccaaacccttctacaatgtagagcaggaaggagttaaaagaatcagttgggcataagcaccagatacaacataattagaaaaggggcccataaatctctataagtcagacaattatgttccaggttttggacaagttgaacgaaagaggaccataaagctacagccgattccaagcaaaaaaacatggtacaacgcatcaacactaatagcaagcaagccagcatagatgagaaagatatgcatgggagatcacatgtactcctaagtcatagtaagattaaattcctgtttctgaagttactgctgcaatacataagctaggaacaaaataagcagccagattaaattcctatttctgaagcacatccagatctacagacaaccatatatagcagcagcagccatagaaaacgtagaagcagctcgcaaaacaaagcacgacgatgcagatttcgatccctgatactgtaagtataagcagcatgactagatgaggtctgctccagcaccacaagacgtctgcctccaatccttccattccagtgctgtcaaacagaaatattaattatagtatagcttagaaggatggcaacatcaatggcaaaaccaacagtattaatactaccaaataatgtttaactcagggtaatttaaatggcaagccgctaagaagtatagctgtgattaacacaaaccaataagtgcagaatgaaattgcaaacgaagttaattaattaattgcatgcagaagaagtttagcggtttgagttacctgacgaagatgtcaggttcttgacaacctcctcttgattgcagtcgagcactcctccaaatcatcacgatccctcttgggtggaactggattctgaatgtgtttgggaaattctacacccaaaggctgtgttgggcaggaggagagcctggtggaggacatgatgttcttggtgtgcatgttgaggctgaccatgtacaccccttcttcagcagcattgagcatgaaacagatgacaccgttttcctccatgctcaggacggggctagtcggcttgaccttaggcaacccggccttcttgaagccctccagctcccacaggcttgccacacggagttccccatccttgtgccactgcgtggtggccagggtcagagtccaagtcgtcatcatagcttcatcagggggcaccatgtcaatagaagcgaacttgatggagtccttaacgcagttcattgtccggcataaccgcagctgattcttcatggggtcaagatggcactcaggcggcagcgggatgtagcggaacggcacatcgtagccaccggtgagcacgtcgtggcagctgcagtagaggacaccttgcgcgaggttggcccagaaagcctgacctccggacgagaacaccatatgggccttgaagcgattcggcgtctctggagggaagagcgggttcttgaattgccacggcgtggtgacagcggagaaggaggatggcggtggaggtctcgaggatggcggcggcggacacaggcagaggacatcctggaagaagcgcctggtggtttcccggtcggaccgcatgtcccttcccaggagggcaatggtgtagtcgccgccggcgccggcacgaagagggagaggctggaacgtggcagagggatcgcagcggttgggcaggcaagggatcatggagagtgacttgccgatggcgtcgtagactaggtagcggtgggtgcgattgcggaggcaggaggtgaagacgatgaggtcgtcggcgacggactggacggaggtgtgcaggttgagggcccgtttaggcaagtccaagagctgcaagacggaggagccatcgtcgaggatctcctctggtcgggcggcgacttgcacggggggttcgctgaggcggatggacagcttggagagatccggcggctcggcgatctgcactaggagtgacaagccatacaccacctcgtcgccgacgtggtcgttgcgcaggtaggtcttccgatctctacactccatgatcgcccactccgattcttccttgacggcttccttgtccagatgaaccacgcggtccagcacgacataggaaggtgcagaccccatggtagccatcagctgtggatggaggtgtatgaaggcgaaggggatctgcgagtattagggtttctctgggtagaccagtcggacgaggggaaaggttcgatctcaactcgacttacagccacagccgggaagggaacgcgatatggtcaggggcaggcagacatagcgcatatcgaatcgatccgaccgttagatgcatggcgacgcggatcgtggcttcatcgaacggctggtgtctagccccaacaaacacaacgggtgaccaacacctggactaggtgcaccatgccgcactccataattgagtcttctgggcctgcttcaaagcccctaggctcggtggccccggtgccaatataacctggcccgcctttaggataaataagttcacttcagatccctcaggttgtcaacaagtctgaaatctgtagctcaaccaaaataccaaatataatgcatccctcaacttaaaaaaaaaactgcaaataagataaaaacagttttgatgacggtttcatccaacgtggatggtttgatttggttcttatcccatgtgatgttgatgtggcattattagaacgaagattgacaaatttaattaaaaattaaagggacaattacttatttgagcctagtttatagcctaactaccaaattaaccctactcttttaggtttgctcatttaacccaaattgaccgtcttaaatttttttcatgaaaaatattatttttcatgatgttaaccattctattttcaaacttcacaacaagcacttctatgggggattcattaagaccttcacagttcatccagtataaggataacaagcacttctattggtgggggtgggggggggggttcccaacaatcacagtatgaccctattctgtgtaaaaggttggttcaagcacttcagagttcaataagcactactctgaaggttaacaagcttttatgttcaaacttcaaaaaggttaccagctgtgatcctgtgaaggcctcaaaggtaagcattttcattttgtataataggaaaaatagagggagaagtttacagctagaattccctcacaagggtgaattcttctttacaacgaaaaaatagttgcatgttcattacatcatttagcattcagtgattttttgagggatcgaaggacaccccacatgacagttgataaaaagaacagaactaaaccagtgataatggcatacttcaaaccaagattcataagcaaatttaccaacagtcctgctaagacaacgcccacgaaatttgctgaaaaacctgaccagaatggcatgccaagaaccgatgaaattattgccccagtccatgctccagttccaggaaatggtacagccacaaacagcatcaaaccaagccattgaaattcctcaacaggtgcagccttctgccgcgcccgctcaaagagaagatccataatccgagttgcagatgcgcttctttgagagagaaatgctgcaagttttttcaggtagaggataatgaatggcacaggcaccatgttcctggataataacataatggcatcagatcctgaattgtttttgtggggatattctgtatatttacgatgaggcattttccaagagatataaccaaattgtttattagtactactgttataacttataactagcagtttctgttctaggtgtgtcagtgtcactgagaaataacttcatgtgtcgtcgactcatcacaaattaacaaccctatcatatcacaatacaaaggaatactcagtcaaatattaaatttagttgctgccatttcactgctttgctctcttatgctgacaatgcttcaaattactgaccttcccatgtaggaggtccaaatttaaacggtaaacaagcgtgcatcatatttttatcccaaatgttcattcatagattgatatttacacataatctgtcacgttgatcgaatcagcactgatcagttactatatgcagtttctttctttatgtatagtaactgatcagttatgcataaagaagaaatggcagaaaggtattgttgctggaattgctgctgtccagaacaaatcagaaccaatcaggaactatgcataaagaaagaaattgcaaaaggttcttgctgctggaattgtgatccagaactgatcagtcactatacatatagtaaaatctaactaaaacatgtgctgttgtttaattgctagagcctagaagtagcatcagtgactaaaatcagcatggaattgcaggtttgcagttatcatttccaggttatcctacattgtgagtttattccatcattagtttcagtatacatattccattacccaggacctaggtaaatcaggctagcatatttattcataccatattattattttacagtagacccttactttgtttattcatcaaactgtgattttgatttgtggactgtgtgaacaaagcccaaaatttagatggttctgcaaattagcaccagaacattttgtaccactgtatattagcactacattttctaagagacataaccaaattgtttattactactattgtcattattagcagtttctgttccaggttagtctttgtcataactagcagtttccaaaatgtttattagtattattgtcaacccatcacaagttcacaatcctatcaattatcacaatgcaaggactactcagtcagatattaactttagttgctgccattcaactgcttttctcatgtaggagtgcaaagttgtactgtaaacaagtgagcatcatctctattctcaacaattcattcatagattaataatcacacataatccgtcacaatgattaaatcagtactaatcagttactatacatatagtaaagaaagaaattacaacatggttcttgtcgctggaatggttatccagaacaaatcagaactgatcagttaaaacctgactaaaacttgtgctgttggctaattgctagaagtagtactctgaattaaacacttaagtaaaatcggcatggaatcgcaaactcgcagtcatcattttcaggtatcctacattgtgagctcattacatcactagtttgttgacctgtaaaaatgtgataatgatttgccggacgtgtgaacagaagcccaaattttagatggttccaatacaaattagctccataacattttgtagcaatgaatattatcactatgttcaatcccagtgtcacaggcaattcagcgaacacctcatgggcaaagctcgccaaaaggaaaaaggtaagcaagagagacaaacccgagaacggataggacggtgaggcggatggggtcgaggcgcatccagtacccaaccggaatggccccgcgcagctcgatcaccggtagcgtagcgagcgtgaacacgacggcctcgtccgcccacccgagcctccggagcgacgccgccacacgcagcccgaagccggacgccttgatcgagtcctccgccgccaccgccgcaccggcgcagcagagcacggcgcaccccagcgcgcccagagccagccgcctcgcgagcgcgccccagtctggcgccgtcgcagccgtcgcatcccgctccgtctcgtccccacccatcggcgccaccagacaccgccccgtccccgcgatggcgcgagattcgccggtaaccggaggagacgccgcagcgctcaggcggagagcgagcctgggatttgtcgctccgcgagctgcacctgcaactgccagaagaggcggcggcggcggaggcctccatctccacgacgcgagcgcgagcggaggaggggaggaggaggacgaggcggcgagaaccgacgccgccgccatggccatctggatcgaggaggaggaggaggaggcctctcgcggatcggattgagcctgccactttggactcgatttgattttgacggttgttacgaggcaacgattcgtggtgatgcgggaggaggagaccccgaggctacctgcggctgctcgctcgcgccatgggagggaagaggaaacgggtggcgatttgttacactgagaggtggggccggaaaggtgtgggcccaccgcatccggatgtaatagctttttttttttttttttgctggttttggtggtgtgttgatccagtcgttatcaggttgagcgaatcaaaatcaacagaaggaatgcagcaggtaaaccgtcaaaattaacgactaaatgaaagaattttcgatggtgatggccactgctcgctacagacaatcagagattcaattatcagttcttgaacgggcaaaaaaaaaaacaaatattgcttctattgcggaaatatcaataaagaattgaatatgatcagatgatgactcaagagcaacaggcaattacatttccattcccaagtatcacaagtttattgtcttaaacgcgtttactcccacttcacatcgaattttgcagcatttttaagaggacaaccacagggtctctcactcctagcaccgagagaaaccagagcctggtactaaatgaggaatgcaggcataagtttgggatttaggatgaggaggatgaaatgaacatgttgactttcctctccagttcatccttcttagcaccaaccacgcgactaacctccttcccgcccttgattaacacaaaggtcggcatggcctccactttccattgcctcgccacttcctgcaaaattcaggttcaccaccattaacaaaacatcatgttcttgttatacaagaataaaagaagacgaaacactagcggtgtgtgctcgaattgccagacaggcttgcaaatggaattcttaagaaccttttgctacaaaccaaacaaagtacaataattggtctgcagttacatactttataactttataaatcataatcgggacgtacacatttgatgcatccaagtagtgcgccacatagacccatcattcccgcccagctatttattagtgcattcaaacttgcacaataattttgttgtggagtttgagataaatatgagaggatccaatactcaatgatgcaagaatttgtttatgcagactggctaactgaaacttgatcaataatttgctctaaattctactagttgaactatgtaaaatgcacaattatttgtggtggtggatgaacctccacctctgatgaagtgataattcgtcctggtatgctggaaccaaacaaatattctgttaggtatgaatacaacgatacttccatgattctaggctgtaactgaacaaattcttcttatcctgaacaagtccccataaatcatgaatatttatgatgcttgttatggtatcatcttggagtactctacaattccccataaatcatgaatatttatgcttgttatgtcatcatctcagtccatcctacatcttcccaaaagatatacaatgcgctctaaacggatttggtctttgctttataaaccataattgagccatctattcttgatttgatcttgcttaggtgaattcttagaacattatcaagtcgaatcactcaaaccaaagacaagttcatccagacccataaagctagatactgtttacagtacatataaagcatcctaggacaatgcaagacagcaaagaatgtcatcacattgaactccatagtccatatctggttctagacttctagtggccaagcaactatattgcttaaatactacggcaagaaccaaattcatgtgaaatcaaacatctcactcaatacaagtgcgcatgccagccgtatgcaaccagcacgatttctcagaaattatgcaaaatttctatgattttgaaccagctttgaactaaggcgagagtcaactacaagtactgtactaattagtagagtagatagtaacataataaccaatataactcaaattctttcccccttctaactctgcagaatctgtcgatttggcaccgaggtcaagcaaaacaaaagaagaagaaaaaaaaaagcaagacatgccagggtcgtagcaaccgtaccgaaagttcgtcgacatcgatcttgaagaagacggcgtcggcgaagcgtccggccatgtccttgaaggccggctcgatgaagcggcagggcccgcaccaggtggcggagaagtcgatcacgatctgccgcgcgagcagtagacagccaacacacgctcagatccaaaccagcactcgaggtcgaggtcgatcagattgggggggaaacagcgagagcggagctcaccagcttgttggggttgctcttgtgggcgccccactgctcgtcccaggtggccgtggagtggacggccaccacgcgcgagtcgccgccgtcgtcggcggcgggcggcggcgtgaacatcgtcgagaagaaggagcccatctcggtcgcgtgcttggtttggttctctctctctctctctctcttttctcgccttgctcctcttcgcttcgcgtgagcgcaagcaacaactcttcttgttggtttttgacttgtgatgagggaggagagacgactctttgtagtcttgtggagtcacctactcctcttagccacagaaaatctcacgcccaattttactatcaacggtccagattaatcttgcaaaactaggccacgtgtcagtaacgaaggatgaaaatgatatgaaaatttccgacaatcatttttgtaaaaaataaaaagtaaaaaagtaatagtttttagcatttctatttagtcatttataaaatttagttttctgttttctatttgcatattgaaatcgacaataaatagttaatttataaaataaaaaatagaccgttttcatcctatcgcgtgcctttttaggtttcgttcaatcttgaccgtccacgtgtccaaacaaagcggacaacgatgaccaaccactgactcagacaaggggtggattgtggtgtgccagcatctgaactctgcagatgtgtaaagccaagttgattccagacttgcacgggtatatgcttcgaggacacaaggaaatggagacccaaaaaggctaaagaacccaatggtttcttgccaaggtgcatcctcttgctgtagtagcatagatgatagaaccaccacacttttttacatttccaaccccactggtcggcagccatctacaatttacatgacaggaaagaatgaataaatactacggagaagcttttgttgctgcaggctgaggctgcagaccaaatgtgctagcttagctactggacatgaaggattcatgcttcatgaaccgagcagaagagagactacttgacactacatgttacacatttacaatctaggcacacggagcgagatgagcttccatggtggtatcacatcctacttgaaaaggagtagagcagcacaacgagcccaccctgtgagcgctgctcactcaatgatctccactagttaccagtgacaatgtggcattgagcttctcataaggggttgctgaacaaaaccagttaggatctagtgctccggcttcggggtgcgtgtgacgaattgcgttacagcatcctggtttacatgaaaaatgaacctcatatcctttatctgcagtaaacatcgacagatcagtaaggtgagcgtgagtatacttgatgatgaaaactaatgacattttcagtgaaacatctttcaaacaagccaacgtgaactaccaatatgtactaacctttccaacaattaattattgaaactcagcttatgaatctatgaatcatcattatatctctgaagattattatgagtgctacaccaaatgctaaaataaatgtaaaaggagctaaaggtgagtacttacgctgaaaggcccaataagattaactgtttaacatcagtattttggcatgtctgacgaataaggccaagataaaaatggcaaagggaacatttttaacttattccattatatatttgaaatgtatgtgattatctcaagtaaaattttattttgattcctgagcattagccatttcagtctggtctttatatataacaagcataacactaggcacgtctcatgatacatcgtggatcgagtataccaccacatgccagtcagccagtaagcggtgcaagctgtggtacagtggtaccctaaacaaatcatacatgttcaaattattctaagcactagtactaaaattgtgtagcacatcaaagttaagtatggaatggcaatccttcttgctatctggcataataagaatatgaacagttcaataaccgccctttcataataacaattttcactaatggactccaggatctggtaacacttaacaacaaagcatagtcaagattttcttaaatatctattttccatagtaattacatggataatgaaggatttcaaccatgtttatcagtacaactcattccaagttctaggaacagccatacgtcatatatatcacactgaaagttcaaagaatataaatgcacatatgcaaatttttataacatatgaacacactactatcaaaagacaggaccagaacaattactacagggatcatttcttaatcatgaggttacaaattaattgtgtaaacaatgaggtttgggtagtttactgcttttggttcaatcagtgataaatgaaggaaacaggaaataccagtacctcaattaacgaatctgaacttaagatgatgcgtttgcagcttggtacttccttgctattaacaaaaattgaacatttcccaatgtttttgatatgaaaagaaccagcttcatccatcttgataaccgcctaattttcatagcacacatggatttatataaacacaaaggcccaaagaaaaagagaaaaagaagcagatgtggtaaaacataatcccaggataagtttttttagggtactgcacgagcaaacaatgggggttaggatgtaatcagataagcctactattaattacatgaaaacagttgctagtttaagcagaacgacataatccgatcaagcactagaaaagttatgctgcctagttgtatgttgtttaggaccatttccatgattacagacctgtagttaacataaatgactggaaaatgtattttaaattagtcataacaactcactaacctaaggctcagaattagtgataaatcctacctttcatcatggatcgacgctatgtaattttcttgcttgtacaaaaaccatataaatgtcccatattttaatgtaccgtgtgggcctccctcactgttttacagtaaaaaatcaact

SEQ ID NO: 18579 - DNA, 19794 bp, Oryza sativa
ggcatgcaagcttcaagatcactttcaaaatgcaaattgaatagaagaagaaggaactgctcaagctgctgccgcggatgatgaatcttccaagctgtcatgagtgtcttctgaacaaggaggagcagttgattccttctcgcaagcttaggtttcaaaaaaagaatcacaagctagcaagcggtgacggcagccactgaaagtggccaatgcattttgaacacacagcgaatttgtttcatgccatcgcaattcgtaaatgtgttacaaggtaatcttatgggacataagtaaaagcttccgtcacccgacctttggacttcagttgatcactctcaacaaaatgtaaattttgtcatgcacgaattctcctctggaagggtctcttgctgaaattctgtcatgcacgaattctactagtactgtatacagtactactgtggagcaatgggcatgcgaactgaccactgaactgcttcccaattcagagtttcagacttggaatggcttcctggtgccgtcagtttgtttgtttggtccgattctttgtttagtcccatagtacttgcccttatatgataaaatatgattaatactctatgcgtgacttatctttttaatttttttcataattttgtcaaataagacgaacggtcaaacattggacacggaaaccagggtttgtctttttttgggacggagggagtatatgtcatcagtaagctcatctgaattcaaatacgaataaacacatggtacaaacaatatagaactggaaatcagtcagactaattgaactgcatttgcccccaacaccaaaacaacaagcttgcttagatcacctaagaaaggctaacaataagcttcagtatgaccagttcactacaatcggcataaaactctacaaaaatacatcggaaggccatgctccaacgtgtgccccatgacataaagcaaaacaggctgatattgagcaaatcttcactattgcacccatcgttttcagttgatagatcgatgtgggggtacctgaattctgttagctgttgcctgttcggttgccaatgagatgataaaaatccttttttagttctcaacctcatcacgtaaactcctagtcctacaaacataacgcacacgagctataaacgaaattaagggggtgtttgagaaacaccccctaagccttacatggattgcatgagcagagaagactcaagaatgagtacagccatattcatataaactagcatggtggctcgcgcagattgcgcggctagcatcattatattttctctcatataatagcatatatgttttctcattatattattcaaatatattaaaatgacaacataattttaaattttgcaataactttacaaaactactaatatgtaatattcatattgtattttatatatacgtgttagttattaattatttttaatatcaaattttagttatttgtaaattataatatttctatatggactctagaatcgtcttttaatatttctttttttaattccgaattttctgtaaattgtatttttatatagactctatgctcttcttccaatattatttatttttattctgaatttttattatttctaattgtatttctatgtggactctaaactcatctttcaatattctttaatttttaatttcgaatttcagttacttctaaattgtattcctatattgactttaaactcttcttcccatgtttttcttaattccgaattttatttatttgtgaattgtatttttatacagactctaaaaactctaattttaattttattatgtttattctaaattttagttagttttaaattcctatatggactctatactctacttctaatattccttattttttaattccgaatttctatttttgcttaattgtatttctatatagactctatactctacttctaatattccttatttttaattccaaatttctattatttcctaattgtatttctatatggagtctatactctacttctaatattccttattttttaattccgaatttcaactatttctaaattgtatttctatatggactctagtctcctcatctaatatttcttatttttaaatttcgaatttcagttatttctaaattgtatttctatatggactctgctttttctttttctctgattaatgtgagaatttctaggccatgagagcgaacgtggaggctcctttttctattcctttaataatataatagatactagcatttggtccattacatcagcggtgttactcaaacttatcaaaaacaagaaacgtttttatcactagaaatgcactcaataatacctaggaaatataccatttacattagttccaagaaaaagtatcttttgcatttgactttaaactcaactattggggagagacatcccacaaatctttgaacttagatcgagaaagacccaaacgctggctgccaaggacgcttttcgcatataactctgaaagcagttatctcatcaaggaccttttttttggtgagacccagagactgaaccctggtcagcaaccccacaactaggtgggttaccaccgtgctgccattcacgcgttctcaaattggcattagacttgcatataagatacacacaaaaaatggtaaaagcaggaatatctataacaatatttaaaaaaaaaacagctacatatccaatatcaaattcaattttgcaagactgggtgtaatccaaaccggactgggccagttggaccaaagctgaggagacccaagttcatccctgctgttatcttccaagttgaatactccaatatcacgtctattattcttgaattctgttatccaattctggctgtcatcggtgaagtaggcatgatttgccttgagagacggaaattcttcagcgcggaggcaaagtgtctggttatgcccaacaaacaggacatggtcttgcaagcgattgatcttcacaagcttttcttccaccaagtcagacttatatacttcgatacttgcagtattcttcaaaatggcatcataatcatcttctgacggatgaatgtagtcgtcctcttctgttttccagatttgcagcacatcaccccatggcgcgtgaagtatgtatgtatttctgtcaccatcccctatatccatgacctttcccataacaaccttcaccatggcaatagggccactgaggtcaattgcatgaatttctcccaacgtagtgactgcatatagcaggccatccttgtaggtgcagtcttcatatcggccgtactctggcaggtagtcccattcatcatcccctactcttgcaaatgagagctgaccgaatggattgcgtataagcaccacaaggagctttcctgtcgatgtttcagagaatacaaaagccctcccagtgaggaacaactgctgccatctaggagaaatgatggatcccattgaccttgaggaaaacatcactccgtcgtgccagaactggctccgattctcatacttgacaatagcgcccgactcgtcgtaggtgggattaacctgctccatggtgatcactggcgggagggccatctgctccctagtgactgggttgaggaggtgcatctcacacttatcatcaatggttaccagccaaccatctgatgacccaatcaggtatctatcacggatgggtggatccgggagagtaatcttgtaggttctctgctctgcaaggctgtagatacaccctacattcttaccggcagattcagaggtgtagaagaggcaaggtgtctggtgccgtttatattgtccaaggctgtgtagtgtggtgtatgcagagtgccaagaggagcagacggagctcgcacgcagcaagtcagggatctccaagcgggaaagtatttgtaccagcaaatcctccggcagatgcggcaattcagcctccaccatcgatggcagcacgccaacatgttcttcttcgatgtgaggaagagctgagagcttatgcaaagctcccaagattgcagagcacaaagccgtagctagcctgcctatgctcattatgctggctacgatgcaggtcgccatcagatcactgcttctacttgcaagatgaaaaaaaaaaagttgagttgggcttggccctggatagtgtatacacttataggcaacaaggcaaggacggcttcgaatccgaaattgaacgggaatctgaatccaagaaggaaactgctcctgtcatgcctgcctgcggaattctggtattagtgcacgggcgagctaaagcacttaaatagattcggaatcgggagtttgggaccaaacctgaaacctgttgccgcagagagtccgaatccgacgagtgttgagttcctctctccctgtgtcgtcggaagcaacagtagtagcaaaactgggccattccactcgccaggaggagccagccgacgagggcgcagcggcggcgcagttggttgggtcgtgcggctacttggcttggttgggttggccatggccgccaccccgcccgcatttcctctctctccgtcgccgctgcgccacccaccccgatcctccctccgccgccggccgccggcctcggcttatcgtcgtcgccgacacgagttgggctccgggcccaatacatacttgggcttaggccggcctgcgcgttggcctgcttgatgtgtcggcccaaaatggtggccggcgacgctgaacggggtggggtagtctgctatttaacctttctctcgccaacctgcccaccgcgctctcgctctgccaccgccattgcgccaccgctcgccggagaagccaccaccaattatcgctttcaaggataataaggtgcatcctgttcctcccttcttcagttcttccccatcccgttacagagtctttctttgcagacacgtacgccaagaagcgttcttggtttcttggccgcgcttgcgccaccgctcgccggagaagaagacaccaccgccatttctggtttcttggccgccctctgccaccactcgccggagaagaagccaacaccagtttcttggccgctctctgccactgcgcttgcgccaccgctcgcctgagaagaaaccttcaccatttttggtttcttggccgctctctgccactgcgtttgcgccaccaccaagcaccgcgccgcgtccaaagataataaggtgcatcctttcttccataacgagctcttcttctcttctctttctctcttcttccccttcctctcttctctttctctcttcttccccatcccgttacagagctcatctttgcagacacgcagggcaagaagcgttcttggtttattgcagacaagaatcgtctctccacgactgtatccggcgcaagagacagatgggtcccgactcaggtagcgtcatctcatggtgggctgaggcgccatgttgtcgttggttggccgcgctgttcggctgtccttcgcagtcgcgaggatcttctccaaggctgcagccttcttcttcttctacgcgatcacaggtattttgatgtgtttttactgtttgctggagtgatggcgccagaaattgtggattcgcattttcgttttcttttgctctgtatacaaactgctgcatctcttttaacaaaactagctgggcggctggcgcaattacgcggctagcacctatacaaaaattatatatttttaatatgattttaattaaaatttattaaatagttatctcgttgtcttaaaactttaaaagactaaaccttatcatcattgtgtttctaattttatagtttttaaaagtcacaccaattgctactccttacttctgtcatatcattttttttatttgcttgctcaatctaccaatgtttctatccattctccttggaacctttaaaaattagatcttatagtttttaaagtttattgtcccgttgggatttgtttttataatttttagaagtcccatcaaacattaccattataatcctctatggtcgtccactgcctcttctttttattgtcatttgtattttaaaaatcgaacataactattgtttaggtttatttttttacattctagaagtttcaccaaaacgtcagcgaccttgtcactgtactcctctacgactcgcccgccgcctcccttctctgttgtcattgagattttaaaatcaaatatgagtatcatgggggtttattttttttattttttagaagcccaaacctttaaaaattggacttatagtttttagagtttattgtctcgttgggtttcattttttataatttttagaaattccgtcaaacgttgccaatgcactcctctacaacccgtccgccgcctactctttattgtcatcgaatagtaaaaatcgaacataactatttgttagaattcatttttcttttactttctagaagttccaccaaccatcggcggctctgccattgtactcctatacgacccgtccgctgcctctcatttttattgtcatttagattttaaaaatcaaatataattatcattagggtttattttttactttctagaagtcccgctaaccgtcttgaccgattgcttcacgacctacccgttgtgtttccttttaatcgtcattaggattctatttggtgttttattaatagttttaaaatgttccatcaactgccaccactccactcctttataggcttgttacttaattaatctcgtcatgtattttagttggtattttctttcaatagtctttatttttttatcaccaattttagttatttataaattgtattcctagttgaaatcttatttttctttttctaatttcagaatttattttttttttgaattttaactaatattgtattgtgttcttttaatatttttattttttatgttcattttaagttgtttcaaaattgtattcctacttgaaccctctttttaatttatctaatttcagattttattttattttttattttaaattttaattaatcttgtattgggttcttatatgtttcttatttcaatattgcttatatttaattccgaatttcagttaattttaaattgtattcctaactgaactcttattttcttttctttttactaatttcgattttttattttttttatttcgaattttaataatctcgtactgtgtttttatatggactcttatttcaatattgcttaatttaattccgaaatttagttattttaaacttgtatttctacttgaactcttattttccttttttgctaattttggattttattttaatttttatccaaatatgtattaatcttgtattgggttcttatatgaattgttatttcaataatgctttttcatttcttgcaatgttaaactaaattgtagggggttcagtctcgaaagggaaagcatcataatgctttgctttatggcaaatattctaatagcaggacctctcgttctaccgctagggctatcaaccttcctaccagtgcagagtcttcgaacaaggaagtggtacgaacgatgacttctcaaattataacctgttagttttttttttcattttttgagttaatggttaatttgattttcttttatttgtatataaaaagggaaagagaaatatctcatataagtttaaaatctatttgaattaaatatgtacaaattatatatagtggtcacaatcagacaaatatgattttaatcatagacacattgaactttcagatcatattgaatcatttaaacatgacgcaataggatggtgtgcatggtgatgctatggtgctttaatgattgccaacttaattagtatatggcatgttcttatatgatttttcttttcctgaaattcgtagaccgtgggtgagagaaaatttccaaaggaagtggtagttgcttatgttgattactgtaaacgtgcatcagtctgtgaggagaatcagcgtgtgtgccatatgtgtgtgttcatcgagcaaagatgtcagaactacatagtcaaacaatctaaggtgagtaatctaaatgcgcattgtaggtattacgtagagacatttgtattcttgtccctatttttggatttaattgtgattttctctgtttttttccttaaaaaaaatgaagcaactgtttgccctgtttttgagatgcattgcccttgttatgtatgtaatgttgtatttcagcaagtctaatttccatgtcgtatatagttgataatccactgcataaatttgcacggcgacatcggtgtggagtgtgaagcgccaggttgcagtgtaagggcaatgacacatgaagatcttgaggttcactcctacttctgtcacattcaggctcaaggtgatctaccattctgttgcaaacatggatgttaactgtggattaacattaaatattagcgcttaacttaattctcttttgtctttttaggatggtggaggcaatacgaaaatctcgagactagccagtgaccacagaatgccaaggtgtaccgagacatcttggtgtagagcgagtagtatagcagtatgaactttgaacaagagtttccgctggtggttgttttggcatgcacttgtacatatgcttcttactacttttggagctgttctttactggatttataatgcgcttacactcttgtcataagttgtaaatgaatgtttgccgaaaaagattgttacaaaactatatgggatttgcatctacttccttcacttcacagtgtaaaactttctaatattgcccacgcggtacgagcacaggctggtttgttcttcttcttcgtgtcgtgcggctacctggctgagtgtgagtgagttggttcgggtttggcttgcaccagaattgtgtttgcattcagacactttcagaatgccaacagcgacttcttttcacgttatttaccgattattttttttcaaaaaaaaaatcttctattgtagtgattacaacacatgttttaatttatttgttaagtctatttatcaaaatatttaaattattctacaattaatctgttttaaactaaaagctagatagttctggtggaaattaagcctagtccgctcaataatatgttttaaatccagcctaacatggctttttgtcgtcctctttgtttagaaattaccctggccctacattttatatcttttgttcataaattacaacttccattaactacacatagttcaggtggaaaccaaaaaattacatcaaattggtctcacactacagcaactatatatgctagtatatattcagttcactgaaagcttgagactgaaggacgcagaaaaaatgctgaaacatgtattgtttgggggtaaagaactaatcaatgaatcaatggattccctgagagtagtccatcgatcctttgttagagtacttcaatttatagtacctgtttaactatcacattagtaatctcttacttactcctttggattcatccactaagtggtagactatcaaagccaatttagtctgtacaaaaaacaaaaacctaataaactcgattgtaacatactcatttttccttcaactcataggccaaccccgggtaatgatctcaactcaatcaaaatgattcaatatacccgattcgaacttgaatttcacatacataaggatacaccctatttgtatcagaagccaggtaaactatatgcaacaaattactttggttcttccattatcacattggcatttgacattgtacacctcttaccaattcttgatgaggcgacaggttagcactggaaccaccacacagccatagccatggaggatcagaattgagaagcttcagaagcttccaattcaagatcccttgaggccggacacctcgggaagcatgccctggatcctcctcagctcggccagcgcctcccgggcgtcgggccggtcgtccttgtccggcgccacgcaccggaacgccagctccgccaccgcctccacgctggccatcacgccggcgccctcgccgagcaccggctggtccaccacctcccgcagctcgcccacctgaatcttggccaccacccagtccgccagcgtcacgtccctccgctccctgcccacgtccaccggccgcagcccggtgacgagctccagcaccaccacgccgaagctgtacacgtcgctcttctccgtcagctggaacgaccggtggtagtccgggtcgaggtaccccggcgtgccctgcggcgccgtgcagcacaccagctccctcccggcccccgtggcgcatgcgtccggcggggacaggaggcgcgagagcccgaagtcgccgaggcgggcgcgcatgtcggcctccacgaagatgttcgacgaggtgacgtcgcggtgcacgacggcgggcttcaccccgaaatggaggtactcgagcgccgacgcgatctggaccgccatggcgaggcgcgtccgccaggggagcggtggcggcgggggcgccgccgcggtgacgccgcatcggcggtggaggtggtgggagagggtcccgttggggacgaagtcgtagacgaggagcagagcgcgcgggtcggcgcagaagccgtggaggcggacgaggtgcgggtggcgcagcgccgagaggatgagcacctcgttgcagaacgacttggtgatggtggcggatgcggaggggaacgacggcgacggcgacggcgggacgtggaggcgcttgacggcggcggggcggccgccgggcgggaggtaggcgaggaacaccgtcccaaacccgccatccccgagcttgcggcttggatcgaacccagcggtggcggcgcggagctgctcgtaggtgaacgaggggcgatgctggtggagcccgttccggcgaaggaacgccgcggcgcgggcggccgcgttggtcggccccgcggccggggccgggccccgcccgcggtagcggcggacggcgatggcgacgcagaggtagagcaggagcaccacgagcagcaccgcggcggcgacgagcgcggtggtgagcacgccgttgccgccgccggccttgtccggatgctgcggctgcggcggcgggggcgaggcgtggcgtctcgccgcggccggcgggggcagcgccgcggcggcgacggcggcggcgaggaggagaggcggtgggggcatctgggctcgcgatccacgggctggacaaaagttgggatgcgctgcgcggtggaggagaaggtcacaactactatgcagtagactccacaactcacgtcagcacatgccgcgcctggcaggtggggccggattcctttttcattaaacatagtataaacgtagacgctaacaacgcgtgtgtactcacccttataaaaacacacgtgcactatatcactataaacatctccaaaagattagattgacatatcttgatattgacgaagttatctcgaatatcttattgtcgataggtacgtcgcctatcactgaaaaaataattagttgtaaatggagtacatgtgtcaaagtatagaattttaatctagtgtattggttccattataggagatctaactagttgatctatgctcacttcataagtcggattccttttacttaaactcccatatcaaatggttcaaagcgacaaatttgaacgaattttgttcgttttcactttgacgttggcgtgtttagtcactcaacacgaagttttgactccgatgatccaatctatctccgggggtgtgatagcgtacgtcgttttcacccggcggagcgaagtttcttttctcttttcggcgtcggtttcatgaattccaagagagaagtggtgggcatcacacctgatttggactcttaacagaaaagtttaaggggagagattaggcgagtcaacccaactcaaagccatgggccatccatcgtagtggagagcgcaatagatagatatatatactccatttctagatataccacacactattgactattggacattaatcgatcattcaccttatttatttattttacaaatatataaaaatacgaggtatgccacctttaataacaaaataagtaatagatagatatactccatttctagatataccacgctattgattattggacattgattgattatttatcttctttttacaaatatataaaaatacgaggtatgcaatcttttataataaaattaattatagaaaaataagtaaaatttatattattttttaaaataagatgaatggtgatggagaatggcagtggatagacatgaatcacacaaggagatcggcgatgatgctgttttgcagcagcgtctcgctgtggctgtggcggtaggttttggtcgccggtggtctcggctacttttaatggcgctcatcatgttgggcgatgccgacgtgagatatggatttagtagtaacagcgacctggcgagatgggaatggaacggaatgcggctcttgttaattacttgtgccgtgtgtctcgacgcgatttcgattagtttagtgagggtgattagctgtttatgttaggacggtcgtcgcgattacaagtcgttgtactgtggtaggagtactaaaatacagtagttggagcgcggccactgtagtagaaagggatggacagtatatatagatagatgacagtcacaggctcgccaccagacaaccagcttcatcaatgggggttattcatggtgttccgtgccaaatttcatccaacgatagctttggcatgttgcattgaccgactcggataatcggcacgagtcaatgggccagtttggagagcattaaattctgagaagcagctgtttggtaactagtttctgagaatctgtaaaagttctgaaactcagcttctccaacttctggtttcttagttcatttttcagaatctgtaactacagattatcagaagttgtgaactgtttgaggcagcttctaacagaagcagcttttgggaaaagctgcagctgggacaaactcccctaaacagggccaatgagcaggagcaaaatttactgcccaaaccgttgtggtcttgtggatgagttcgattgtgctgcacaaagcagggttttctttaccattttgataatcgtttttggtgagagttaccgcagccacgatattacggctacagctaaaaattatgagttctaaaaacaacatattgatgagttctaaaaaattatttggctacagcaagaagtaaccgcaagatattgcaaacgacgctagcacacagcacacatatgtccggcaatgcaagatcaactttaagctgtgtggcaggtgttcgattcaatctctgtttgtgtgtactctaccgttgagtattctgtcccggcactcttttgagatggaaagaaaaagaggagaaaacaaaaagaaatcgaaaggaaaaggaaaaggggaaaggagaagacggcacgcactttgcgacgacacggattcagttatccatcccagtcgcaggctcgcaactcgcaaagcagcggcaagaagatgcgaatgcgatagtagtatcagtgtttgagcttttcttcatgtatgcacgcctattgtctacttgatcagaagttcattgtccactacttgatcagaagttcagaacatgataaagcgtaatagcttaaatcgcctagaaccgctgatacaggcagattcagattcattacccccaggctgaattctgccgagtcttcagaaatagggtatccatggatatcagaaataaacttctgaaaacctctttcccccaaaaaagatcatcaataaatgaagggtatagccgtatagatggtttgaggtctcaaaactcaactatgaactataaatatctcctcttcttttctttttctttttttgcatgcgaatacctcagctaatttaatttaggctaggctatatacacacgacaattagatcctaccaagtactccactggtacagggaaaaaaatgaatggagtaaatgtacaaccaatcattccacccaattcgctaccttctctccatagattatggaccgtatggccatggaaatgtttttgccactgaaatgcacaacaaaaagggaagatcattagacgaagaaaagaaatatcaagatcatccggttgagagcactcagcaagcagctgagtacactcaacaaaaataatgttaggagagtactcccttcgttccaaaataaacaaacctagaatgatgtaacattatacaatgaatctggatacactgttacgtcacatcacatcctagatttgtttattttagaacgaaaggagtacatgcaaatggacttgtccatattctgactgtaatagcaagatggggcaacaaactcttacaaaattcttactaacaaaactctcaacatttgattcaagtaattggaagttatagaaaagctagattaaaacatggtatgccacatcagcgtcggtaagaaatttgtaacatttttttggtaagtgtagctttttcctagtaattgggttctttggttgaaataccaaaagatgctgcgcatgcgcatgtcatatagaccacaaaaccattaccaagttatgttcactgtttaaggaaaacccacgacctgaattgtactatgtttgctgctaacagaatgataccaccatcttcagtacggtagctctctatcagaagagatgtggcactagattttgtgtatgcaccatctaacatgaacagctcatggtaacactgaaccttgtcatgctattcgtgttctgcaaaatccaaggatgcactaatacatttcttcactcttctaaataaaaagtttagtctgaaacataatctaggacagaaaccgttggtagatgcaaggacttcacatacaatttgcaacaatattgtaaaaggtcaactggatctaaataacaaaaacggttggttgagctgtaatggatgtgtagtgcaacctcattaacagctaaatccatcttctttttactgcttactctctgaaatctcggctttgtgttttttatgttctctatcgacgaaataaggcaaccttcgttaaaaaaaagttactactacttactctctgaaccaaaatctgaagaggacatagtacggaaaggaacctttcctacaacttcattataaagacatcctactatcctaaacttgctgaaaagggggtgccttagcattgtaaaagttggttatgtggatatccattctttgattcccagctggttgaaaaacttaaaattagtggctgcctggctggtatcatcatatcataaacaaattatattatgttctcataaaaaaatatattaggctctagtactccagttaacaagaggtaaagtactctaggactggaagcatgagagggaacaatggcaaccattgatcctctggctctactttccagctataaaactaagcaacacactgaactaactttacctaatacccacgttatgctctgcaagacctaagtcaaatgcgccattgagctagtccatcctcaaatcatctaatcttagactaatcagacagattcagggcatatcattagcctaaataaaatttagtttcttttacttttacaatagcatccaatagaagcaggagtagttaggatggtgaaaacaacaaggaatgacaaaattcaccttttgaggactcctggacaagcacaatatgcattgctgcattgtttggtggcagctgcaagcggagaggagcgagtttgccagtgatagggctgcgtgtgcagatgattatgtcatggaggcccgtctcttcctgcaacttgtgtgtgagctcctccaagttggagccattgaatgtgaatgagcgtgtctcgtcgtcttcgtccacatcgcccttatcatctgcaatgtggtagtagattgcacggccctccaccttgtgcaatggcgcagagaaagaaagggaggactgacagcacaaggaagtctcagtgttaattttctgaatcattgcaaaagtttcagaagtaattgggaaattggagaaatcaactataatagttccaaatttcttggcacacataatgattaaaagttccaaatgattgctaattgcatttgagcatctctatttgttgattctagaagcagctttatgaaatgattggttagttcatccaaaggacgacatattagcctacgcaattaaagagtgctccaaatctgaagtcaatgatggctttctttgctccaaatctgaagtcaatgatctcaggatgagatggagaccaattcgacgaacatgcactggtcaattcaatggagagcaagggaaatgttcgaacaaatgacaaacctcgagtctagagggcgcgggcttcggcggtggaggctgcggcgacgcgtctttctccagcggctgcggcgggttcccggtgtacgatttggtgggccggtggtggacctcctgcggtcgcggcggctgcggcggcgcgtctttctccagcggcggcggcggcgggtgcccggtgtaggacttggtgggccggtggtgcgcctccggcggcggcggcggcttcttaagctcgggcgcgtgggccggcgacggcggcgcggcggaggtgggggcgcggtcgtggccgggggtgagcacctgcacgatctcgacgtcccagagcacccagtcctgcgtggcggtgcggtgcggcacgtcgtgcgtgaccgagttccgccacggcgggaggccgccgttggcgcggaggtagtggccgtaccgcgtcttgagcttcgcctggaagccgtccttgacgggctcccactccagcgacgagtcggtggcgcggccgccgggcggcggcgcctgcagcaccttgcggcccgtcatcccgagcaggaagggctcgttggaggcggagaggtagcggccgtatcggctgcggaggcgcacgacgccgggtgagtgcggcacccgctccaccgtccaccgcgcgttcgtggcggcgccgttcctgtcctgcgtgacgtgcacctcgtcctcgtcggcgtagaggaacttgtcgtggtggctcttcagcctcaccacctgcgccctcgcgaacagctccatcgccgccggatctcctcctcctcctcctctctccgaggcgagagagattttcttcttcttcttcttcttctccaagcggcggaggcgacgaggtggagttgagttgagttggccggtgacgaggaggagggggattaatgggattaattaatgaggggggacgacgcgtcgctgccggtgggggccacggttgggggagagcccacctgtcggtcagttgcgggggtttcgactttgactggctcgcggttgcgggtgtccggcacgttgggatgggtcgcgcggcgagaaggcaacgcgcggaaatggcgggacgatggattccgtttacctcgcttgattactgcctctctcatcatgtaaactggagtagttactgctttggtagccaaccttgtacgacgatttcgttgtgcctcacgtgatgatgatgatgatgatgatgccttgatcgcaaaccagatcgttcatcgaatgacaacttgcattgttgtttttagttcatgtagtacaatgcaaacattggtttttttttaattacgagctcaattactactatgaggtcaagtaaacatgaaggcagagcagagcagagcacacgcgtttgaagttgtacttgggaggatttaagcgccgacggggaaaggtgtggatggccatcaattcaagcggccttcgtagcatcttctgctgataagtttggtttgacctggagtctcgcctactagttccaaatagagctcccttccaaatacggcggcgcgtcatcaactgccgaccacaacatggccgcccccaaatactcctacgagatctccatcggattcagtgttgcttgcacccgtgcaatccaatactcacgtgatgagcgagcatcgttcgtaccggtctaccggacagcttgagttccgatctcgcagcgacaataagatcctgcttcgtaaatctctaactttaaaatttagctttaggaggtaggtctggagtagaattgtggaatagccaaaacctagctgcacatcacttattcattctgtgagattactccatctagctccgctcctaattttagatggagctaaaactgtttggctgagctccatctccaggagaggtggagctggagctgtgtcaaacataacctaaacccaccaataaacttagtgattaagtaacatgaggatagaacaacgctgcacttgctcactctttccgtctttcgtgtggcgatgaacaactaaattctcagtgtaccagcaagaataatcaggttaggagttaggagcatctacttttgccatacgagaacaaaaaaagaaagtaatagaaactttgatcagtatagctgattaatcctagtatgtcaccagtctggtagtgccgtagtggtagcgaatagcccgtgtttgtacatatgaccatatgataggataaatttggagaaaagtcttggagatgtcactgtcttccagactaaagtttgcgtattgacagtgtcaagccatggcgccctgctatgcatccctgtatcattaaggccttaaacaattagcaagagaaagcagtccaaccagaaatatagtgtttagaaaattaggacaagacaaacagctcagcctttccacgtttgcatgcccttctttaaagtcactacatacatagaagttttttttttaaaaaaaaaagtgtgcgtccatgaactccaaatgtatggaaaatttcctaattatatacaaacttttaaggataaatatattgttatgcaaactttctttgaatagagttattatcttgaaaggttattggcacatccggttcgatgtagatgctggtttttacccattttgaagagaagaaaatcacaaaaaatcgttgtacgaacgtacatctgttggttcggtaagatagtactactagtggtgaattccatcacgcaggtgacattctggacgtggtaacaacccatcaaaacttgaatcacaaatactcctatgtggtttctgaaacgtattggagtcatcaaccaagcaccggcgttgaatgcggtccacgtcaaaagacacagaaacttggccaaatttagacaagggagaacatggtgcttgaaaagtttgtcaaatgcacataaccattcgttgtctcaaccattgttgttaccccttccatagcttagatcacaaggagaagaaacggtattgatggcgagaatagcataaaaggttaggcaaataccagaaaaacatcctaatctacaatatccaatgaggcaaacaccaattccacaagaaacatacaaactgagggcattaagacaccagtctcaacgcgaaaagaatacccaggaaaaccacgtcacgtccataacacgcaaccacgcaatcaatccaactgtgtcagtgcacctcgcagtaatcaaatgggtaaatgaccattcaccatcatggacaggccaatcacaggaagcagcacatatcgtacctgttagatggatctccctccccttgagcccaacggctcaagggggccttgacccgcgtcctgatcgggggcgcccagcccaatggctggtgggcccccgtcacactgtgccatataaagaggggtggaggacgggacggcaagagacacaaggaacgaggtttgtcgccgccgccgacacttcaccccataaaccctaaccgatctagggggcgcagccagtgac

SEQ ID NO: 18580 - DNA, 19527 bp, Oryza sativa
  unsure (1)..(19527): unsure at all n locations
agagaagaaagaaatccaaagcaaagaaaagcaaacgaaccaacggatcgaaaagatcgaaaccctaaccctaatcttacctcgtcgccggccacggagggggagaggggcaaagaggcaccgccgaggagccactcgacagccgcgcgcgcacccgcgggtgcacgcgcgcgccggcgagggggcccgcggcggcgccaccatctccgtcgtcgccggtctctcactcttcactcgcgtggaggggtgagacggtgggggggagaagagaaaagaatagagggcgtggcggcgcgagagcgtctgccatggcgcgacggcgcgaaggctgccggcgtcggcgacgccgctcggcacggggcacgcccgcaagagaaaggagagggcgccgcggcacaaccgctcgacggcggcgcactcacccttgagtgagtgcgcgcatcggcgaaggggagtgcgacggcgccgccgtgtcgccatgccgccgccggcgctgtgctagggttccggcgacggcgtcgccgctccgtgcacccgcaagagagaagagaaggagaagctagggtttcggcggccggtcggggcgagagggggttttgatccccgttttcggcgcccgaccgtccgatcataaaccctaagatcggacggccggtggcggccgggccaaaaatggcccaagaagggagcgcgcggcggcggttttcccggcccaggcccaagttgcggcctgggaaaggggaggggccgctcgcccgcgcgcaaggcggccgtgggccgaccggcaaaggccgaaaaaaaaaattcaatttaggtccctcggggccgaaagaaaaagaaaagaagtttaataaaagtccctcggccgaaggaagcattttcaatatgtttaatgattgtgtttatttctaagcaatttgaaccaacgtgaaaattgtttagataacagataaatgtgagaaatgcttctgaacatgtattttgtatattttcatgcaaattacaatagaattttgaattgttcttacatgttttacctctgtttaaatttgaaccaacgggagaatttttacagagagtaaacaacagagttttgttattgtttatatgaattgtatatagatcttccgctgcaaacagatgaaattgatgaaaattagtgtttctaaaattaaatttcgaaccaacgggagattttaattttaggaacattaattatgtgctatgatgttgtaatttttctgaccaacgttgataattgcaatgttatagttatggctttatgtgttatgtctattttctgcccaacggtgatgtagacttaatacataataattttaatgttaattttgttctcacaatacatgattatctcagatggctactccttgatgggttacattaaagatattccgaccctgaaaggagataactacgaagaatggaaaagagaactcgaccttgcttttatcttgggagaggtggactgggtgttgactaccccatgtcctatagaacctgctgaaattttcagaggtgaaaaagagtcagatgctgaatggcaaaagagagagagggacaatgcttccctcatcatgtcgtatgacattgagcatgcgaaatggtcttcagccaacaagaattgtttggctgcggtaaagaacacgattgagccaaccatattgggctcaatcccagagtatgacactgtctctaagtacctcgaaagtataaagagccggtttactggttcttcaaagttttatgcgacacagctgataaagcagcttgttacagagaggtaccatggaggtggtgtaaaagaccacattcttaggatgagcaacatggcttccaaattgaagcaaaaagatttgggcatctcagatgactttctggtccatctggttttgtcctcattgccaaagaactttgacaaccttgttgtcaactacaaaataagtacagagaattggaatattgaagagctcatctctaattgtgtgcaagaggaggaaagacacaaagagaccaatggtgactccattaaccttgtcaaagataacaaggaaaagagccacaggtcaccctcctcaaaagaaaaacagcctcagcatctgcctcagaagcaacagtttacagttgagacaagatcagtgtctacattgcaagaagacaagacattccaagaaagatcatcctgacttcctgacagtgatcatggcaaagaaaggtgagaacattattacatttgtaaagaatctcattatgattggttattctagatccacatggtggattgattctggagcaactattcatgtgtgtaattgtttaaagggattccgttcaatgaggactacgcaaagaagtgaaagatccattagagttgccaatagagttgaagcaaaagttgaggctgttggagatcttcgcctagaactcgcgaatggcttcacacttttacttccagacgtttttatgtcccttctttgcaaagaaacttgataataagtgtatccaaattggattttgatagatatgattgccattttggaaatggcaaatgtgaactatggtataataatgaatgtattggtcttatgttgcaagatcagctttatttgttatctctttctgagaatgtgaatgttgtgtcctcgttgacaaaagaaaagaaagcgaactcctgatgtctcatcgaaattatggcactgttgtttaggccatatttcgagggggagaattgagagactgttaagaatgtagttcttcctccattggagttctcagttttagaacgatgcatacaatgtatagaatgcatcggtgcccaaaacaccgtatgagctatggatcctccgtgtgtgggggagtcctgcaaaggataaagtatttaacccaaaacagtaagctgccattttattggctattctgaaagatcaaagggtcatcgtttctactgtccaaacagttatacaaagtttgtagaaacgagacacgccgtcttcttggaagacgaaatgattagggggagctcggtaattcgagaaattgatcttgaggagaggcgggtgtctgtacccgctccgtcgactcaggaacctttcttctctctacctgctaatgttgtgccagcaatgcatgccgttgcggtaccaacacctgttgttatctctcctgtggcaacaatgaatgaaagtgaggaacctgttctacaggattcaacagaaattattgccacatcagaggaggagctgcaacagcctcaaacagataatgtgccagaataggaggcccctagaaggcctgaaagagtcgcatatggaggatgatcccatctcatacgaagaggccatgagaagccatgaaagatgaaatgaaatcaatgaaattaaatgatgtctgggatttagaagaaattcctaaaggagccaaaacagtaggctgtaaatgggtctacaaaaccaaatatgactccagagggaatatagaaaagtttaaagtgcgactcgtggcaaaaggcttcacgcaatgagaagggattgattacaatgagactttttctccagtctcttgtaaagtttccttcaggattataatggcactagtggcacattatgatttggaattacatcagatggatgtaaaaacggcatttctaaatggagatttggaggaaaaagtatacatggcgcaaccgaaaggttttgtcatgaaaggaaacgaaaatatgggatgccgtataaagagatccatttatgggttaaagcaaagcttcgagacaatgctacttgaagtttgatggaacaataaagaaatttgggttttcaagagaatgtagaggacaactgtattgattcaaagttaagaatgggagactcattttcctaattctgtatgtagatgacgttctactggctagtagtgatgtcaatctactgcaggaaatagagaaattcttgtcctcaaannnnnnnnnnnnnnnnnnnnnnnnggcttcatatgtttttgggcatagagattcaccgaaatagaacaaagtgtgcattgggattttctcaaaaggcatatatatagaaaaggtgttgaagaaattcaacatgtacagatgcagtgctacacctgctcctataatgaaaggcgaaaagtatggggcatcgcaatgtcccagaaattcagtatgagctcaataaaatgaaaacaaagccatatgcgtcagctgtaggaagcctacagtacgcgcaagtgtgcacacgacctgacttggcatttgttaccgggttatttggcagatttcaaaagtaatccaggcctagagcactggaaattggtatagaaagtcttgcgtgattgcaaggaacaaaaggcctcatgatgtcttacagaaaagcagaatcgctccagatagtggggtattcggattctgactttgcaaaagataatataaagttaacatcgggatacatgtttaccctggcagtaggagctatttcatggaaaagctcaaaacagactaccactgcagggtctaccatgtatgccgagtttatagcatgccatgaggctacggggcaggtgaactggctaatgaagttcatacccggttttaaaggtggttgatagtattgagaaaccactaaagttatactgcgataaagaacccacagtaatgtactctcacaacaattagtcaagtggtgctgccaaacacattgacataaagtactatgttgtgaaagacaaagtccaggatcaaacaatcagtctcgagcacataagaacagaaaggatgctcgcggatccgctcatgaaaggcctacctcccaacatgttcaaggaacatgtagcatgcatgggttgtaagggaagccttatgaatcctggactatagggcccaaaagttaaaatatctgtttctgaatagagatgtgtatagtggctgtcgaatccatcggtaatcaaccgtgacgatgaaacatgctctatatgtaaatctgtgatggaatagaaaaagctaaaggaaatagtgagatcaagggggagaatgttagatggatctccctccccttgagcccaacggctcaagggggccttgacccgcgccctgatcgggggcgcccagcccaatggctggtgggcccccgtcacactgtgccatataaagaggggtggaggacgggacggcaagagacacaaggaacgaggttcgtcgccgccgccgccactccaccccataaaccctaaccgatcgagggggcgcagccagtgacgagaagactccaccgccgcgccaccacctcgccgggatcccctacgaccaccactgccgcgcagcaccgtcgccgtcacgaccaccatcgccgccgccgccaacgtcaagcagagcacgacaacgacgatggctgggacttcctcttcatccaacgcgtcaaccggtcacatccctaaaccctttcccttattctctattgttgttcaatcatccatcgcaaatagaaccacccgactagatctaaacctaggtgatccaatagacaactctaacagtaccattttaaactagcgcgtttctgtagacataagcattcccattcaaatggtcataatagatggctccaacgaccatcagccactgtcatcaagggtcaagatcgacaagagtgggacaaaacaaccaaaatgtagcaagcaaaattttggcagaccaatggtggggctgcaaagtttgtggaaagttctctggaaacattttagccttttgacaagctggtccgggtcaccatgttgttctccccacgatgatcacactcaattatcctttggttttgttcagaccatgttgcaaaaatttggaacgatattgctccaccagcgatttatccacgcttccttccccagccagctctttcttggtctttctttgagcccttcctctcttttgctccgaatgactatcatttctgtttttcctctttgccagggcatctgccggattatgtttactcgacagagttcgctgcaaaacggagactatgttaaactacttcgcttcatcgagatcgataattttgtggtgccgaaaaacaaaaggtccaatattacttacattcctatcagcggttggtgttgcatcttgtctatctccatccaacgcggtggttcccttgtttgactttcgtgctctttttgcaggcctttgatcctttcttttatcttcaaccatactttccacagtgccaccatctccagctgccgaaagatcctctgcaggcccttcaccagcgtagggtaacttagatgatctatcgtgtgattttctcttgttccctttgttgaaagcccttctgttatttgcatcagggccatcagttgcagactgatctcccagaggcctcgccttatcttgcgcagcttctcgcaacttatcacggcggtccttccaaattttctggagtctcactttctcaacgttctcaagtgcaaactccacaattggacgacgttctgcaccaaaagtttctgcaaatgacaaaaaacaacaatgtaactggagataaacagacaacactaaaaaaaaatgcagcagcaaacaagcaaatgctagttactactagaaaggaagggaagacattaagggtatagtatgtctctgatgatctgcatactgaggaaaagtgaaaactgcagctagagctaacagcagctcaaagacacagatagctcatgattggacaagaaacagcacagataggtagcgcgaagccatgaacaagtgatacagtgattccatgcaatccaaggatgcagcattatgcaataggcaagattaacacatcacattcttctcagagaaagacatattgcacattagaaagtaagtgagacgatcaggcagttagacagcatggctgcaacaaaacaatacttagaagcatttggtatagaaaagagtaccagggttattgtttaggactcttagagccacaagagcatgctcatgttcttgaaaatctacgaaggctacaccacgggaatgtttctgtgcagtactgctgctcttcttttcatttttcagaatatttacctgttcaagacaaatgcacatgcataagcattataaagatacctagaaatagaataaaacagaggttgaataaagaaaacccaacaaacctttcggatgacgggattttgcttgtgagcacgagaaataactgcttctctacaaagcttctttacatcattaatggtcatagtctttggcaggttgtagatgataagccttgttttggacacatgaaattttggagactggagcatttccgcttttcttctagctaacctacatgacaaaatcaaagatttcgtgagcattgttcacatgatcctttggccatgagcccatgattgagagcataataaaactccatcttaagaaagattactggacattcaataaaaaaactaaatacatattatagaagaaacaattgaaaaatacttgacaaaataaaattaatggaaaaagactatgattcaatagtttcatctgccgtacagagacacctttttattatagaaaaggttgagacaccacatgctgccaatgaattataaaaattgcatctatcatagctgtttattcccagagaaatattaacacacatgtacagtggacatttaccaatataatagaaccaacactttgcctatatttcttgtcaaaagacattggctatattggtactagctgtagggtgatctaatggtgcacagaaagaaggaaaagatcaactcttaccaactacgtttattcatgtcagcatcggatacgccttctgcagctggcgtcccagcaagtatttcaccttcctgccgcaacaatgaatttgagataggaaaattgatttaagagatgatgagagagtgagagaggggggaagggaggggggaggggggaggctctagtaaaaaggttaccttagtcaagtataggttacgtcgatcctccacctcattctttgccttctcaagttcctttttgtgagctgactccttgtccagtgctttcattatcttaagagccctgctctttataaaaattcccaatccaggagcagcattggcagcagaaactgctgcatcagctgcctctggtgtagagaacttcagaaaaccagttcctctaggtctcctgtatagatagcacaaaaacatgcattaatgagtgtacatgcaaacgacctctggttgatacaacagcaggaaataaaggaaatatgatgttctaacagatggtgaaacatactttgtgagtttgtgaagaactgggaagaaagattcaaccttcccaaatgctgagaagcgctctgttacctcctcattacttagatcaaaaggaaggttgcttatgaataatgtcctatccagcccagcgtcttgtttcttgaattttgtggcaggaagggtgttttcctcctgtgccacacgtttagaattttctaacttgtcagctgcaggtacagatgtaggtaaatgggtctgcttctgtttcttttctgatgtatcttgttctgtttctgtgtctgtatcaatatcagaaccctcattgccagatggttcagccctctcagatgacttgatcaaattttcaagaacctttcttgaaatatccatttcagttttgaaatcatcagcaggacaattggaagtctcctgctcaagttcatagctatcatcttctccaacaagattatcttcagactcctcgtcactgcctctgtctgatacatttgccagctctgtaggtacagcaagttcatgatatttcagcttccaaagtagtagttcagaaagcacaaagaattgacaggatttaagagggcacacggtgtattaaaacaaatatttagtttttaaacaagaagccagctggtcattttgaacaacatgaaccaccgtttatctgttgcctgagaaaccataccaacgaaatgacatggtacctttgccaaaagccaaatgtccatgttaaaatagctgttaagaatatcgttgaagtacataaagatattgcaggtcacaggatgaacgaaggcaataattaaaataattgatacaaaagtctatatatttaccatcatccttagtgctggattttgcagcaacagtgtatactttctttggaacagcccaatcaacagctacagttctctttgcaactacttttccattaacattttttatagcctgttaaagagaaaaaaatataaaatattaggacttccaaagattttttttttttttgctcttactgaatagggcactgacattttctgcatcttgtttacgtgtgaaagacacaaaagcaaagccttttgatgccctgtagaagaatgaatgcaacagagttatcatatcttgcaatttgcttaaaccgctgaagaaataaaggattcaacgcgaaacatacccgtcatcagacttttgtggaatggacacatcccatataaatcctgctaaactgaatatatccatgatctcctttactgtaatctgcaacaatgaaacaaaaacatatagcctctgttttatctcttctaggaaacaaagcttggaacaagtgaacttttgcattcaatcaagcaccttaaatggtagattccggactatcactctccatttcctgatctttgagccctgtatagcaagcaagttagaaacaactgcaggtaactggggaaatagctgaagagaaacatatgatagtggttccagagtacagataaacaccatgcaactcttgtgaagaagggggacacacaacaactgaaaattaggattttaagtaatctcattctatctcctacccacctattctcacagctgcaattgtagccatgcaagatagtagtagtagattataagtggagacaaagcggtagcatatctattgtgtcattcacggaataatattaggatctttctaactgaaagtgagaaaagcttgattaactcactgactaatcaatctctagaggcttgtacatcttttacagatacaaaaatggagttagcggtggtgatggtagtatcttatgatgaataatatagtagtgccttttgtgaacgattgcatgtcaccatctgatctaatgtgaactatgtatgcaatatttaaaatttggggatactaacttttttctagtttagaacttataatatttagtttagatccattgcaatgaacaggcactatgttggttctggtaaaatatctagtttacttattgcaggtcttacaggacactgtaactaactatatttgaaactgtagtcaggagatctgtaatatatgtggtattcaggacgttgccaggagacacagcagcagaaagttattgttagtttgagactccagaatttgaagttccaacccatttttaattagcacatacccatccgttttaaattaccgtactaattcatgatagccaccttaggttagaacataaggataattatatgtagctttgaggagaaactaaatgtgtgcacatgcactactacactggtaaacaaaaagtggaagaaaaacggaagtatttgaagtttgtttaattgtagaatagaacaagtctatcaagctaaaataatgaagtaatggcagcacatcaaggtaaatataatgcaagaagatacctctccaccaagctgacgagcccaaacaactgctcccttgacctccttacgatgcaagtgaacaaccgaatcccaagctgatttgacactggcaaaaagtacagctgctgcatctgttgtgcatccatctcgttcaagccctgttgagaatgacagccattccataaattatactgtttcaagaaccacatgctagtggtattaaaggagaataattgtgtgtacagcaggaactgggaaaatgagataaaacttaataagtcataccatggagctccatttcctcttttggaagtggatagctaacagatacaactgtgccaatctctccagctagacgaaatacttcactcgccatagcaaagtctcgaagaccaccgaatatcacagtttttgcaacccttcatcacaagcaattacaaatgtcatgctggatgaaaaataaacaattacagcatatatccatgaaaaaactaagaattttgtgaggttatggaaaccaaactagaatgggatgggggaaaaaatcagcataattacttaaattgtttttaggtaatgttatggcttgatggtatagaatatttgagtccacacctttgcttttctgagcttttcaccttagcagtattggaaatgctgacttcctttgatagtgtagtttcctttttcaacaactgtagtggttctggttcagtaatacaccatgaatcagaaaattaaagcattgataaaatttaggaatggaaacagtgttggaatcgaacaattttcctttcaaacctgtatctgttttatgagatgtctccttgtgttttgcagtagaagtagcatatgcttcatttgttgcattggcatccttggcttcatttgttgcatcagcatccttggcttcatttgttgcatcggcatccttggcttgcacggcttacaagcaaaaacagccaggcaatcaaaatctcaatcaattgaaattcagaaccaaataccagaaatagaaatttaccattctccttcttctgtaaacgttccttcagtggagcacgatgcgttgctagcttaactctaatttttctaccagcaacagagaatccatccttttgctgaatagatcgctcagcatcttgaacagttgcactgtatcaatgtaaatatgtcaaaaatgtataacagattacgcgtcagttttatgccttatgcctatatattttctgcagaaagatattcctacatgaataatcacacgacacatctgtaagagaaacaaaaagatcgagctaaaccaacctcttgtgatttggtttgtgcattagtacagtacataacatatggtgaaagcttcgtgcagtaacatacttgtaataagaactatcggtgtggggctaacttctgtgagggacctgataggctggtattaaccagacaccatcactagagacactgaataaatgtatttccgcttagcattaaacaatttgctcactagagcattacactactcacgatcaaaatcacttctcgaattctggaattgtggcaagaaagggaaacacatttccatcggaaaacaaccagaaaagcaagcaatgaaacttacaattgcacgaacccaaagcctcgctcgtctctgaccctgcattagaaacaaacacaacccaattactccctgttaaacagccattgaactcactgtcactgaattctcatacctttcggcgcgaccatgaagcatcgcctcaccggcccgacctcgttgaacaccgcctcgagctaaaaaaaaacagcaatacacaccgcgtatcacagcctcgcagaccgaaacagcaaaaaaatgctagccgcatagcttcgcaggggataaggctttgggattggggctcggcttgcgcttacatcggaggacttgaaggtgtacggcaggttggagacgaacacggtggaggggctgtggcctccggcgccgccgccggtggccgcgccgccttccgtggctgctcccccgccaccgccgccgccgccgcgctgcttccgcttacccatcgccggcgtcgtaggggaggaggcgtgtgaacaagctcccgtactcgacgaggcgagaggttttgttgggctaggccgctagggtttatagcttagaatgggccattgtttttgtcggaccggatgtcctagcggtgtatgcttggtttgggcctgtttgcgttaagtgcaaaaaggtccactttacgtccctcaactaatggtcgagtgctcgagtttcatttacatacaactatatactccatataaaaaactacgatggtgatgggagtaaatctgttattctacttgtgcttcttcggtttttataaattgccgcttgatattttctgatactgtagaatattctaatatttgattcaagtaaataccatatatgcaaataagcaaacaattacatgcttgataaaataatattatgctatgatattataatatattttttatctataacaaaacatagacattttctagtcaactataaaattaagtatagattgtcctaacttctaaaactagtgttaatcgagccatcaatattaagagtagtttcaactgacatgatgcttatcaaacttctaggcaccatttaaaaaaaaaatgaaacttcatcaacatttcttaataataccttttcattaaatcttcaactttctaatatcttatccatcatctctactttcgaaataaaaacttggttctgcatatcatttttcagcaactttattttttttccgtaactttataacacaacagccttgagacatgtttaagggagcttttggtagctgaaaatttttccagaacaagaaccccgcgcacacacaccaaacggtctagatttttgttcggattctgataagttgtagttgtaaaattcagaaaataaattagaaaccataaactaaaaaatcgctccgctgtattattagaagtaacaacttctcgtaattttaagttccctgaacagatccagacccttggattatgaaataaccaaggtcactaaacacaccctcatctaacgggcaggcagctcgcccgtgacgcgtgccgcgtgcgtgactgccagcagcagcagcaagcggaggagaggagagacgcgccgccgccgccgccgcctgcgaagcaaagcggcgagcgagaagccaacggcgcatcaaagtgaggatatggagaggggcgccgccgccgcaggagcgctctcatgcaccttccgctccccttccccttccccgacgtccccggccgcgccccattggcggcctctcctcggcttccgctcccgctcccgctcgcgtggccggggctggggccagcgcgcggtggtcgccggggcaccgcggttattcctgccgccaccatgccggcgcttcaggtagcgagctccctgctgtctcttgttcccttttccttgtcctccttgtctcggttgggattgggagtattgctcctgcgctcgcaagctgttcgatgaaacgcctgtgctttttgggggtaagtgatgatgccgtcatcttaggaatgggattaatcgattaggacactttatatagtatggattaggactggcaactttggatcgttgagcctgttcaatctcgtgccagtgaaatgttaactttgacagctagtagctttgctatggttggttggaggcttggagcattcggacagttctttgtgcttgtcttaccacctttccgggtttgacaatgtacattaattctaattttggatatttcagtctagatactttgagcttctagcagatgatgggcaaaagctagaatttcgaattagctgcgaggatgaaaggggttaaattagcatgtctccatgtcaagtactttcatggctcaaagttgcgggtggcttgttgcattttactggtttagtaagtgtaacgttaaacttgtgcggaactttctaacgtcaggcaagaagtatatcttgcccaagtctagcctgttggcaggtgaagccaattaaaattaaagagattatgtggaacaactgtgcccattggatatttgcaaacgaaaaataatttgtgaataaaacttttatattacgtgttcttagcgatctaaaagcaaagactgaaaaataaactttgatgaaaaaacctcaaaatcaactccaaatttaaggttgaaaattcaaattttggttgataagcataagcgaaaagatgaggccgtatatttgacgtgttccccatgtaaggctcactattgcggtattgccatatgatttttcccactggtaatcctaagatttcaggattttatttctctcttacagacctcgcataaagctatggtttataatcacatcaataagagtcgatcttttatgtttactgctgtaaatgcttaataatgtgaacttggtttctcatttaaaactttaaaatttctcttacacacttgtagatactgcagtcaaagcaagcttctaggcacgaacaaagggcaaaacagatgctcgttggcaactttcagctcatttggacagtcagggatcagtctgaacaatgaagatttagtgaaagataagctcctaatagattgtggggaagatcaagattgtgtgattggtatgcactatgtttttttttcttcagattatttaagtttcatacttgtgtgcttattttgcatgtaaaacctataccatgcacctccagtaagtgataattgcatgccaaatctattatgggcagctcatgtccttttctaaggctgcacatatactttcttagaaaactctgcacaaatcttgcatgaggctaggattaaaccagattttcattgggtattcaatgcatgtttcagatgggatagttgccttgggaaagtttgatgcccttcacattggccatcgagaattggcaatgtatgcttctaaggcaggaactccctttcttctttcttttgtgggaattgctgaggttcttggctgggagtataggtgagtgtaaaagaggctattcataatttcccttggtaatcattagccccaaataactgagtgccttgcttgtggcaattcatgactgctttcctttcatgcaggcctcctatagttgctcagtgtgatcggaagcgagtgctcacctcttgggctccatactgtaagaatgtagtgcctattgaatatcaagttgagttttcaaaggtcaggtacctaactccgcggcaattcgttgagaggttatcaagggatcttaaaatacaaggtgttgtagcaggtagaaacatgttgtcttctcttgtaggtgcactatcttactgtattgtcataaccttttacaatatagctttgtttgttattatgacaggtgaaaactacagatttggctacagggcatctggcgatgcagctgagctagtgaaactatgtgaagaatttggtttaagtgcatttattgtacggtcagtcatggacacagctagatcttataatggagttacaacctccgtaaattcaagcgacaaggggcaggtttcttctagtcgtgttcgccatgctttggctatgggtgatatggaatatgtttctgaattactagggaggaaacaccgccttgtgctgacagttaaggaaaaccaccttcaggaaaggaaaaggatcatgctgccaaaatcttgcatgttgaacatgccaccagctgatggtttgtatgagaattgtgaccttcttaatggaggccatcttggactatgcagggtgatcataaactcagagaccattgtaattgagatgaaagatgagaacagtttattaccaaatactattcaagaaaatcagcaattaggtattgaatttggatgatatggtacagctcaattcatgattggtgacatggcaggtcatattttgtactatatcttcattatatctggcaccttgcggattagtttgtgttgatgctaaatagtgctgattttatctggaggggatatagagcaagaaagaaaaaaactgagaactttgtattcaagggtgtatacctcatcgtgatcaagccaaagagcatcttatagatgaacagagattttgtgcaaatttgcatttcatgcaacgagaagacatggtagtcagagaggacattgtcctttttctccctgggaattggcaacgatagaactgactagcttctagctagctgtatcagcaaagctgaagcacaaggaaacatacaagggaactcatttcccaaatcccacctagtacgtttttccagcttatgaaattgtgatttgtacaaataggtttcatttacacagcaacttcccattgttagatagcagcttgttccatcaacagttaatgaaatatgttgcttgatcttcgaacatctggagaggtctggtccctaacaacgttgagtttagcctaatctagcttatgaaattgtgatttgcacaaataggtttcatttacacagcaactttccattattagattgctgcctgttctatcaacagttaatgaaatgtgttgcttgatcttcgaatatctggtccctaacaatgttgagcttagcctaatcgatcgctggcgtgtattggagctctgaaaaggctaccggacaaggtaaaactctgtaaccttaatcgtctgtgtaggtccgtcagctcacaaggtctcagacaaacagttcatactttcggaacatagttcaaattcaacgccttcattgctatgaattaagcaaaaggtccagccagataaatagaaatatgtacctccaaagttaaaaaagttagaaccctaaaattgttctttgacaaaaaaagaaaagaaagaaaaaggatatacaacaatgatactctggtacacaagttgcgctgtacagatctgagcttcccaagggtaaagcttattgccacctgactaacccaaacatgtcacaaaatggaggggaggccccgctttgagcgtaagatgcacaaataacaacagatgcaaagatcctttaggccagaggcagctgagaccaatggcttgtatttcactgaacttccgcaaatatgactcgagacaaaaacaacacgtcgtgacgctgttcttgttttgacttagtgcacaatcaggtagtttttatttgctcatatttttcacctatgctcccacctttctgcttctggaattcaatgtaacgtaaagtgcttgcaaagaaggcctctgtcgatggatcagctacagtgttctcactttgcttctctgtcctaatcaattcaatcaaatcctggattacagtgttcgtgatctctggaattcctttctcgaagaagtacaaatacctggaaataatagaagcatgtggattacaacaatagcaatcatatgcacaagagaatatatcagactaggtcttgagattacttgttcaaaatttcgataaatagcgcgacagatccgctacttccccttgttacattagccatctgttgagcggcatttgcaattcttaaggcacgctttaaacaaaggaggaccctggaacaacaattcaaagaagcaacaaataaaaacttgtcagttttcatagatacaagaatataattcaaggataatgaatatatagtagtgccttttgttcccatgaataattgacataaccatgggaaactcaaaaggatattgcaagtttgctgtgtacttgcgtgtgcacctgctgttgctgacagctgcagctgtgttttatctaccttgtgatcttttaaaacagtttgactcaccacaaaattataatagacttgtttccgtatcattaggaaggtcctaacatttcatttgcaagaacgaactaaaagttgaaaattacggatggcataactagtctacaagtttcaacaaatcagtatgcttagaagtttacctttcaccatccattattccgtcttggtcgtcagtccagaaaaggtgtgaacatgcataaaccgctcggcattggtcaggtttctttagaagttttgctgagtactgcacaattattcagcaggatgttattatgtgcatagaagagactgatttgagagagagagagagagagagagaagagaaaaacataattcaataaggaaacagcatagtaattgttacccctgttgtcttgtgagtcagggtatctctattttcaaccccgaatatattcatccgttgaagggttccaattataagatgaattgcagtgatttgagcctttgaatcctgcatgtagcatgcaaacattgtaggtcgaaaatcgtatagagttataaaatgagctattgaccctagtgttggaatgcatattgcatgtgtttatgatatgatccaggggttatatcaaataactcaattgaagtaatgtgacaaaatggatgtgcacaaggaagggcaacgcagggcttataccgcaatttcttcttcatataagatgaatgcttgagtaaagaactcataagcaaccggttccagatcacaatcattggccgcctgtaatatgaaaggtagttacatgatatgcagagttatggaaagcataaatcaattgttacagcaatacctctgcacactgcagatataatctgagagccagttcaggagaaggaacacatgagagagcttcaatggtctgcggatgaaaaaaatgatgagaacattgatgagggagaacaatatccccatcaacagatttatagccctcatccttatgcaagcaagtaaatcaagccagggagagtttctgtgctagaggaagttggataaaacagttcacacttatgt

SEQ ID NO: 18581 - DNA, 1135 bp, Oryza sativa
tttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagagcttaaggtcaatctacacagttgcacgcaccggatatctttaattcttctcttctttgaattactgccctgtgtatgactggtaccttagcatggttgccaatcgactttttctgctgcttgtcagtgatttcgaggaaggagaaatgttagaatacggatgaactccctcactgttgtaaactgcacggatcctgatcatctgggttttactggagtagtagaaagtagaattggtgccagcaaacacagtgaaagttgtctgaattttatctgcccctttttatcttgtttcaatatgggagt

SEQ ID NO: 18582 - DNA, 15418 bp, Oryza sativa
cattataggtaattattgtataaattttgactattaagtttactatagatgatttggagttagtagttgactactgtaaaattgctctaatatatgtcatgtcagaattcagatagtgtcaaaaagacacttaggttgagtactttttgttcactttctcaatccatctatctcgttttttatgctcactttttccaaactactaaacggtgtgttttttatataaaagaaattatataagaaagttgctttaaaaattatattaatttatttttttatttttttatactcagttaattatatattaatgaaccaccacattttctgtgcccggagatggagttcagccttaaagttactacctctccttcattctcgctattttgctcatccatacaaaaggtccaaaactaaccaaaatggagcctctgtcgccaactgaggctgaccggcttaatgtacttgctgttaggcacacagttaatcctgcaattcggagttacataagtttttaccgtcccagccttaaaacgattgcatgtacggcgggcaagaaagcagtaattattagattgtccaattggacgacgctgtacctgttgttgcgtcctctcctctggttaagaaactttattaagatgtcatatactgtgcgtgcatggtagagcctgccatgcatgcagcatgcatcgctggatcagtcagctggtgttaagcatagctaggggagcgatcgatcgacgatcagtacgttggggggctctgatttatggtgccacagtaaaacttgaagttgcactgacacgcatgcacatgcaattgcatgatcatattcatagccatagagtatgcaatattgctgcgccagatgctttcatgcacccttcaaattcaagcaaaacaccaagcaagcatacatgctcccgggctcccttctatatcattcattacacgggtactgaattactgaaacttcaaaaatataggtgtagtactagtaccacgtaatttatttcttgttacccggtttgtatatgttgtgactattccaacgaaattgcacgcgtacaccatactacggacggcaactcggcaagtacttgggtagctgggcaacagatcagttcgcgtacaggctcatcgactacgtaccaaactacatacgtataaatgtacttatacaataactatttactccatgtttctcgcgcagacgtactccatccgtctaaaaaaaaaagacaaactctgggtttccgtgtccaacgtttgactgtccgtcttatttaaaaaaattaaaaagacaagtcacacataaattattaatcatgttttatcatctaacaataatgaaaatactaattataaaaaaattcatataagacggacaatcaaacgttggatgcgaaaacccagggtttgtctatttttgggacggagggagtagtacgtaatagttctccaacggccaaaaagcatgtaccaatagtatagtatagtggagtattatatactattaactttgtactctctctctcgtttttttcaaaaaaaaaagggtttacgcaaaattagtactctctggctagtccccttataaggtttttaggattgttcgactttatagaaaaatgtaatattatttttaacataaaataaatatatgataaaaatgtattcgatggagtataggtttagtagaactaatttggtttttttatatcgctatatttttttaattaattttatcaattttaaagaagtttgatttggaataaacatataatttcctgtaattaatatggaatgggggaatacctagctagtaatcaccaggtcaaaaaaaaaaactatttaacgctagagctctactatatatgatgctctgtgtatgtaatctaagtacctgcagactctagcagtatcagtgtaccaccaagatcgatgatcgggcactactatctcacatagtatatacgtacatacggaccaaccccatcatccagtagtacttgacagtatcattttcttcaacttctaagcaagcaatgaacggtcggcacacatgcatatagttgtaagtactttcgtactactagctactccatcagtcctacacagcacacagaagtacctaagataacccggtcgtgtgcatacttgcctgctgcctcccgtgtttttatccaattcgaagcattgtacgagatgtgtaaagtatactacacaactctaacatttttttttttttgcatcgcaagacgacatacgaggtcgccgggtcgatccagagtttggtccgtcctgctcgtattatatctgcacagtacagtacacatggtaaaatcagcacccgccagtgaaacgcgatcgaccaacgtacgtacgttcgccaaggccgatgtgtgtgtgtacatgtgtttgtgtgcatccagaatcgtacaaacggccggggtctcgcgcagcagcagccagctagcgggcgcatgcatgcacaccgcggcgcacaggctgggccgtggcagcctgctgccgcgaatgaatgccaagtcgtccgcattagccagcggcttccggctttcgcaggtaggggctctctcaggagttcgtggccctgacacggtcagtgcactgcgcgcgcagcgcgcccacccgccggagcccggcgccgcaagccttttccagctgcggcgtttttgtccgagccgcgcgcgcgcagggtgtgagatcgattcaggggcgcgcacagcgagcgaaaagagctatactcccatgcgagaacgaagaggccacgacacgtccattaatgctgacacggtcatgaaagtgctcacggggaggcgcctccgctcccaagtcggtcgcgcgcatcatatcgtcgttcgtccggacgtccgcggtcgcgcatggcaaaaacgccaaagcgcgagcgcgatggagaaagcggcgacgccgacgtacggatcgaccaccgagcctaccgccatcacatgtcgtacacatgaaacgaaagaacgagcgacgccgcgaccgcacacgcctagtccgtgccgttgcggtgtgaggtcggctgcatggatgcgtttcgtgggcgcgtgtgtgggggtggggatcggaggattcggccggtttggattttactgctgtgttgttggccagttctaatccggttcggcctatcttgtgactttgtgatatgtgagtcgtttgacgcttggcaggccgtcggatccacacgggtccaaaagcgtcgtcacgaatgggcagtgggattcactatcttgcaccttgtttggtagaactctaacttttatatctaactttagaagttgggtctgaagtggagttgtggagctgacaaaaactagctccacctctctagttcatttcgtaagagagctccacccagctctgctcccttttttgtggagctgaaaactgtttggctgagctccaggtccaaaaaaagatggagctggagctgtgtcaaacagatccatatagtagtacaatctagatccaaatgaagcgcataaagcctctagtattagtaactttttctttttttagaaacacaagtactagtatattttagtttttttttaagataatggaataactagtatattttagttagccttgacattgtgaaggcatgtacaattattaataatgatatcttaatattgctaatttggaatatttaattgttaacatggaagagagaaagtggataaacaaaacattgttgttatggttaacaacgactcaacaataactcttagtcatggttgcataagagtgaaaaaataaacataaaaataattaaaaaaaaaagaatattttaaagttaatggttatagcctatcatcttaacaattgcaaagatatagtatctaaataagtttgtattgtctaatagcctattcgtattgggggaatttcaatacataggaatagaaaaagcggaggaattgaataggagtgcatgcacacttcaatccataggaaattttccatgaggtttgtttggatggaaaatttcctttgttttctctctataacttgtaggaaagaaaaaaattcctttggttttttctatatatacattgctatgaatcgaatgatattcgtaggaattaatccttaggaatccaaatcttttgaaattactctaaaacgaatagtccataagagataatattgtctctaccatttgaatatgtcctcgattcccagcttaaggtcaatctacacagttgcacgcaccggatatctttaattcttctcttctttgaattactgccctgtgtatgactggtaccttagcatggttgccaatcgactttttctgctgcttgtcagtgatttcgaggaaggagaaatgttagaatacggatgaactccctcactgttgtaaactgcacggatcctgatcatctgggttttactggagtagtagaaagtagaattggtgccagcaaacacagtgaaagttgtctgaattttatctgcccctttttatcttgtttcaatatgggagtacttgcgcaagcacctaccgggagggagcttaacatggtagtggcacgcatatatttgaatcgcatgctgatttacaaacttgagcgtacgaaatgatgcaaagatatttcatcgatccagtgcgaacatttacatgcggctctgtatctatcgtggcatgttggggaacgatattagaaacgaattttttttatttataattttttttattaaaagttttacaaaaataattttctattttgaaaattgacggaagtagtcgcctaccgccctctgggaaggcgaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaataggcggcgagggggggcatggaaatttgcaggcggcccccttgccgccctcggcgagggtgattttgtactgtgcggggggccgcctgcaaatgggcggcgagggggcatggaattttgcaggcggcccccttgccgccctccgcaagggcgattttgtactgtgctctatatttttgtataaatatcaatagttatcaaatctttttatattgaaaactatacaagattaaaatctccaagactgataaaatacaattttattattttttagggcatatttggattgttaccgtacaaatattttgttaccgtacaaatattttgttaccgtacaaatattttattaatttttagggcatatttggattgttagtgccaaatttttcttcacgaccaaatatttggtaaggtaaaattgcatttgatcatatttggtttgctgccaaaatgtaaaattgtagtgaagaatgttctacataatctcaaatctagattacgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtaaacaggaagcgccgaaagttgatagtgataactcgagctgccgcttttcatgtgtgctgttgtggactgtgcgcgctactggatctgacactaccgtgcagcgccgaaagtgtgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccgtgggagtacgtgagtcggtccgggggtacggcacggccaacccgtcctgcctgtacaggtgtgacctctggctgctcctgagtgtgtgcctctggagctcctccaagctgagaggagcctagtacgtcgtggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgtggaagcgccggtcgtgcctgcgaacgcgctcgaaggcagacgaggtcctgcgatgaggaaacgtgcagttaaaacatggtgacataatcgtgcaaaagctgaaacaaaaatgaactaatatctgggctgaactgtaccgtgcgaaaccggtgctgtaggtcgcactgatccgaagctaggggcgctcgaaggcaaacgaggtcctgcgaggatggatcatcaagttacgacggggtgatgttttcgtacaaaaatagaaacaaaacttaagaaacctctgggctgagcagtaccgtgcgaaataggtgccgtaggtcgaggtcctgctccgacggtaggcgcgcgaggccgtggttgtaccggaccagctggaggtacgacgtccacggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataacaaattcagtagttgtcctatattatgcaagataaatgaaataattgtaagaagtaatacaaattggatgtaccgccacgaagtagtctcggtcacggtgcgtgggatacgcgtccgtgacagcggcaacgtgcggctctggggcgtctggagtgaaggtcacacgcgcacgagtgcgaggaaggtaccaacgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctggatgtgagcgtaacgacgctgcaataaacatgatcggaattagacatgttatgtgaagaaaaaaaaaagacgactgataaacttataacgcagcgaagttgcactaaccccacgtcgacaccagtaagtccccatcgtgggaccgtcctctggccactgcgcgctgcgaccaaccccatagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcgtcagggtgtagaaggtccgcctacaattaagaatgaaatgttagtacaaaacactcattcggtcgcaaataagcacgtatgataataacaacttatttacttacagtgaactggagcaaccaagccttgctaggcccgactgtagagtacggaggaagggtggtggtcggtcctaggtgtggaaggcgcatcacctgctcgaagcgcgcagtgatatcctccttccacccaaaaacaccgtccacgggaccaactgctgctcccgccagcggtagcccgagcaggtacgacacgtcctgcagtgtcggagccatctccccacagggaaggtggaacgtgtgcgtctcaggtctccagcggtctacaagagcggcaaggagtgaccgatctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgttaatcccacggttcaacagcgccggtgtgtcgtacgccatacctgcatcaaataggttgatcagaaacatataaataattagttcaacataagtaataaatgttgaactaagcgaattactaacacatattaaacaagagtacaaacaaacaaaagtgtttagtccgaacactcatcacgataacattatgatacaacaccgaataattcgcaatactactagtacaacaatagtcggaggtactcattacaacaacattgaattgaaattacacgatagaagtatttagtccgaacactcattacatcacaacagcattttatttcctaaatcgaaagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaatcttccctctccatttcatcaacaattgtaccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcaatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctatgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttggttttttttggatttttagtgaatataatgaaatttcacagaggagggactgggctttatggggggagaggcaaaaatcgccctcccccagggcggcaagggggccgcctgcaaaatcccatgccccctcgccgcccatttgcaggcggccccccccccacagtacaaaatcgccctagcggagggcggcaagggggccgcctgcaaaattccatgcccccctcgccgcccatttgcaggcggccccccccacagtacaaaatcgccctagctgagggcggcaagggggccgcctgcaaaattccatgccccccctcgccgccaatttgcaggcggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcaccctcccagagggcggtaggcgactccttccgtcaattttcaaaatggaaaattatttttgtaaaacttttaataaaaaaaattataaataaaaaaaaatcccgcccaagtaaagcagcccgtacaacaattttatcccaacaacaaaatgggccggaaaggcctcgtgggtcgtctttttttctcgggccatcagatccacggttcctacttccaagttccaacgccgttttctcctcttttaggcgacccagccgacttcgccggccgaaacctgccttacggcaactcatgtcttcagtgacctaacagcttcgtttatatccatgcttatataagttaaaatttaaaattgattttctggtttttgttgtagtttattttacaacgtttacatttatatcactaagtagtacggacacatataaacgttttacttataaattactacctctatattttactattttttatatgacaccgttaaatttttacattacgtttaaccatttatctcattttaaaaagtaaccatcttcccttttgttgtggtttgatttattactaaagaaaatttaagaaatatttttattttaagatttgcacgtaatttattaataagcgaagtaagcgtggctcaagtagtcaggtttgttgtggcgaaatcaacctactcaaattcaagttctagacttgatacatagaagtgtaaatggctaacccgtaaaaccaacttatatgtcaaaataagtcacgaacctgtttattttgatccataagtggattcgcggcttacccatttatacccctattaatacgggtgctcgcacttacgactaaattattctttcagtgatagataatgaggcgtccataatgattttgtaaatctcaagatatgatgtctgtctttcgaatgtgcttatatagataatgtgtgcatgtatggtaatagcggtagagtgtgaacacattgcttgcgagcgtccgtatttaaaaactgaggaaatatttttttttgctaataagcaataagcacaagtgtaattgaagaatgggtaaacaaatcaagtgatttctccgtaactacgtacactcacgccggccgaatccctcgtctacaccaccgcctggttgcgatttgtcagttatagggcgcaagttcttctctaatcgaattcacgcgggcgcggatatggacgtcgactgtacgctccggcttgcgcgtgacgaggcgagaagctctcgctggtttgcagtaggttgccgatctttttccgcctactattagtgagctcgagtgtggctgcctggtacactggtacgtgttggacttacgtaatactccgctctactgttaccaaaccttggcgacaactctactgtacggtactgtcatacgcatcacgtaatcattgaaaccttagctgctagccacgcgcacagttgggcggtgggcacgaccgcaccagcactaccaccggccacactttgcacccatacgcatttggtcttcttttgtcctacaaaatctactgctaagttaccgtatcgttaggaactcatgatcatacgtgcgtacaagtacaacgaacgatcacatgcatgcacgctcaatcgatcccaagcatgtaggagtaggaagagtacttaattaattaggctaatgaaatgaaatatcttgatctggtagtctactatatgccattaggctcgatgagattaacaccagagattagttcacctcaaaatccaaaagacaggagctaataggtaggaagttcactacacggcgagttttgcctgcttctcggcgacctccaacgacgactcctccgtgatcgtgcaagtcgagctcctccggtgcgacgagcaggacgcgagggccgggtcggcgatggcgacgatgacgtcgatgaacgccgccaatatggcggcgtgcgtgtccttgccgttggctcgcaggtaccatcccagcatctcctccagccagccccagttgccgaccccgtgcgcgaccaccatctcctccatggacacccggaagtccacgtacgggtcctccgactcgaacgccaccgccacgccgccgatgaaggaggcctcgccggcggcgtccgacgacttctcctccagtatggagctcgttgccgacgctcccgggtcgaagaggagccggtcggaggagcggaggccgcgcacgatggcgtcgtcggccgtgtcggcggcctcggcccccgccgacgcctcggacgccgtggagaggctgtcggagcagtcgtgccgcgcggaggaggtcgtgaaggaggactcggcggagtcgaggaagatggaggcaatggtcctggagcccgggggaggcggcggcgccgtcgcggcgcggaaggactgcgtccttgggttcttgcaggacggccacacccacggaggtgcggttgccggggcgggaggcggggacggcgaggtgtccctggccttgttgtggaagaaggagctcaaggccagccttccgatgaccattggtacggtgtgggtttcaagatgaaccggccggaggacagagggtttggtgtgtggctttaaaacaggggagatatgacacaaatcgtggacacgacgcggtttggttttaaaggagctttgggagggaagaggggaaggggggacggggatgaaagaatagttctgttgggcttttcagatttatggcctgtttacatggcaaaaaaaattatcctacatgttacatcagatatatggacacatttaaaatattaaatgtagtcgaataacaaaacaaattgcagattccgttagaaaactgcaagataaatttattaagcgtaattaatctgttattagcaaatatttactgtagcaacacattgtcaaatcatggcgcaattaggcttaaaagattcgtctcgcaatttcctggcgaactgtataattggttttcttttctacatttaatactccatgcatgtatccaaaaattcgatgtgacagcgtgaaaaaatttgttttggaactaaactgccacttacttgtatatatgtagatcttcgagaatattttttgaaaattagagtatctaaaaatccgtcgcaagttttctaaataaaaatatttcatatgttaatatagtataattgaagtgtaattatgtaattgtattgtgaacttgtttggtagtgttccactttctaatttaactctagaagttgggtctgatgtggaattgggtctgaagtggaattgtggagcatcctaaacccattttcacatctctatagttcattttgtgagagtactccaaccaactcgacacctattttaggtgaagctggagctggagccgtgacaaacatgccttggaactacattgtaattatgatataacttctataaaatttgtattcaacaatagtttggttgtcaataaccgggatcttacgcgtgacaggtgtaaaaatatatttttaacaatttgtttccttcatgcacaaatctcaaggcagtccactcgtcacaaatctgaaagttttagggacaaaaaaatctcttggaagttttctagcaattttgtaaaattaaccaaggccgcatacttcattttacataatattgttggattttttttctagattatttccatattgttatactctgtaaaaaggtttgggctctcattatcagccacaatgaaaatttaaatatctgaaacctttgagctgattttaatttaagtcatagtccacctgaaaaatggtttttctcgggattgagatcctctaaccctttgattttaaatcactaattaacatgtggatccgctatctagagagcccatatgtcagtgacctacgtagtcgtcagagagaattaagttagaggatcctcttctgtagtcttgggttctcattgtccaggaagacactgtatgtactgtcctcatacttgagtatccatgacttgatgatccatgtatgcattggttcatctgaaaaccaaaagggtgcaattttcagaacagacaacccaaatgaaccttgcaactcatttggcacactcagacggacgatccggattatgggggcaagacccacagtcccacacatgtgcgttcataagccaaaaagagcaggatgctgagacacaaacacacaggacagcgctgatacatgatacaccatccattgaaacctgaatggctaccttgtcttgcagatggaaagacgaccgggtcttgtagcacgaagcatgtaaaactgcaaaggcatttcgtgcttcaagcgaatgtttttccggccatgtttaacgcaaccccgagaggggagcttgaccctgtaccctgtccacgttgctctttcatggttccatgcaagatcggaggccatgtctttgcctcctgcttcattgcaagtcgtgtgtggctcgctgcatattggtagcgaactcacttcgccttgccagtcgcagggtggatggatgatgcacaaaagttttca

SEQ ID NO: 18583 - DNA, 5494 bp, Oryza sativa
caagtttcaaagatgttttccaggcagctgctcacgtatcagtgttcctgcagtcatttatggtagatgtgcttggcaaaaggaattttggtggatacgccatactggctggccctatccaagttgtctgcaccatctgattattggcatcaccgttggcctaccacggtgcctttttcttctgaatcctcaatttgaatcaggccaaaatgcacgagtgttaggaatattcaatattgtactccaagattggcatgactctgtactagaacattcagcgtgtaaacgaccttattaatttggattgggatcctatgctgtttgaatagggaatttggaaggctatatgcatccagaccagcagggaccctctgcaaattaaatatggtgaaggttgtggtttataaggcatgcaagtccgcaagagcccactggcccctgaggacaaaggtactgaaaatattgttgttgcatagagattttgttcaagggtcagctcaatactacagaagattgggatttcggatcatgattttgtatgattgcttcgtgaattattgatggttcggtataccgaattcgcagtttatagtacatttggaggatatattggggtctacacaataaaaattctttcgtcttggtttctgctagacgttcaagctgaacaatcatatcgagtgcacgtacccgcgaaagctaccagtcgtctgttatgtggtatcccaaagccggtggagtataaggactgataaaaacctccttgaaattcctcaacaatactaatgcagaggtgtacgtaccatcatgcctgatcgctaggatcatctgctggaaacactaccttcagggtaaaaaaaaacacgtagcgctagtatttgacgctaatatatttacttagatttcattgttttgaactgtacgtgtcgagttaaaaaaatgaatcgagaaggcatgcatgtacattttgggttaagccaaattgccactcctaattgacgagtccgtactgataggttcagagaagtgatcattgacgaaatgacaaagcatctgtgagcccgcctgcccgagacgcctggcaccagggttcatggctatcatgggacaaatatcgtttttggcactattgtctgaagaaatgatactgtagctcgttctttctgcaagactagctgccatcgttaatttgcatccttccaatgtgcgtctagctactaggctagtactctaaaactaaaactttaaagaaaatctcttgtataaccttaaaattttagctaatcttttctatgtccctgtattttgcttacttctttgtatacccaaaaatatgattttgatcccttccatacccctcccgttagttgaccgtctaatttctataaaaacaaccattttaccttttggatgaacatagaaatttatgaattatgttagttgactgtctaatttctataaaaatgatcattttaccttttggatgaacatagaaatttacgaattacattactggaaatgcaaaagtttattggatgagactattatagttatgagttagacgtgtgatacattatttatgaaaaaaatatttttagataatgaaataaaaaatatgtatttattttatttaaaaaaatcataaaaataaggagcattcatacaaggatagaactacgaatggtcaagatttttttttaatgaatgctcccgataagaaaatctattgtcctattaaatttcaaataaaaattttaatttattatatttgttttattttcaaaatttatgtctaaattttccgcactaattatttagtctcttttttacataaaatgcacatattgtgcactcaaacaaaattttcaatggtttttaagcttatattcaaacctaaattatcaagggcattaaagacatttgccaccaacttaacggtgaaatgaagaaaaatgtgacggcaaaagcatggaagggatcaagttaaaatttcaaggggtatagaagggatcagataaatttcaggggtataaaaaaaattgagtgagttttcatgggtatacaggaaatttactcaaaaactttatcaatgcatttaccaatcatgcattcatgcaaggttgtttagcttttgatttttaccgcacgcggaactataattatctaagcattaactattacaaattcataaaaatgagtttatttgatttttgagagaaatttctatatatttcttttaaaaaaacatatcgtttagcattttaaaaaagcatgtgcaccgattagcaaaagaacacaccttaaaactttttgcacgatacttcctctgtcgcgtgaaaaacaaatctaaaaccagatgtgacacagaacaaaagtgtaacatctggttctatgtcacatctgtaaaaaaacgaatctatggattacccgtcgtctcgtcggtttatgacaatgatagcgtaattcatccaaaccgtctgagacgatgggtttagcctctaggtgctgtaactgtaacaggatgcaagacaaatgtaccaattgtatcggtagctcaccctctctcttcctgtatgtcctggatacagcgagggacttttttaccccgaacaatgcagaatccggcgcatgcagctatgcagatgcagggcaatggcacagcaagcagcacagacgcccagaatccacgaaaaagatcggcacagtccacatggaggctagccttgtcttcgtgcactagcatagcataccaggaaacagcaaaccgggccaggcttgccgctccgatatcttctccggtgtgggctacctagctccgcggccgcggccggccagccggtcccctcccttcaatgcttactgccctctccgccatgattgcattgtgcgccattgtccagggctccaggccgtgatcagcgctcgctgctacgctcagaccaacacaggaaattattacttgctccctactactacgtgcaagcagcgtaaagggggcaggccactgtttgaaattcatccctctcaccttttgaaacagccgcgcgtcgtgccgctgtagtagtgcagctgtgcaggtgcagtagctttgggtcaaaactcaaaactcgaaagggagacagcaccaaaaagatactgcggctgcagccacacagggctagctgcttgacgcagagagttcgtagcgacgttgctcgtctgggcatggcagtcgcgcctagatcggctcgtgcacggcatgcgttgcttgcctgggtacgccaccacctgcgcagccagcgatcatggccggcgcggcgtcccacggcacgagagcgagcgcgcgcgcgcgcggcactctcgtgaaggcgtacgcgccatccggccgcgcggcgcggcgcaggccggtgcagcgtgcaggttgacccgcgacaggcgcacggccgcacacgcggtgcggcgggccggcggcctggatttgggcggagttctcggtggccgtcgcttttcccgtgccagctgacgcgattacgagccgtacccgatcaaaaccggcgtgatcgccggtccgatgcatgcgttttgttttcatgccagatctttggtaatcgttagtacgactctctgagtccgcgagtacgctggtttctgttaattgcagcctacagtattttctttttcttttttgcctcggggaagcgatgcgagcgatacgtgataatttcaggtggcgcagtgccgctgtgcatgtgtgaaatcatgcaagattggcaggttgctagcgcgcacgtactcctctctggtgtgatcggtttcaggtgatagagacgatacatgggcataccttgacacggagtgggctgggatggcgcgggtggtccatcggctacagccttacatgctcctcctatcaaactctcgttatgtccagttcacttggcccatccttggtttcctctacgactagtgctcctctagccagtagccactacccactgtttccatattggcgcacgggtcatataagatggtttgttcctgttcacctgacgggaaattctttctcctaaaacgatatcgaaccatccttatccggattggattaacgagatcgtcgtgctaagtgtgctaacacacttgttatatgaccgttattccgagttcgtcttgctgctgggagagttgcagaattgtagtactcccttcgtttcatgtgacaagacgttttgactttagtcaaaattaaattgctttaaatttgattaagttcgtaaaaaaaagtactacctccgttttacaatgtaagtcattttagcattaacgagcatggtggctcgcgcaaattgcgcggctagcatcattatattttctctcatataatagcatatatgttttctcattatattattcaaatatattaaaataacaatataattttaaattttgtaataacattacaaaactactaatgtgtaatattcatattatattttatatacgtgttagttattaattatttttaatatcaaattttagttatttataaattatatatattcctatatggactctagactcgtcttttaatatttctttttttaattctgaattttctgtaaattgtatttctatatagactctatgcccttcttccaatattattttttttatttctgaatttttattatttctaattgtatttctatgtggactctaaactcatctttcaatattctttaatttttaatttcgaaattcagttactctaaattgtattcctatattgactttaaactcttcttcccatgtttttcttaatttcgaattttagttatttgtaagttgtatttttatacggactctaaactctacttttaattttattatgtttattccaaattttagttagttttaaatttctatatggactctatactctacttctaatattccttattttttaattctgaatttctatttcttttcttaattgtatttctatatggactctatactctacttctaatattccttatttttaattccgaatttcagttatttcctaattgtatttctatatagactctatattccacttctaatattccttatttttaattccaaatttcagttatttcctaattgtatttctatatgtactctagtctcctcttctaatatttcttattttttttaattccgaatttcaactatttctaaattgtatttctatatggactctagtctcatcttctaatattccttattttttaattccgaatttcatctatttctaaattgtatttctatatggattctgccttttctttttctccgattaatgtgagaatttctaggccatgagagcgaacgtggaggctcctttttctattcctttaataatataactagctaggtggcccgcgcaattgcgcggctagcacccatataaaattatttttttacatgattttacttaaaatttctgaaaaatttatctcgttgtcttaagatt

SEQ ID NO: 18584 - DNA, 19201 bp, Oryza sativa
tactgacacctctctctccatcacggcatttgcatcgccagatggctatacaacagatcaaacaggtcatgcggatctgtaaccctggccacagcaacaaccgcaattcatgagcacttaatcgttttctctaggcactatgtggcattcatcgtcactttaattgccgtgaggttaccagctgatcttttaggaggagggatttaaggagttgttggagcttcactgcatgaacttggcttgcgactactaggatgccaggtttgcatcttcgattctgcatgccaggcgaactgtgcttgtgctgccttgcgctgccgacgcccacgctttgaatgcaacccgtagcatctctgcctcctctgtttttagccttagcccaatgcttctctagtaggcgtactatttgatcagtgatcttcagaattcagatgcgtgcggagagtgaggaggaagaagatggcgcgataatctgaagtgacgtagtaatcaatgtatttactcactgtttgtcagaacacgattactctgtctgtagatgcaggctgtattgaagcgaatttatctgcaagtgtgctgctatctattcggccatgtttcaattcatggtggtgtcgacatcgtaggtaaagccgtagtaatagtcgagtatagtaccgctactaatactccaaacttccagttggcaaaattgttaggcagaggacatgacttaattccgtgtgcagcagacgtggagcaacgcaacctggtaacagcctgcgaagttcgccgcatctggcgagcagagctgttgcttcttcggaaccgatcgatcgatcgatcgttgtagcagcagcaagcaacgcattcaagcgacaagggttggcaagcgagagagagagagaaagagagagaccgcgcgcggtttaatcgcctgacaccaatccggccatgcgcgccccctccccgctcggcgtcgctgcacaactgtctccaattactcgtgcatttatacggcttaaaagcgaattaatcggcaataggtctccctttgaatgatcctaaccaccgagcatctttccagttctccctcacgtcgcgtcacaggagaaaagattgcgcttccgctaatctgagaactttggtttttgtaggcaggagcagtggatcgatgattgcgtgttccttgttccaagcaggttgtgtttggcaaacaattgattactcagatgatatttgtgttaatctctgagtacatgacaactggcaaactcacaaaagtagtaacaaaatgtcacctgaactagaagtaaactgaacaatttcaggaggagtgaaagttaagaatgtttttctcagacacttgtagaaagctaacaacaaaaattttcattgtctaaccatctaaattaatcaaattatgatttacgaaaagaaatggaactgtctgaaagactgaaatgatattcgtatgaaccatgattgcgataggctttcatgctctcacctcctagtctccactagagttgtactcctgcattatctcgaagcacttccagtgataagtaacaacgtcactgaaatcgttctttaaaattggacaaaatcactatgttgataagcatacaatcacttctcccaccacaaatctgtgtctgccgatgccaaaaaaaaaaaagaaagaaagaagaaaaagggtgggcaacagaactcatgccatgtcacatgtttcatgcaaaagtgcaagatgagctatcacatgctagaatatatgatccccaccaatccatcccagaattttctgaactaaacgacaatagtaagaaaaataatacaaacagacttatttcctaccttttctgttttttctaattgaattacctgtccggccttgttttaattatgtccaagactctaagaccagagtctattaacatagtgcacggtgaatcgcgcgcctcaagcaatatgagcaaatatctgctttaaaatactgcttgttgttactttaagttgcttggtttcattaaaactctgacagttcatcaatggtactccctccgtttcacaatgtaagtcattctagcatctctcacattcatattgatgttaatgaatctatatagatatatatgtctagattcattaacatcaatataaacatgagagatgttagaatggcttacattatgaaacggatgaagtactaattattttgacaactgggaaattggcatgtaagtgtttttcttacattatattgtttcactgataagtggtctctcactaacatggatggcatccacatgtaatgtactaatgtggcaatcctgaagtgaaccttttcaggtcatcaagggtgacaaaccctcaatttattttctcattttttaggtcatttgggttatctttcagatggatgtatgccttattttagtttctatacaacaacttgcagttaaaagaaaaagatatatttcttatctaagaacagttcccttcggttggaaattcagtttccggctctgtaattttagtacaactgtgtacaaatgcacatgtattcaatcaatcacattacacattgctgcaacatatttatgtaccattcagtaccacagaaaagggtcaatactatatgacaggacaagagcattacttccattaaatgatttaaatgttgatgacatgataaacttaaagtctttgcactgttgcacgtagctctcagctgaacactagaacaggaaatactactgaaacgcgaaattattacctagaccaattccgtttgacagggtgcaccgcacgcaagaaacaggtctatgaaataattcctttcgggatccacgtaaactctgatcgatcatgaatgatggtaattaaattaaagctacgacggcgacggtgacgacgaagaagaactaaacgcaagaactgagcccccggctgttgcaccagctagctagcctcgccgatcggatcaccggcgttggcgcgggcggcgctggtcgtcgtcgttgaagtcgagcagcacggcgctgtggcaccgggggcaccggggatcctcccgggacagcatcacgtacatcatgcaccgggggcacccagccagcaccatgggcggccccgcgccgccgcccgccgcgtccgggctgccctccgacgacacgcacgagctcggcggcgacgcggtggacgacgacgaggacgacagcctgcgcggcgacgtgttcgcgccgttgacgccgccgctgtcgccgcccgggcgcacagtcgccgacggcccgccgccgccgccgccacgcgccctcgacaggctcatcagcctcaggcactccagcttggaactcttgccgttgttcctgctcatcctcgccgcctccaccaacaccacctccgatcactgcactcagctacgccaacaacattagcgagacagcacaagttcacaacacacacgacctagctaagctagccactatccaacaatatgacctagctagctagtgacacattgcactaaacttgttctgaagaaaaattcagtcacattgcactagaccaaatgcattacctcggattctaatatagggagcagttcgacgtgttggtggattggagctctccacttggttgcatatagcttttgctaggtaggagtatttgtcatgcaccactcctgttgttatataatggggaggggttgaggaggaggtgggttttcttaaaggcaagaacagccacatttaaacgctggtcaattccctccaagcctctggagtctggacgctgtcccgccatacttgtattttccattaatattgtagcttttctggagggtggaaaaatattggagtatatttattaattaattggtggatagacgtgacaaggagcaggtgtttctgtagatcgaaagggaagcacttgtacgggggtatgttaatgagctagctggaggttccttaatgcatggcctctgtaacaacatgaagtactaccattcatgtaacaagatgatcgtaaaatctatcatgtaatatacatgagcggggtattagtgtagaagtactccctccgtaattataaaggaagtcgtttaggacaatgtttaagtcaaaccttgggaatataaataatgaataactctcaaattgttgagtttaaaaatgtaaaaattatatgaatagatttgtcttgaagaatactttcataaaagtatatatatcacttttcaataaatattttatagaaacaagaagtcaaagttgtgttttgaagaccgtgtcgttgtccaaaacgacttcttttacgaatacggagggagtacacatttgactaaacatttttcttaataaattaggggctcatgacatctctcacactcttggcgcagctataaaatattcattctttgattaactccatggtcagataggattcacccttcaaatttttaaaccgagtacgatgtactcctctgtcattttggccatgtttttttatcacctaaagttgaagggtgagttaaaacattgggcaaaatgacagaagtactaatggggccagcactattcgtctatcttattagcatctcgctgtatgagaagagggcctaactgctagttgaatcctatatgcttcatggaaaataattgtgtgcaatccagatcacaaaagatcggtcaaaccagcggaggaaataattccatcttactagtgcattcctctagatcatttgaccggaaggaaggcatgcatcccctaatcccctaattatgagggtgtttattggcttttcaccgtactttttggttcgtaccatccaaaatagcctctgcgaaagtacagtttcaaaaaatcccgatccatgcatgattatgccatcatgcgcagatcattgcagatcatatgcgacccattagtaaaagttcagagactggcctgaaattaactgtagctgccggcctgcctgccgccgaggtcactgcgcctgcctagcgtgcgtgtccagccccaagggcgcgcagtcgcgacatcaatggcattatggccctgactccgcttattacgagttacgacacggcgtaagcacaaagctagtcaggcgacgaatgaagaagctctcgcgcgagacggcgatagagagagacgtgtggtatagctggcatccatccatatctcctcccctcgcggaggcggggcggggcggggcgggcgcaaccgcggcatgtgccgggcctttatgcttcgccagagccctccaaatagaaccgggatgaatgacgatgatgaggcgtcttgatgatgtgaaaaaaaaaaagtttccggacgtccaaagtaagtgcaattgcaagcgcgacgcacagttaatctgctcacaggcgtggtgcatttaggcacacagcttgctaatgaatgaaaccgcgagtaaattagctacagtatacgtgcaggcgtgcagtgaatgagggggctggctggctgcacggttcgcagatcatcgtgaacggcttcacgcaatttgggcctacgaggaattctttttagttgggcctcagttttggggaaaagatttggcccacgatgaactcgctggagagtcctggagaaaataaggggaatttttccgaaaaggaaaggtaaagaacgagaggtgaggcgcatggaggaggagggagagaaagtagtggcctgggcgtgcgacgcggagggggcgggcgatggagagcggcgcgaacgcacggcggcggcggcggctggtggataggggatccgatcgcctcgccttcatcaccggccaagctcagagcctcccctccgatccgtccccaggtaaccacaggaaagcctgctcttcctctgatgaacaaacctcaaaatctcaaatcgcctgctcttatatgggtcttgtgaaagatgttgcttccgcatccagatttgattcgcgggattactgtggttgtgatagggttagtattaagttcttcactagggaactatgcgtgcgttgcctggatgcgcgcaactattaggaggattgctgcacatgttatgtacagatctccaattaggtgatagatttgaattttatttttgcgaggcagaaagccaggaactgcctacattgcagcgctcgttctgcgacttgtaagttaattagtccctctagcccctaatataagtaattttgatattttgcttacactatttgatcattcgtcttattcaaaaaaatttaaaattattatttattttcttcgtgacttactttattatccaaagtactttaagcacaactttttgtttttttatatttgcacaaatttttgaataagacgagtggtcaaacagtacaagcaaaatgtcaaaatcccttatattataggacggagggagtagtttgttgatttactatgttgagaaaaaggagggatagaaacatgaaatagtttattagtttgttgtcaggagtaaattcttgtcctattaatgaaacaggatgtaccttgtaggatagtacataattaggtgctaggaagtgtgctagctgggtattttctttatctacaacgttttttttgcctaatactccagaacacagagttgtatttgtatacggcgaagacctatgcaagcaacgtttataccaaattaaccccttgtcgggctgcctcctgggctctccctccacactaacataaagtattcctagacctttttttggagagattgaagatgaaggcaaaaagactttgatacccctcattaaatgatggatggttggctgtgggtggatgattgggggaaatttcaaatgcttggaacccttatatttgtggacagagggagtagtaagtactcaagtgtagtttgattaattgaaccactgtctggagtgtacaaatttcagaggaaataacatttttgagacaggaatccttcatactcattgagttgcaactaagggagtccaatgtaacatctctttccacttacctactttgtaggttccttagaaaattgtcacaatgaggcatgataagtagtaagtttgtaaactttggagatatttagcatcatgagttttcttggtacttctcgggctctgtctggtattgcacttagggcatgttctaaacagatgttagaaacggatgattagtcacgcgcaaaacgagattgtgattagcatatgactgattgacataagaaaaacattttttaaaaaaaggcaacttctatatagaaaactttcgtacgggacacatcatttagcagtttgaaaagcgtgctaacagaaaacgaggaagtggccaagctgatccccactttagaacaggcccttagttgtgataatggaactgataatccagtccactaagtttcacaaaaagataatccaatccacacagatgataagaataaaatattgttctcaaagaaaatgtagcaaaatttgactgttggaaaaattccacagctgcctgtgttgctttgatgaaaagcacacacattgcagtaccataatcacaagctgaacttttattatgcagatttccttagtattgtcatttttcctactctatattgatatcaagcataatgctgtccatctattattgcctaacaactagttcatcacttatggactattgataattaaatcgtcctagacttctatttgcatatcttagtagcttacacttggtttaagtgatattcttgtcatttttgttttcacagttgtacttgaaagttaaaacatatagcttcttaaatgccacatcttaacagaattagttgctattttgcagattcaccactttatactgttgatgctgcttcccttcagcgatctgaacgtcagctaaatgaagttggcattggtgatgacatattcaactacataactcagttgcaaaaatcagaatctggtgttcaaccgactagtgaggcccacctggaaactcataaagagaaacaccaaggtaatgaaagtgacctccaaaagctcaagacaagcaatgtggttcctgaaattcagccagtaaatgaaaaggcatttcaaaggcacagtgaggaaaccctcaggaagaagaacagtcatgacagatcggcaagtacacagcctatgagggaaatggaaacaagatccagatatgtgcctccaaatcagtctaatcaatctgatagtgcaggttggtctgtggaaactctgaaggaaatcctgaatttcgcaccacatgagattacccaggccatatcagctacagagtataaccgatttttggcttccgtcatcattggttttctggtggttctttcaaattgggggctggacgttggtggcactatcaccaaagtattagttgctacaaggccaattctatttcttattgtaacgaacataaccattgtcttcactttgttgatggagaacaaggaccccaacgtgaggggtagaccagctggcagcaaccttggttctgctgataacttaggccaaatgctagagattgggttgctgctacagaaagccctgagcaccctcctgatagactgcagcgtttgcgctgtcatcatgatctgttttatttgattttgaggggtaccattgacagtattttacggaattgcttgtaagaacgccaggtaccattctgtctatcgttcgaatttggagccctttttgctttatgtatttatctactgttttctgcatatatgaatatgtataaaccttgtccaagagaacggacgcgtgacagagtgaggttggtatcagtctatcagaggaccaaatttctctgtagctaaggatctgataatttgatatgctgatgaatatgggaaattttccctgtaccttaatcatgccctgataagcatgcaactcgacttggcagtgcaggctacacacgcagatcacgcatggtctgcagaaatggatagctagacgttgcacagtttgatagctagacgatggtagggacttttggagtttagttgtgtgatgaggtgtgacctctgaactacattggtcttaaaatataatgcattttaatcatatggttatatgggtaaaatcctaataatataaatctggagatatatctcgtgtttatcacccggattgttcttgagttgttgttcctaatacttgggttgttcaaaattactgtattttagaacggaggaaatggtggtaaacactgtttggagttttgtgtggtgtgatacataggcagatcacgcatggtccgcataaatggatagctagacattgcacagttggatagctagaagatggtaaggacttttggagtttgtgaggtgtgacctctgtacgacggtgcgttagcgacaaaagagaagcccgcgtttgtttgcactgccaagtgtcgcgcacttatcaaccacgtgccgcccaaaccctcggaacggtgccgcactgccgccaactacgtggcgatatccagatgttcccagcagtgcatgcttatcacaacacagcaccgtaatgactatgtaaaatgatttcgacagcatcattcatcaaaacaaaagcacaaaacccatattaacagtgacatcttcgtctgcatcaaccaaacctagacacgacgttgccacgtcaaaccccattagtccttgacttagctaatcctaattaatgctgaaaaacctaaagcccaaaccgtgtgccgaccggagctctcaacagcctctgtttccggcaagtaggccgtccacggttatggatcagagagccccaagtgacaaacggtttgacagtactacttgcctatgttgtggtgtaggatataatgtacacgtcatcgcctaccccttgcttgtttcacttaatccaaagagttgcaaagaaagggggtgggtcgccgtcgccgacgctggtcaaggggtggtgatgtcatggatgctcttgcgcttggagtcgcgggcgccggcgttggcctgccggatgaagtacttctgcgcgtggctcgccacctgcgtcggcgtccgcgtcctcaccgagaaccgcgagatgttcctccagtctccccgcccgtacctgtccaacccctcgagaaacaacctgcacacacacgcatggtggagcaaaacgaagtgaatttacacgggaaaggcggttgcgattgagggggggtggctggcaggtgggggccatctgccagctgggaagagtttgttggtttctctcggctttgacgaagcaatgcggaaaagatcgcgagaaaaatcgagaagcctctggaacagagacgagcaggggaggaggagggaagggaaggagacgagggtttgaggtgtgcttccgtccgtacctgtgctcgtcttcggaccagggtacgccgcggcgccgctcctcgccgcggggcttgccgccgccgccgcggcggtcgttgccgtcgttatcgtcccaggacccgggggcgtcgacggcgccgcgcatgatgagatcgatgtcggcgacgagcacctggtagtgctccaaggcctcctgcggcgtgcgccctgggagctgcgccgcgacgagcgcccaccggtcggggacgtcctccgggcacagcaccagcgcgctctcgaacaccttgtcctccaccttgctccacggtcgcctcgccaccggtcccccgcccgccgccgcgccgtacaaatccatgccgagtgagtctcccctcctttcctccaagcctctcggtcccttcccgtggacgacacaaacacggacgatcgcggtgcgaagtgtggtacgctactgctgctacgagcgacgatgatggcgttgcgtgtgccggtgggtgtgtggatgggtgggcggcgccgtgtgttgttgggcttggttcgctgcggctacgcgtgggaaacggaatttataaagatttcgcttgggggtggggacggcgcgggtgaggtggatgacggggtgagctcgagagaatggaacggtgggttgggaatcccgtgggggttttttgtgatgctctggccgcgtggacgcacacgttttgggcgtgcggtcgggtgcgagtcggcggggccatgggccatcggggcatatcctttgtgcgcgcacgggcggcgccagggtcggtggacgcgtgcgcggagggccgaacggccgtcggctggcagaggcggtggcgtagcgcgcggacggggttgctttccgctggattctgggattctcgttgagttcgtttgggcacggagcgtcttacggtgggttgttgttttgtttcattctgtttttgaggtgtcacagtactcgtttggaccaacggaattgatattctaccgtcgcaggaaaattgaaggggaaagtttcgagtcgtcgtatccggtttgagattcgtgcacgcaataggtttaaaaaccaagcgcaagaacagggccggacattgcttggtggtacatcatgatttttattttactaggaaaatacccgtgcgttacaccgggtaatatcgcagttgatgaagttgaacttgacgatgtacctggtgttgtgattaacaaaaaaaattatttaaaataggtatttttatcatttttatcgtaataccgatgaataatcaggatggataaaaatacttttgggtatttatttatagcctcgtagtggtcacgcgtgttttctcgctttgtcaactctcgtgttgcaagcatgcgtcttagtttccaagatcatatgtggactcgcgtggagaccggtcacgtaacatatgatgattttgcgcaatttttttcacaatcgatattttttatatcaaacaattgttttttccttccttcgttttttttattttccggtttttcatacttttttatcatcttcttttctccgttttctccgtaagatgaagatgaagattaagtttttttatgcaaaacgaggtggtattaatgtatgattgattgagttttaattataacaaacttgaaaaatacattaatatgatattttagagaaacttttatataaaaagtttttgcttgaaacgcaccgtttagcaatttaaaaagcgtgccacgaaaattttaatcttcatcaacacttgttggagaaaagaacgagacctaaattattctgattttagataattacataattaaaaacagaataaagattagcgaggagataaatttgtgtggtatgtcgacatccttatcctatcactccctcactctatcgttctctctcccattttgtctgtcgcagtgtcgtgtccctctctctctcgtagaggtggccaaacgggccgggccaaaacgggcggcccgaggcacggcggaacctgtagccggcacggcctgctacagtaacgggccgtgccggcacggcacgagtagccgtgccgtgcttgggccgccggccgagcccgcgggccggcacggcacggcacggctactgtagtaagtccgcatctcatccttccgcaagtccgtatctcatccctcccaactgacggcccagcccgctagccgcctccgcaagtccgttgagcacccctcctagctgatggcccagcccgccagccacctccgcaagtccgcatcgcatccctccgcgccatttcggttcctgggccaaccgtgccccgtccacggcccatttttcattcacgggcccgtactgacacggcgggccacacgcatgccgtgccggcacgggcacggcccggccatccacgggccgtgcttgggccggcggctcggcacgtgggtcaggacggcacggcccgtttcatgagccgtgcctaacgggccgtgccgaaacgggccgtgccggacccgtgcccgtgccgtgccgggccgggccgcccgtttggccacctctactctctcgttactctccaagcagttcctctattgttctctctcccattctgtctctcactctctctcaatctctcgttactcaccaagggtccaaggtgaccgacagtggtgctcgcttggatcccgcggttctgccgtcgacggcgacgggccggtcagatccaccaccggcccaagccgtggttgctgcttcctcgcgtcgatccagccaccaccatgttcatctccatcgttggctggcggcggtgaggctggtgagcggcggttccggcggttgggaggctcgagggcggcgacgaggctggtgggcggtggattcggcgtagggaggcgaggcagtggactcccgtagccggcggttgcccagcggaggtggtggcggcggcggccgcgccctcccctccgctagatctggcaggaggggaggcagcgggctctcgcggccggcgcctacccggcggaggcggtagcggcgccggcggctgggccctcgatgggcggcgggttcccataggcggtggtgtcactttctccatgtttctcctcctcgtgctcaaatgctctcgatggatccgtcgccttcctccttctgctacttccttcctttcgttctttcctctcggttttctctcctctccttcgccactcagcgacgccctccttctccgccgatccccctcctcgaccacccaccgacggcgcctctccctctcctccgctccccttcctcgtccccccaccgagcccgccggcgacggatccaattcccccgagctcgctggcgatggatcggccttcgccgttgggtggcattcgtcatcgtaggatcgagctgccacaatggtccagttcggtgccgagcagattggggcggtctcgtcctttaggcggaggaagcggtcggagacgaggaggccgattgagtcgtggatgcaggatcctgtgggtttttcttgtctcgtaatgtcctccatgatcactatttggtctgattggtactccctcgtatgacgccgttgactttttgacaaacgtttgacctttcgtcttattcaaaaaatttatgtaattataatttattttattgtgatttgatttatcatcaaatgttctcatgacataagtatttttatatttgcacaaaaattttgaataagacgagtggtcaaatgatgattaaaaagttaacggcgtcataagtatttgttttgttggatgtctcaggatatggtgcagtggacgaatctggaggtggagttgtacaagcagagctgttcggtagtccggataggagggttcaaattgtcggacgaaggtggacctctatggattttccaacaaggatgctgctgtggccgccggatccagtgacaattgactcccccgcagtagaggtgcttgaactggtgagtttttttaagttgatttgagttttcactattttttttgtcataataattagatcagaccctagtttatttgatttgtttggtttgagtagatcaaccaagagcacatgtgtaggtggagtagtgtaacaatattgattaaaaacttgtcttgttactctatattggttgaatgcccgatgctttcatgtgatattttttgttgaaataggaaacaatggcatttcagcacatagagacaaatacatcttaactaatcaaagatgagattcagatctgtaattttcatcagtttcaggacacatgcagtatttgacactgtctaattctatgtcttccaactgacaccaaaacttttcttgcgggtcacaaatctaggttcactaaacccaaaggcttttgtagcaatgggatgccaggtgctagtggttacttgagcagctatgggggtgatggtgggtatggcagtacaccaggagcccaggaagaaaatatatggtcaataggtaagatatatggtaagttcaatccccacaccacctctaatcgttgcgcaatattgctggttatagattgattggtttatgactggtactatatcaaatatattactgtctttgatatgttatctctgtaggaatcagattactgtcatggttcttatattgtgcacttccacttactgctagctagcttgtatcctgtatattttagttagtcaagtaatagtagcatgaaaacaccaaaacattatatgtctaatctgaacaatcattttgagtagcctaattgattgcaagctcttgtgatgattttgctgtgtgcatgatttatgttctgcattcatgtgaatgtctgaattgaaggactcgtctggaacttccacgttgctacgtgccgctgaacaactgaaaaaattggttgttgctaacttgaaaaaattgactgttgctaactgttctacatcgacgggaaaaaaaccatacatagcattggttgtgcatatgaaaggctcagctaaacattctcttctgaaaacaaggctcatgtatgtctggttgacctctttaatttatgtataaaaacttcatgtatgtctggttgacctcttttattttatgatggtactgttagttcgaattcataagctgacttatcttatgaaattaaaattgtattcaggattgagttggttgataacctagaatcgacattgattggagattgcttgacgtcctagaggaagagccttgcgattaatattttcttgtgtgcttctattatttctatagcctgattgaaaggtggcttgatgtcctagaggaagagccttgtgatatatgttttcttgtctgcttctattatttatacttctacattatattgcctgtaatgtaatgtaatattaaattggagtaggaatcggtgtgggggatactgaacctgtgcgcgcaaactggattagaatcggtgttgtttttttttaaacttgggcttgcgggcttaatctggtagactggagtaggaatcggtatgggattttttttttgcgtgatttgctctagagtaggaatcggtggtgttcttatttttttgatggggtgggaaaagtagtgtcatattagattagatccgatcacaaatcggataacagaaatcgcagttgtgggggctgcggtggaaaaaacggaaaacacggacaaaaaaaagggttacggacgaaaaaaggggtttcggactaaaaaccgcgtggggtgaagatgtgacgaaaggaaaaatccaaatcttttaattattattaagatagggtactcttttttgttccaaaaaattaaacttgtgatataatgtgatctaacctaatacaacgaatctattcatattcaaattcgttatactaggttatatcatattgtatcataggttgagttattttagaatagtgaagtaatttatccgacctgtatatgcattgactggaaaagatgtcagttgttgtaacaaaggctgccaaatatgtctgttatatagttattacaatgtaatttaaaatgttattataattatattatatattttttaaggaaaagttacgataactatactttagatagtactctcccaaagtaaagctgtcgtcattcgtgggcaaagcatcgacccactgcatttgagcccgatacaggcattagcccatggaccgtatatacggcctgaatagctttcaccgggagcccaccatagcagcagcaaatattttctggacggttgacaagtgggcggcattttgtttccggtgggcggcttttggggattccggtagcgccgattccgccgacatccgatgcgggaccggcggggatacagaccgccatatgccgcggtacagcagccaaatgcacagcgcactccgactgaaaccgcggtgtttcccctggctttcctcccgccttttgcggattcgtctcaccgaaccgtgcaatgcgatgagcagcggcactgctgtgttcctggagcgtcctgttcttcccatcagcactcatcccgtctttaaagatttgatccagtcttatcctaaattagttggcaccccggcgtcttgccgcggcttcgtagttttattgtcaaacaaaaacaaaatcgtagttttattgtcaaacaaaaacaaaatcgtagttttaaatggttagatacaactctatatataaacaaaaacaaaatatatgataatatgtctttatatatatacattatgttactataatacaattcatgttttattttttcaaacgtcattgtatattgttataatatatgaatattattttcatgcacaatatgggtaccgttgtagttagacgatttgcatatctctgcttaattcaagctttttctaaaaattgatttaggtaacgatacctaataattatatactatctaatcatacataataaaacaaaacgcacaccttaaacaataatttgagttgtattcagaaaacatggtgttatgcacaaaataatataacagtgctatgtgtgactatgaggtggagcaaagggatgtgattgaataactaataaatgattgaattagatgaataggtagtttcttgatccaatggttgttatctttgtagacttgtagtaatgtattctgatggcttaaaattgttgatgatgtggcttcttgcttgtcttgctttataggagtaaatgctccttagtgagtactaactatatagtactccctccgtcccaaaatacagcagtctcatgtccagattcgttggcttaggatgggtctcatccaatactaagttgctatattttgggatggatggagtatgataggatatgaaacatttatacgattataattacccgataagattcttatttgaagaaaaaatgaatgttaattagagtacaatgttgttttttttcctgaatatgatctacccaaaaaactcttcttctgcacataatttgtatttgatgcactaaccaagtcgagttgtctatgaaagaatgatcggctacatgtagggttaagattggtttcagcaatggatcatggatgtttttttttaatttactagaaaaatgctcgtgcgttgcaacaggtaaatgctattttaattttattattgttatatggtttagctaagaaaaaattcattctgcgaattcccttggataattttttcataaaatcataagctgctattatgagtgtatttcatctcaagttagcatgcgagttttttttaaagagatttcttatacgattcctcttgtatttccaaaagaaaatgagcttaaaatctaactcaaagatggatatatatttttaaaagtgaacgaatttaaaaccgactcaaatatggatgacgtatcaaaataccaataaaaacatcttcgatttttataatagtaaagatttcattcaatatgttgatgtgaccatcaagtatatgcatacaaccaagcatgagaaatataaaatattgccaaagaatacatcggataaatggaggatctacaggatattaaagtccaatgagttttggaatccagttcggcctccggagacagcactgatttcaaacggacctagcgccttcatgccaactccgatttgggtgatcttggacttcgtggaaagcttatctcgctacctttcaaatgcatccagtctcacgtccaaattcatctcgagtctacgggaatcgccaaaacaagacagtactgttgctgaaaccgaacttaggccttagaccttgtaatagactaggcccatctcggaagtgtctccctccacctccacgaattagcacttaaccctagctttattttccgctataaatagctttgtacattctcaaaaacatttgggttttgtttagttgaattttgccaagtgccattcaccttgtctctagtcctcgctcgattagtcggcgactattgattcagagcccccaatagttggtgtgttgatttgccgggtcgattagatctaccacttcaatcgcaactatttctttgtgcttaatcacctattcgcaatatttagattgcatcttatcttgttcttgcagtgttctctcgtttgcattgcaggaatcatcaaccgcgcgtcacggttggtacgacatcgtttgtggtgtagcgattgcacggcgttctggacttgttctggttggtagccacgtcgcaaacgtcgcactcgatcaaagtgagagttatcccctcaccagaagatcgggccacgagagagagcatcatcagttggtatcagagcttcagttgcctggtgaggattttagttttgtaattttttcccatcatccactatacagccgcaccactttttcctttaccaaacattagttttgagccttgtaattttcattcaattttgctttattgagt

SEQ ID NO: 18585 - DNA, 12644 bp, Oryza sativa
acttttgcgctgacattttttttttaccgaaacggatggcaggagctttggccattcatttcagatggactgggaataaaactgtaaacttttaacttttgtttgtctgtttcatgaaactgggaaatgcacatcttcatgcgaaattaagagaagaaaaaaaccggggcaagaaacaatggcacggcctggaactaatgctctgttgatctcaacactgtttgtagttcagcaatgtccaggagctaactaatccatgaaattattgttcacacgaacgctggtaattaatcagtagcgatctggtcgaagataaaaaaaaaaataacgatctggtcgccgccgccggcctttcctcacgccgccgcagacgctggttaatctttcccaaaacacatcaagaaataaacaggacggccccatcgcaatatatgtgcaattacggattacaccctctcttagtgttgaattacaagaatgccacaataatttttttcaaaattatccttctactacactactacagccctatactagatgtagtagtaacgaatttccacccttagatctcatctcctcagcggtatatatccatccaaaggtacactaaaaaaaatccttcgtctggattgctgtcaccaaaatctgtgaatcagtctaaaaagaagaaggaatcaaacggacgaaaaaactgttaattcgaaatggcccagttaaaatgaccaattgtatgggctagcatggcccagtgagttgacaacacccacgtatcatggtggcccatgatcatggtccacctcggtggtcctgttgtagcccagtaggtaactattatgtttcaaggaaaaagtctatactttatccttcagttatagtcggagtctgattttcattcctcgactgtaaaccgggtataacacattcctagtatcaatattgacttattttgcctccccgagaaattttgatggtggtttcacctgataaggcattctcttagaatggtttgcaatgtaaatatgtaatccattggatttcatgcaaaattctttataagtttatcccgaaaactttccagttcttctacgagacagactttactgaacttgaggcattcatatcattgccaatattagaagctacgttcaagatcaagacaatctttccactagttcgtctgcatcaaacggctcaatgcatgatgtgatccacagttgtcttgcatgtgcagtagatgtacagtataagagcatctccaacagcctctctaaatcgaactctccaaacacccatatagctaacttcccatcttatttagctagtcaaactagatactcacttcaactgactctctattaatcatcttcaaaataataacggacccacatgtcagcctatactcatattcttcttctctctctctccccttcttccttcccgttgccgacggcggccgcatgtggtggtgctgcgacacggggaggcgggcggctgcgcacggtggtgcggcgacacgaggaggcgggcggccgtgcgcggttgtgtggcgacgctgggaggcaagaggcgagacgccggcggctcgcgacaacgacccggggcgacactcgaggcatagctcggcgcggcggctcgtgacaacctcgacagcggatctagaggggggcggtgacggagctcggcggtggcggtggccggccgcgaagacgatggggtggcggtggccggccgcggcgacgacgggacggcggcgccctcgtcactccacatctgactccgacgatggaggccacaggtgcgtgccgcgtggagaaagagaggaaacaggcatgggtcccacatatggctagccggctttggctggccaactttggctagtctggtggggaatttatccagccggatggcttggagaggcatttggctagtttgttggagtagatttttttttgtgcaagttagccaaattttgacttggagagctatttgactaggctgttggagatgctctaacagacggtatgtgcctctttgatgccgtgcgttggggaaaaaaaaaagaagacgtcaacagttgtgaaacaggtgggcctgatatgcgcacatctttggtgggctagtgatgacatagaaccaggttactagtatcattttgttagcgctggaaacaaagaccggctcgtcaaaccttaactgtcgaagtgtcaaccgtcaacgtacgctgccggccgcctattcctctctgccgccctattccatgcatcgagcgttaaaccgttgcccctttcaatcaccagttcaccacccgcagatcgttcgatccccagcctccttagtccaacaacgcgcgccagtatcccctgaaaacaatagccgtgcaccccctgttccgcactaaaatcccacgcacaagtcgtcgcgggcgttctatacttctatccatatctcggtcgctacacgcgttacatccgtacgcttcatacatatactgctcctacctaagatcgatcgatcaatgcgcttctcaacaggtaatgggtgatcacgcaatggccaataatcacgagcacaaggtggaccacctcgaccagcccttctacggcccgcccgttctccctccggtcgagccgctgtccgccgccgccgcgcgccgccggtgcgtcgccgacccgtacgcgctctgctgcagggcgatccgcgtgctgacgatcgtggtcatcgccgtcggcgtggtggcgctggtgctctggctcgtgtccctgcccaacgccctcaaggcctacgtcgactccgccgagctcacccgcttcgagctcggcggcagcgacggcgccaagcggggccagctgctgcggtacaacctcaccgtggccgtgagcatccgcaacccgaaccgggaccaggccgtgctgtaccggcggctggaggcggtggtgctctacggcggcgagaggttcgggtacgtcgacttcccgcggacgcggcaggggcggaagagcacgatggtgatccggccgagcttcgtcgggcagggcgtcctcgccggcgcggcggcgttcggaagggagaaggaggaagggttcttcaacatcaacgtgaagctccacatgagggtgcgtctcaaggtgatggtcttcgtggacagcgtcgagtacaggccggacgtggactgctacatcagggtgcccgacccgagcaacgcgacggcggtggcgatggggttcacggcgacgcgctgccgtgtcgacgacttcatgtgatggactggaccctgaagggtgcagcattgcattgcacgtataggtgacttcagattgttcattgtgtatattatgatcttcgagacagcaaaaggaagtttttcttttcaaacgaattgaatcaaaaggaagtttgatcgtccatgacgaattaacgattgtgcaactttatttagtgttgtgtttaactgcagtatcaatgaatcaaatcttcggctaaatttcaacacttgtgcttgtgtgtcttcatggatagaggaggatgggagacagttttctttcctctgaagcagtcaagcttggctggctggtgcccttagtatctgacatttgtggggatcaatgccatgtttcaatgtgtaaccgttttatttctaggttattcctcttttaaaataatagaaggttttattaatcaacgaaaacatctaatctctgcagcaacaacaacaagtacgcaacactataaaagagagaaaactagacaacatgacatatcatgttgccttgtgacaccttactagggctgtcaaaaaagctagagactcgtgagctgctcgagctcggctcgagctcttaacaagccgagcccgagcctaacctcaagcttgtgagctttttcgagccgagctcaagcttttcacgaggctagatgtatatgtacttttattttttatatgacagactagtaggttaaaagataaattagtatacatttatttaaaaaattagtatgtgttggtattatatattaattttaagttatcttaatctttttatttagtattattaacttaaataattagtatttataatataatcaaaatatacattatcatatactcggtcgagctagcgagcctaaccgagctcgaagacggattaggctcgactcgagcttgtgtctagctcgagcctagaaagccaggctcgcttgtactcggctcattgacagccctacaccttaaaccaacaccttaacaagaaactgttatttgccccccatatcgtctaaaccaacttcaagtctgagagatttttatccagcgttaactccaacacaacacctacaataagcaagtcgacaaacaaacaccaacattatcggatcgagataggccaaattaaaatacgagtattagggctttcaccatatagagatcttgccaacagtaacaattgctccaatgccaccacgcccgcaaaaagagaaaagcaaccagaatagaactggtcatgactgattgtggccgttgaatcgttcttcccaaagacactagaggagaccacccacgttttcatttccgaattattgccatcaacctcagcaaattgaacaaccgtctaacgaaatgttgcctccaatgggacacctccgtcgagtggatggaaagggcttgatatcgaagacctaagacttcagtggactaatcatcactcatcacagattgctaattgttgaggaggtgtacagagaggaccaacgttgtctggcattggctagatccaatttctcatcgatttgccaagaggaggaaagaaagaaaaggataaaatcctcttggaaaccttggacgccttgcctcatcagagcaccattgcagtcctcagaagatttcctttgtttatggttgttacctctatacaaacaacaccactaaccggtcacctagccaatcacaattcgagggattgtagtcaccggataaagtacatctactcgcggtggatgtagttgaggtgccaaagagatctcggggccgccacaaccctgatggcggctccatgggatgatatgtatggaaaggcccaggggttcttaaaaaatgatatcatgttgctatgtaatattagagcttgtattctttgttagccgtgtttgtatcctttgacgcgaactatattttgatcgagttggatccttttttttcctaaggggtggatggaagtttgtgacccattgatggttaataatactagtaatcgaattagtacttctagaataggctgggcagtcaacttttgatgaatcctggcaatagaagaataaaattgggaagaatgaatacatgccaattttttgttgtttatggttgttacctgttccaacaactagatttagcatttacattatattgccccttatgagattaagaacatgtttgacatagctccagattccagatccacactagatgtggactttataagttaaattaaagtggttgaaaattgtatgtttcaaaatgattcattcaaatgttatcaatacaatcatagatctagatccatcgatttatgaagctagaaatacctagctacaagaaatcctggatttggagttatgccaaaccgggcctaagtgtgcaggatgatactaagtagtaaatagtacgatgatacgctgtgctcaatcctcagtgagattgtgtcactctatttgtactgaggaaacatctgcgacatgaaactggaaaaaaaataatacttcacaaactaatattgtgcctaagatggagaacaacttaaacaacaaataatctattcttcatctgttaatcagcatctgtattttgtatgattcgtatatcaagcctactttggagttccaatttgtttaagaatcgaaccagctattagcaactaacaacatgacaagtaaattttttttggtcgtttttctgaacgagcgaaaagtaaatctcaactttacaccgcgatggacatcgtctggagtgaccgggcgtctcttcggtccggcgacgccgccggtgagcagaacgccggcgtggtgatcggcgtcgtccccttctccgtcccctcgtctatcgtggacaggctcctggccgggcccccgaacatcttcttccacctctcgagctcgcactggtccggctcctggtcatcatcctctgcctcgccgggttggcgctcccgcgacggccaccgccggttcctctccaaggacggcctggccatgcgcagctgctggctctccttgtcattgaagcatatgccgaacaggacgaagccgcggctggacgcgacggactcgcggcgtcgccaccaccgccggacaagaacggccacgagtagagacaacagcgcgacgatgacgccggcggtgagcgcgagggcgagcaccatgcgggcgtcctcccccatctcttctcctcccctgtttctccagcaacgcgcggttgtttccgcggctactactccaagcgaggtttgtggaagctgcacgagaattggactatacgatggcaatgtccgatgaaccaggccagaagaaacgaagtctttgccggtcgttgtacagctaagctgctaatgacagtgaaaacgctaggtttatttgtgtccacgaaagaccggagctgcggtaaacggttcacctgctactcctactcgtccagttgcacattcgactgtgttgccggcggcttattctgttcgtcagaaaataacttgcgattttttttgaccggttcctacttcagataatttctggagtaactgaaacacccagttgattctttttgaaattgttgttttgctaaattttcttcagttctgaacttctgatttcagatgcaaccgcaacgttccgtccgtcaaccagcgcgcgggcgggagccgtcttgcaagacaggagtacttgtttgtactacctatacaaacgaattactactccactgaacctgcacggagagtacgttaaaacgtggaactcggagcaatttccagggctcattcattttagcagtcttcagattgaccacacatattcagtcaggcaggacgcaaaccgggatatccttctctgaaacaagccaaaagtggtcaaaacgaaagagatagcacgcgctttgtttagtacacgggcccaaaagcctaaacttttatttcgctaaaaaaacaaaaactggcccagaccgtaaattttgattttaatggaaggcctaagctgaagactattgtctcggtccatgacggccttgtttttcatgggccaatttaagccaatattaacgggcaggaaatttgaactaaattaggttgtagcaaatcgcaaatggcccacgcacaactggtacagttcgtacgtaccgcgtacatactctttttcttagcatgtgtttgttttgagagatttgttagattgggttgggtcgaactcattttcatggtggtttagttgtaagactagatgcgatggattgtcttcgaaggtaaatattctactgatatccagattcggctgacccatgaaaatctggcaccgcactgacccaactctcccgcacgggtcacatcaaacgcacatgtctcgccacagtatatatttatagaaatatatacaaaatagcatgatacgaagataccatatttatagatctagtacctacgggggtatcatatatgctatccgagacaacatatccgatacctatggtaacatgctgacgtcaacatgatatataagtaccagatcttacgggatataatgtgtagtactggaggtatcatattcgatacctacagtaccatgatgatgttagctatctcgttactatggtatatcattatgtagtctccgtcataactttaaccgtgcccatgcgagatgcctctgtgaccacgcggacaattttttattattttttgggaggggggagggagtaattaaaaccccttctcttttctagggttatccattaatcttattcaaaattgcttttggttgagcttgatgctaaagtagttttggatcgttgaactctctctttctaaaattcctctcatgctatgcaaattgaatcttatagttgtggatttggagtttgggacctaatgtgtgttacactcaatcttcaggattagggtttgtgcaagggttgtgtggtgtttgttacttttgaaggttgaagactccgatggttaggcgttgctcccgagtcaccgatctacctgtgattgatggagggaagattgtgaagaccggatctcatccctgtaagaaaagagatacctctagtgatttaggatgaatgtatttatgcaacatcactataatagagttgaaaaagactcagctctattcaacaccacgtagactctgaaaagggaaaaaagaagggttcctgagtacaccagcacatagtgtcgcatatattagtgcactgcccattgcgagtcgagaatgaaatttgcccttgacttatccttaattacttcctccatctcactcgctaaagagtgattaaacttgctacagttttcaaaactaatttttaactttagatttctcgtatattataatgtctgtaacaacgaaatcataataatataaaattaaatgtaaataacaatccattgatattattttcatcaaataaaatttattctatagtaaaatatttactgattaaatatttaaagagttggattttaaaatgtgtgtgcgttttagtgagtgggatgaaggccttgtttagttcccataacataaacttttcgtctatcacatcgaatgtttagacatatgcatggagtattaaatgtggacaaaaaaaccaattatatagtttacgtgtaaattaattgtgagacgaatcttttaagcctaattgtaccatgatttgacaatgtggtgttacagtaaacatttgctaatgacggattaattaggcttaataaatttggttcggtaattttctaacagaatctgtaattcgttttattattagaccacgtgtaatattttaaatgtgtatccctatatccgatgtgacactagaaaataaaaatttttgccatctaaaccgggccgaattacctaccacaacgcagttaaacaaaccttcaaaaccatttaagtcttcgagctgaaacgtctgaaacctgtgtaccactagcattgcaccactagtccactagtagtccacaggtcgaactgcagatagacacgcaattgaattgaatgctgcacacacttgacatttcaaaatggcgcgaaagattaactacacccttcctagtgtagggtgtacagctaattaaaaacctgatccctatgacgagacgatctgagtattgaattctctccctgcttggtcagtgcattgggatcgattagacaggtcttaaaacctcaacagctagcagatggatgcatgggctaaaccaatttgctagccagaccagctaagctagcccatgcaatgtgtgtgtagttacagcaccctgttccccgctgtttcgtttgaaacacacccgtcatcgagctccgcgagcgacctagccgacagctccttaaattaaccacacgctcgagatcaccgtgcgattccgatgcagtactgacaaatgaatggagccttctattctattctccctctgaacttccaattcatgcagcatcggctgacgatttagagcttcgggaagatgcatatgcagtgatatggatttgactgctcgcaaatgccgtgtttatgccatgacccgatttgtggaagtactactagtacatatcagtacattggttgagttaaactaatccctaattcagatttgcacagttagctggcaaattcttctggatccaggaatgattagcgattcccttgcagcagcagcagctggccagggcggtaccgaatcttagcgcatgcatgtggccatgattaggttattggtgcccaaggtttttacctctcagcatcaaaaggaagttagaaatgcacatggaaaaaaaggcgatcggagtgaacaatccaaggtagctacactggtgaaacttatgttctgtccaaggttgctgctgcgtgcagctagctttttcttcctttcggccatggaaaggaggacacaaaatggtgagctcactgtgctgcactgcagtggacgccgcgaggcgcgtgcacatgtacgtttccggcaagtctagctatgtataggcgactatgtatgcggcagagatgagagtagctaggccgcactccatgcatgatctaagagcgtgcagttctattggacataatttccctcgaagtgcccagctgtgcctgtgagatgtgcacctcatcaatgttgtagattgtgttcgagatctatctccctttctctcatttatatgcagagatgcatgcaagtgctgctggacatgaacactccagcaaatcgccgttgatatacacatcaaaaacgagttctgcaagtgcctgacatgatgaggcaccgctagctcatcaagctttctctgaactctgaagataagttcacatgaatggaaagggaggaaatctatcccagagaagtggacaggcatgaagggaaatgtaccccatacagatgtaaatccatacgaagcagagtagatttatatgctgtgctgctgtacacagtacaagcatctgtactacagagtactaatggttttggtgcagtccatctacgtgctgtttcttcattttgctgaacagtgaacacatgatgtatagcagtgggtatgatacagttatgtcatatctattagaggatcttggacgcgattttcgccatcgttcatttgttcttgcagtcttgcacagttgcacctgctcttgcttaggaccccttaaatcgcagggtagaaaaatagaggaatagaaaaaacacaggattccgacagaaattgaagtgtaaaacagaggattacaaaacacagaaaaaacacaggaatggtcgtttgattggagcacaggaaaaacgcaggaatcgaatgagagagatagactcaaaggaaattttccaagaggttggagctcttgctaaatttcctctaaaatccacattcaatgtgccattccataggaatttcataggatttggaaagcttcaatcctttgaataaaagggccaaataggaatattttcctataggatttgaatcctatgaaattcctacatagatcttttgattcaaaggggcccttagagtttttaccagtctctctctctctctctctctctctctctctctctccttcctgattatcctacttaatttttgcaaaagaactactactgtaattctggttttgtcctgtagcagcaccattacatttactagtagtttttattcagtgagtgcaaagaaggaatcgatgaatactcctatataacagccaaatgcggctaaagattattttacatagattaaacaccattagaaccataggcttattttaaaggaacgttttttaagccaagtggtaagatagaaaacaaccaaaagatttgcttcaacagagaaagctagcatgagctgagccagcagcatggccagcttgtcctcacatgaacagttagtcaaccccaacaggggactcccgtcctattacgaaccgtggcaaagaaaaaaaatatactccatccacacaccacaccatctcaatatatcatcagtcatcttctccctctcccctacggtgtacactccagctcagaatttactgcacaaaaattaaccacctcgtgcagtcacaccagccatatatgcatgcatgctatgcttacagggcttacatctgcaactctcccctctgacatgatccccccagggatccaatctgaacatctttgcacccatgcatgaagccatgaaatgccatgaaaaccattcacccatacaccccccacacacacatactccgtataactagtagcagtgtgtagcactgagccgcactggactgtgctgtacatgttgttcacatatctttctcaggtttctgctttcctcttgcactgtccgagcttattttacccacacacttgcccttacacctctaattatccgcttcacatgctcgctctcttctcccttctcactgttcatgtcgctctatctttactcgccatttaatcgttgcctcgcgctctcacatggcgccccattaatatatagcaccactagctagctcctcttccagctccaagctccaagaactcaactcactctctccgagcttagctctcactgtctcgccgcgcacacgtcgctctcactggcttagctgagctgagctgcattggcttctgcagtgagtgcaggagtgcaaggctattgagcttagaggtacaccagtggcattgtccatgtcgggcaggtcgtcaaggaggggcagcttctcgctgcggcagccgccggtggtggacatcggctgcaactgccgccggccgaagctgttctccatcttctcctcgtcgtcgtcctcgtcgttccgccgcggcggtagcaagcccaagtcgcccaacgcctcctccacgaagacgaccacggtgttcacggccacgacaaggggcgccggcacggccacctccaccgactcctcg

SEQ ID NO: 18586 - DNA, 1409 bp, Oryza sativa
ccaccaccctctcatcctccacgccttcgccgacctctggactcgcaacggcctcttctccccgccgtccccctgccagttctagccaagtttcaacgcgacgccaccatgcacgccatacttcttaatcgtgttaaccactagctatattactagtgtacttgttaccagcgctattgatagcgtgtctgtcgcctcagtttgttaactatctacatggtgtacgtagttcatggttgggagaggttattaacagagatcccagcgtgatgtggtgcatttccaacggtcttcgatctgctgaaaccaaagcacaaagaccgtgcaaaatgcaccattaattagctccagcagcttgatctgcttgatgtaatgacacgccatatgcccatgtacgtgatgtgtaatgatgcgcgcgcgtggcgccgtggtggtgtaatcatatactacttgtgtttcatgctaattaagctagtagtactccctatctatactaaattagctgaatgcactggtcacgtactgctcgctgacacctgagcttattagtgtactacgcttgtgcttttgttgcgattcgcttgcacgacggcgtgacgctgtcctgtccatgcacgcgcctgtgtgactcgttgtgtgtctgtgtgctgcgcgtatatatgccaacccgaccgctttccgtttcgtgtggaacaaaggtgagcgttaacgtatacgcgcgcggtcgatgcgacttgttgagccgtgggggctcagctggggcgctgaaggtagtacaaaagctgccgctgcgatgctgcttgtttccttgtggggtttcatcattcgctggctcgacgtgttcggttgtctcggtgtgcgtgggtgggtgtgggcgcgtgacacgctgacgtgcttactgttgcggcgggtgagatttgatggagagggagatagctcgcccgatcgacgtacggctggatccttccgcggatcacggtggttcaaccgtgcgggcttcaccggcggatgcacaagttttaccccctggcttgaaatccaaacccgcatcatcccaatcctggctgctcagttgggccctcgcgacagagccagcgatcgatcctaccgagcccaaacaataaagagctttttttgggttacgggtaaagactattttatggtttttcggcggtcaacagtgatgcacgctggcagtagagcccggactaccgtccatccgacaatcccatgagtgacctgaacaggatcattttgatagtaatctgaacatgtcttaagattgaaaaatattcctccgtttcaaaataattatttttcacccactttataccaccaacataaaataaaaagactaaaataccctcatgtttatcaaatccaatataatttctatttactttatcttc

SEQ ID NO: 18587 - DNA, 30951 bp, Oryza sativa
ttatgtaatcgcagcaaagatcaaacaccattcaaacaatcctgtattcctctaatcaatagcaaatacttcagacctgtctttctctattctatagcagctagcaaatcctgaagaccttaaactacgacggtaattaatcgattagggaaatggataatcttgctcaaaaagaagccttcctaaagttttttgctgagcagctgctgcattacctgaataaaaatagagaggtggcaacgactccgattccaaatcagacgagggtcggcgactccatgcaaaacgagggcaggcggccgttggggagatcatcgagaatcccggcgtggggcagcgaggtgtccggcgggggaaagcgaagggaccggcgaggggcaatgaagcgccaggggccacgtggtttgtcggcgccggaccttgatgactaaggtggacgggagtggagggggacgacgagggcttttcggcgctccggtggagggatggcgtggcagcggcaccggcggagcgctcggtttggtggatgagggcgatggaggcggcgaacataatcaacagatggtgggggatcgggagaaacgatgaggaatactgtgcgaacgcgaaattaccgaaatatccttccaccgaaataaatataaagactaaaatgcccatgacaattaacggttagatataatcctactacactactatacacataagtggggggcaccgtaaaacgtccccagacgaatgctcatgatcatgcgccgggaggaattctgttcaaggagattaaggattttattcataaaaactttgtcagagttattttctcttatgttcatcgtagctgtaatcggtgtgctcatgaactggctcgtttgtgtaccagtagggacccggattggtctgatgtctggactgatcccctcccagcttttgtaaatcgcctcgtgactcgtgatatcgccgagtcccccgtataaataaagaggtggttactataaaagaaagaaagaaagacttccgtttgattctgtctcccgctttgatgtttctgaagtaagatttctgaatttaatagcggcacaaaaacccggctagctcgatcaattcattcgtgcataaatacatatagctccatctattcattcgtgcatatacaaatacatgttttcgaaagaattttctacaagctgaacaaattaaataaagcatggcagactgtgtcgtgtcgttcccagccgaggagttcgatcatgcctccatgtcgtatcagtgacacgaacacgtcaatagtccacgtcgcacttcggctgcttcctcgtgaacaccgtcgtcggcgtcccgctcgcggtgccgttgccggagttgggcgccggcaggttcagcgtgcaggtgaatttgctcttgttgttcagcctgaagcccctgaccttgaatccttgtctagcgtacaccctgaccttaacctcgtaagacccctgcgccgtctccctccggtatgtgcgctccacgtcgcggtcgtcgatggccgccgagccgctcagcgtcacgtcgaacctggcgtcgctcttccgaccaacgtataacggctgcagcggcgcgtacccgaaccggtcgccgtcgtaggacgcctgcgcgtcgacgctcctgaagttgatgccgaagcggttggggttgcgcacgcgcatgcccacggtgaggttgtacacgaggaggctgccgccgttggtgaggtcgaagcgggacagcgcagcggtgtcggcgtaggccttgacgacgctggggcggtagatgagccagaggacgaggacggcggtgccgagcgcgatgacggcgacggcgagcaccctgaagaggcagcagaacagacggtgcgcgccgctccggcgtggcgcgggcggaggcgccgctgcgccgtagtacgctgccgccggtggcggcgggatcggcgggccgtagtacgcgtcgttcagcggcggctgcggcttcccgtaggctgccatgatcgtagctagttgtgacaattgatctgcttagaattatatgggagagatcgaacgagtgatggatgaataatgaatcaggtagctggtgatatttatacgctatgcgatcggatgggaaacgaagatgttgaagaggatcgcagtggaaattttcttggaagcgcgtgtgcttccgagttcttgacgcgtttgctgatttgctcctggagtctggattctgacactacctgaggagttttcttctttgaaacttgaaaggttggggtaaggaaattttcaagggaacacgcgtccatttattcactggctgacatggctttgaaatttcgcttgcctcaccgcggatcacaactttgaggcgtacatgtttgcaccacctgcgcgcgtgcttcttcctgtgttctttcctaccaagactaggtcagcctttttaccttttttgagcataaacaaccatttttacactgatgctagtaagctcagattcacaaacattttcagaattcgcacccttcattgtcggcttattgaaaagcttgagctatgagaaagtcaagcaagccttcgatatgcgtattactaaattatttttccccatctgatctggttcaacagtttatcctggttcaatcgggagaatactccaccccagggcccacgcgactggcggcttgagaaaaatcggtactcttttatctctgacgcggccatataacaacctttaaatactttttctcaaaaactattcatccgatcaaggatctgattatttcgttatatttgttacaattaaatctttacaacaagatctcacatgatcatattttgagaaaaatattcttctttttttttcaatagatctgtttgtaatgttgcatacaatattatttcgatgtctcgataagtatttcttaacgttttactatggcatttacaaatgttgcatgcaatattctttttggatgttgcggtaaatattctgtgacattcaacggttacaacttatgcgtgataaaaaaatatttcaagataataaagtatttgcatatatatatatatatatattcgtaggagtttttctatgtttcggccattagggcaaaatgttttgtccaatgattgttggtgttacaataaatattttgtaaatgttgcatatctctgaaacatgttatggagtgagttgggacatatatggtcaaatgatgaaacatttttttataagtgatagaacaatattttttgatacatatatatttttttattaaaatatactcacatgagatcttattataaaggtttatctatatcgaatataacagtgtaatcgaattataaatccgatatatgatttagaatgaaaaatatttaaagtttgattaaaaaaaatagttaccaaagcagttaaggagaggagagagaaaatatagtgtccacacacatgcagcacactagcacctcaggtggtgtttggatccagggacttaactttagtttatgtatttagacactaatttagagtattaaatatatactacttacaaaactaattacatgaataaaagctaatttgcgagacaaattttttaaacctaattaatccacaattagagaatgtttactgtaacatcacataggctaattatggattaattaggctcaataaattcgtctcgcgaattagtccaagattatggatggattttattaatagtctatgtttaatatttataattagtgtccaaacatccaatgtgatatggacttagaagttttagtcccatctaaacagggtctgagagtatagggtccacatgcatgcaatacactagcacaatactctcttcgtccaaaaaaaaccttaacctagtatgagatatgagtctcctcttattgagacggagagtatactctttgacaagtacccacgcgataataataatagtgactaaaatgcatgtcacatcagggatttttcatgcgcggatcaggcgttcaatccctagttcactccggttcaatctctaagttatgttatcttccttttatttttaatgacaaaatttatcatgatatctgtcttcaaaatcctacaactaagtcatttgtcaaacgaatctgaattacaaaatcgcaaattcacaactttgtttaaaacaagaaagctagacaagatgatgaatgttggacagatgtgtgattataatgggccagttatccacgtatctccgggcgaccgggcctgttctccattaggaaccaaaatattttgctaaagccaaacaaggacttcatagcaaaagataggacaagaattttaatttgagagaattggcaggggccgcgcgaacgcgtaccccctctaccacaaattatgacgtccactctcccacttggggagatggtaaaccaacgcgctaaaccaagtgcaatgtgagccattgatctaggccacgggccttcttgatcgcccgtctaccccatccaggtaagtatgttgcaaagtttcaccagccgcctcttatatagggagcgctcccacccccatcggctcgagttgtcgaggtggtactaaacgggatcgtggtcgtgcaggtttgcagtcccgggcgttgggcctccactacgtgggccgtactcttttgatggactttcgcttcggagtccgcggctcggacgcgtacgatcgcaccccgtgaccgtgagtccgtgacacaatccaccacgcctacgatcgcccatgtccggctttggaatttcagagactccaagccaagatcgacaaggatactccatcaaatacgctctcaatttctcgatcaaatactccatatcactaaataggctcgactcagaagctaatcacagtacactcgaccctgctcgacgcctccacgagcttaagcgcgagcgggcacctcgcggacagcatggtcgccgacgtggtcatcagcccgccgtacttgtaccgcacggcgccgagaacccacagggtcaccgggaacacccccgtgtggttgtcttcaccaaacgcgccggcgtcccaggacaccacgcccgagctccccacgagcacggcgcgcaccgcgtcggcgcgcctcccgccctggtacgacagcggcagcgcggcggcgccgaagcgcagcccccggtagaaaccatccgccgacagcacgtcgtagtagacggccgtccgcctgctcgggttccggatggtcaggccggcggtgaggttgaaggagagcaccggccgggggttcgccgtcgtgttcagggcgaagcgggagagcgtcgcggcgtccacggccacctggatcgcccgcggccggtagatgagccagacgaggacggcgacagcgacgacgacggtgcaggcggcgatgaatgccctgaccaggacgcggaacgcgctgggccggcggcgctggggatgcagcgccgccggctgagcctgagggtacgggggaggatcgccgccgccgtgctcgacatggagttcttgtcccgagtagtacatggccggaggcacagatgggggtggcgtgacatgatagatagcatctgtagatatagatgatggcgtttgtcgatggctgatgctgatgctgatgctgatgcaatatctatgtgctaaggcaagacaagaatcggacgaattcttcgaggctcgtaccagcaaacaggcggcgacaagagaaatccaggctgctggtaccggatggtggaaaccgcaattgcgcaaaggtgtcaagtacaacaatatactgagtagtatcagttagtacaagaagtcaagaaggcttgtgtgcttgtggaatgagagatttgtgctcaaaggaaagtatgcagtttagcctagcctatccggtctgttgcacctttggttggcaaacaagtgttgtgctagtctgaaaagtgactcaagtggatatgagtgcaatttgtttactcaactgtgctgcatccgggataataagagttataacagctattggtagtgccagcagatgatctgtacatgaaaccatattttctggattttgggatagttttcacaaacacaagcaaagaaacattggatcaaaccagtcatttcattagcttgattattatataaatttacatcatactttgacatgtcttatttctgttcaagagtctggactatttacaaaatgtaccgtaaagaatgaaaactaaagacgcaaacatgggaccaatggatcacacgatgtaaataagggtgatgtgatcaagcaacaattcgagatgcagagcacaaaccaaaaacaacggaaaaaggttaatgttatggccttatatgggtattatatgtactcacattgaactgcgactcgcttcatcattcatcatccctttaaaacttttggccaaccagattgctgtttctcgaggagataccttatccttcccgaaaggctttagaacaaccgcaagctcctccagcctattgtgttgcagtagatccgcagaaagctccaggagtccttcaagggcctcggctcgctgcctgaaagacttgacatctagaatttccttcgttgggcttgcctcctccttgaatccattgttgatagcagtagtagtagaatttacttcagggacagtaagaaattttacaacatctgaacaggctgttttcgagctgatggtattagtttccgaaatattgggcttgggtgcagcacaatcaggaagtctgtgaggcacaagattatttgatgggatgcttctcgaatccacctcttctcttaccacgttgagaagcttgccaacatctgaactttggactcccatttcagcgttctctgcaactgcctgttcaccgcagacacggaagctgctgtgtcttatgacatgtatgacatcctcaattggagggttcaaatggggagatgatgttctttccagtgattgaataggaggggatcctttttctagtgcgaagtttttcgttgaaacaaatggggcaatatctgctactgatgaaagcaattcttgcactgtgaacttatcctcatcattctgtacaatggcattggcagtgctctgtgatatcttactgcagggcacgttgtccttgaaaatactcacctgctcagatatatcagaagatggctccaaggctaagttttcacaaacatcatcattactagccatactcttctggaaattggtggtgtttagctccgagctaggcattgctgttaggtcatgtttttgtatggcagcgtcagggattgagcacttacaagatgaaaccaactgggctgatgaatcttgttttgatggttcagacagctcggtattttcagcataagcaattgtggaactggaacaatcactgctgtcttccttgatagatacagccctcggtggagcagattttgcccgtgcattgccaactttcatttgaacacccccaagaggacttgggggagccattggaaaacctggaggctcaatgatatcattatctggaccatggacaggtcgacaaggactttttgcacgctccttgatgaccttattgtgagctcgttttgtgtcagcatgaagtggactctctgctcccagtggcctacgaggggggatactaaggcgtctagaataacttggtggtgtcctgttcttgacctttccaacagctgcatcaacatcttccattgcctgcttggcagggtctggctgcagcggctcatcctgtttaattttagcttttggagaatgttcgacaataggggactgcaagacagtaaccaaaatattagcaacacaaacaaagtgagtttagcacaagaaaaagagcaatcctcaccaaatgcttcagaggaggagatgcttgtgcccgtttcacaggttcacagatgacctttgctgattctcgtgatgtcacttcactagattttgaactggaggagatgtcactgctatgctttgaatcatcagacaattgttctctattacttggtgaatttagttttacacggctagctctaataggtgaattattttgcctgagcttgctctcttctcttagagttgttaatatcttcttgatgatttttggctgcttaatctcgtttctaggccgctgatcaacatggatggatttagatgaatcttgcctctctaattcaggacccacagtttccttattgcttttaacatcatcagatcttgaacagtttttcactgatacatgatcagtagcttcagcaccttcagtatcaatcgtgttgttggaacttgtagatggccctgatgtgttcctttcacttgactgtatactgtcaatatcgcttccagaaatactactacactgactaccagacatgcttttctgactgctccgtgaactggtaatgggtttctccagtgagtgaatgggatgtgatatatcagcaaatgggcggtattgattaacataaggttgaaggtatgggcttttaagaatctcagatgcctgtttacaaagtgtgtacagatattgtcaaaatctactaaatgcaacaaacaagtattgcagggaggtttctgtgtgcataatagctaaccgtaggccgatgttcaggactcttcctgagcatgcttttgataagtgatttcctgcattcaacagcaaagagaccattttagctaaccttatactagaatcccatctcaatatgacaatggaaaggtgaaataatttgtggagtaaaaagtgttgtgtctgctatctatcatttgacttggaacacagtgagaaagacaatacgtggaagagctagtttgtcaaaaggaaactaacaacggatatgacgatgaagaaaattggattttatgaacaagaaaaatgagaaaaagcaaagactccatgtatgatcaatacagatatagtgaatgtgcacttacatagatggagagtagcatggaggcaaagggccaatggaggagcgatttatcttactaattagtccagccatatcctgaaacaaacatgggagtaaacttaagattaactgaactttgacaactttgagtcaaacaccatcaatttggtaaacactacggaagaaaacaaatatatatttttaagaaaacatccatatgtatcggacaaaaattgcctgcaaagactactaatttcatcaaggttttcaaacagtacttctaattgaattattataagtgcatatggatttagttggaagcaaaatattcgaacttaggagagagtagtaaacctcttcaaataaaatttgaaagtccatgagatataagatctacatcattcacataagtccagaaatgaatttcctggatggatcatgaagaactctgatccaatatgctatgaacctgaaaaagaaactcacccttctcttataaaatggcacatggcatgtgtgtgaaaattcacatgcacagagataaagagaggaggaaaaaggataagtggtcctgcaaaagccactatttgctaacataatagtgactgacttcagcccagagttcaccacacctcagaaggaagagtctaattttctttattttaagtgctttttttacttcttaaatgaagcaatataagcagtaaaatacaaatagcaccgttctattagggccgtcattaggaaccatctgcaccattaataagtgcacctgatctccatcaatctatagtgccatgtttgcttgattgcaatttggtttgtcacacgtgttgcatggcacataaaaaataatcaatttactatatactggtgaagtttgtgtaatccggccattctctttaatcctaggatatatgaagtcaacgtttagaactaccgattcttattaaaaatttgataacactatattttgaacgttttccaagagcatgaaagacgttatgtattggagattgtgttgatgtcaaaaatgacaagtcaacaagtaaaaaaaaaagcaggagcacaagataggtggcactaattagaaatgggactgcttttgtattaacattaaaatatccatgggcggataatttacagatatccaaagaatgagtgataagaattaaatcatccttggcatgccaagaaactgtttctaggtaattatagtgatctggggaatatgatctgttaacaacttacaaatgccttgaaggcaggccgatgagcagccatctcgtacatacaacatcctgtaaatatctatatcagttagaaattcacacatttaaacatatccatatgagcaagggaatattaccaagagaccatatgtctgacttgaatccgtaaggaatgtctgcaagcagctctgggcacatgtaatttggtgttcccacaacctaagaagcatcatgccaaaatataagaatttgagaacataaaggtatttagctaacataatgatattccacttgaacatatagggatcaattcgacatatgtttcaatgttccatgcagtgcaggataccaaaaggtaagcaacagaatatagaagcaggattccaaaaggtaagcaacagaatatggatgacataagagatggttaccgaagaggttaaatcatctgcctttaaagtcttagccaggccaaaatcccctgcaaataaaccagagatatttaaatgcacaaaatgaggcaataccacaattatttgaatttagatggtaaactaaccaagacggatgtcctgatcttttgtgagaaatatgtttgagcactgcaaaaaaggacaaggacataaaacattactgcttgctcaataaattaaatgcaagcatcactgatcttttagcataccttgaggtcacgatgcaaaacaaagtttgaatgcagatagtccacagctaatgccaattgagcaaaccatttcagtagtttctgagtgttattcataacagttagtacccttttacacactatttctaaatgaatacggaaaaagggctataaaaaggttgcgatcacctcctctggaaagtatgttccatttgctttcttcatcagttcagccctgttagaaaacactatagtgagacgacagtcaactaaaaatgtagccgagaaactaatcccccaggccccaaccaaataaatcgcactcacatatcaccaccttcacagtatcccgtcacgatgcaaacatagcagccctgtcaaaactcacaaaataagctaaacaaagttgaaaaaaaatataaaaaatgtgtataagtgtgtgttcctcgagagcaaaccttctcaacccatgcttccttgaactcaacaatgtaaggatgttgcaggcgagcaataagggccatctgcatatatttttaaattgttcaatgcagcatgaaccgatgaacgaaaagggcccaaggtttcttgattttcactgacctcttgatgagcagacttgcgacagcgctctgtttgcctcgcgagccgaattttcttcagcacatacctgcaagctagtcagatgtcaactacctccttaaaaggaaaacataatttacagctaaacagaatagagacgcatatcatactttttcttctcggtcttgtggttcacgaggatggcagcaccaaaggcgccacggccaatctgctccataacctcgtattgatccatccgtgaatccatggttcccaatctcttaccaaaacttcagcaatttcacagcagcaaatcaccctcgcagaacttcaatctccagtactccaatgcccaatctccacatctcctacaggcaacagctccacgccggaagcgatttctgcaagagcatcggggaaaaaacataagcgtaaatcgaacagcactacgctttgcatcaaaatttaacaaaccatactcctgttctatccaatagaaccctcacagtgaatttactcaaacgagaacaacaacaacaacaataacagaaatccaacagaaacaccaagcctcacaaaatccatggccgacgttttcgcgtctgtactacgcacaggaaaagagggagaagccacccctcacgagaaaaaaaaaagaagtgattgagaagcttagcaactgtactgcacacagttcccaccaaccgcgcgccactgcccgagacagggaccttaccgcggctctccccaccgacattcgccacgatcggagtgctccggctacgacgccgccgccgccgccgctccacggcgggatccccgccgaaccccgcgacgccccgttcgccggcggtggggcaccgcgatggggcgtccccgcgctcgccgacgaggcctctgctcccccgcacctgagacctctcccgctgcaggctgcagccggtggctcgtcgcctcctttgggcgattcgatttgatttgcctcttcgctggcttctcgtttttgttccggtgtgagttgcttttgggtttttaaaatcgccataagggtgggggaaagagcggcttatatacgccatgggcgccactaatgatgaaggggttaatacttaacagcgatgtgcggagggattagtcgctgtgattaggctgtttgatgtatctgatgattcagcccttgagacgcaaaattaagagttaatcagttagacctaatcgtgcattatttgttcgtagcgactgcgaaatcgctagaacgcgcaatgctttctccacaagatcagccaaatcatcgaagttttgaaacattaacgtgattccatctaatcgtgggttgttaattggcacctgattcctatgtactcgggtgacatccgtcaaaattttgaaggtacagtcagttctgaatttttttggttttgatgtgtcaggagattgcatttgttcatggaattctgaatccattgtaattctatgaacaaagcacacaaaaaaatgacacaaagctctattttggtttattaaattcattgtttttacttttcaatgaaacagtcggttaagtgtaatattggagctgcgacactaaactcttgtttaatactagtaatcagtaatttttcctcttatgcacaccacatgcacagcctaactgatcctaaataagaacatgcgagtaaccgaagcttgctatatacagtatgtattgtgcaattgtcacatcacaatgttccgtgcccgataatatgcctcatcttgcttgctacgttgagccaaccatattatgattgattccttttattaggttcgcgtgtgatcaatgctcttttttctttttctttctttctttttttctttgcctcgtgggaacggctccaactgtgtcatcatagtagaacctttccaagtagggatttgatcatgaccatttgaaattaagttcttttttaagtgaaatgctcagattttgcgatacggttaaaatccattgtatccttaaaatacggccctactattgccaactttgcaaccggtggaactgaagaagcacacaagcctgaacttttttatctatgaaacagtcttaataaacttttgaatactcgtgacacgcttttcaaattactaaatggtacgttacatgcgaaaactttctatatgaaagttaattaatttatttttcaagtttgtaataattaaaacttaattaatcacacattattaccacatcgttttgcatgaaacacttaatctttatctttattttcatcttcaggagatttgaacaccacctaagtgtaacattagttttcaccgtgtttagatcccaattttttcttcaaacttctaactttttttatcacatcaaactttcctatccagggtgtgtttagttcacaccaaaattggaagtttggttgaaattaaaacgatgtgacggaaaagttggaagtttgtatgtgtaggaaagttttaatgtgatggaaaagttgaaagtttgaaaaaaaagtttagaactaaacagggtctcacataaactttcaactttttcgtcacatcgtttcaatttcaaccaaactactatttttagcgtgaactaaacacagcctttacaacttttactcttacctatagactgtagtctgtagatgaccctgttatgtaaagtgctgagatgaaatttttcggagcaatttaaagctaacctcagtctaattaaaccaaaagatggcctaataatggcaaggttggaaatgggtgaagtgatggatcaacgtccctttgctactaaaagaagcattgtgcttgtgatttctatatgctagtgctcgcttgcccactagtttacttagattagtttaagtgatattttgtttagagtggctccaatcagatgcacacatatagccagtggcactagttgtcggcagtgccagctcattgctcaagcccgagaggactgagaatttctgtatgtactgtcatgtaggtcaacacttaacagaactatccatcatgaaacattgcttagccattttatgcaagaacacacccaaaatcatggaccaagcaatgtatctgccgaaccaagcaacaaatgcatggtatattaattcaagaacttggcttgccctgacactctgctctgtcagaaactaaaaagaaaaagaacatataattccatgtgcacagcaaagtaaactattattgttcagctgtaatatctcatcagcttttgtctactccctccgtcaaaaaaaaaagacaaaccctaatttccgtgtccaacatttgaccgttcgtcttatttaaaaaaattatgaaaaaaattaaaaaaacaagtcacgcataaaatattaatcatattttatcatctaacaacaatgaaaatgcgaatgataaaaaaatttcatataagacagacagtcaaagttagacacggaactccagggtttgtctatttttgagatggagggagtacatgttaacatgacacagttggtttattcaattggatcagcgggagttatccacaaatctggtttattaaagggtagtgctgctctttttctgtttgtccaacaggttagtgagctaacccttctaagaacaaggtaccctggtattgaatggttgggaagacaaagacctgtctttttaatggcaactgctgagctcggcgctctcctcaacaatgaccactcaccggttccacactgatgacaaggttcagggctagggactcggtaacaagcagaggatcactgaaaacaagccatgaacacactgaaaacaagccatggacatgaacaggtgaatcccatggacactgtacttctggtcaaataatttataaggtttcaaaactgttctagggtggcaattgaattccgaaggatgaattgcgtgagctcaattcaatgaagaagaggagcctgaacttgcaggcttacaggcacagtaacagctgaaacaaacatattagctgcttcactagctcacaaaactctgcagaaactaccgttgaattacgatggcccatcttcagtgcagatatgcatcaaaaggttatgggccatgtctgacaggctgtccctcagattaagttcagatttcagatggacaagcacaagcagtggataaggtgatactcctactgattacagatttatagtactacagatctgcatatttgcatgtggcattttgtcatactagtatatttgagctcctaatgtttgtctttacctaccatgctaaaacacaaaaactttggtatgcactaccgatccagtgcccatttctgatccatacagagtttaatctgattcaggagagaaattggcaataaccaaagtgcctaactccattggtagtactgctaaaaaacaagccatcaactaggtcagtactgctgatcaccattgttaggtgaggcccctagcaatgagtaataaagggaaaccataaataccatgctagaattcagcaaagatgttgaagacacaattatgagtgcagcaaagttttttttaagtccttggagtcatcatatccgtaggtttccggacactggcgtgaacacttgtttactgcaaaccgaaaagttcagacctttaaccccagtggccattgtatgatacgatcctggttataagtactataccatgacatcgaactgatatatgataccacggcaatgatcaggatggacccgagtagctaaaaactatggcgacaacaaagaaaactaaccatatccccgtacggttcgtagtaatgaaagctcttagctctctaatctcttgattaatttactactggttcgaactgactactgcctgtacaaactaaccctatctctgaaggtaggtataccattggcgtcaagactcaagagaaaagcaagatgctagacctttttcctagccccagttttttttttcaaaaggagatgcctaataaatattttgtaagttgccaatttgatatcagaatacttaaccctcatttaagaaactcggtcagagagggatggtgcaaccaccggaggcctagctatacgctgacatagaggcgtgcaccgtgcaccacactattaaaaaattgtaaggtttgggccaacagaatcaattgatgagccagatcgatccatccattgagtggttaaacaggtctcgaaaagaaaagtatgagaattaaggattgtcatgaataatccttgacattagtcctaaccaatcgagaaaaaagggattaaaaaaaatggattaaattctcaacaaaagcgaaaggcgaccggtttgtgcggccgatcgagacctcctggactctttataacatcatcaaagcgacccgggcttagcaatttggtgcatggattagtttatagataagctactcccactcaaaatactcgatacgttcagattttgaagggtttttcgcgagcagcgtggccctgcttggagtaaggtatggtctacctaactgttgtgttctgcgctcgtggaatttgtgttttatgtcccaagtcctaacgttatcgtttgtggtacacactatatgcctttcatgaagtagtaccactattgtgatcggtcaccgatagcaaactctctctttctcttttcctgttaggtgaagagaaatccaatctcttcttgttatttgctccaataaagcgtgttatcacttatcaacctctacatctctactctctgtggagtgcaagggacgacgattgatcggttacgatagggaagttaattatggatgtagaggttttgtgaattacatgtacgtacggcggagtagtcagcagagagagtcaaacgtgcactgatgcagctggtgtcccctggtcaagtgattgctgccttgctggcactccggagctgccgggcagtcacagagatctatctatacctattctccgtgtggtcatcaggcctcatgtgccccccagctccgagacgcatggacacgttggtggcaagacaaaacacaccggaggggattcattggcgccaggctgcccaggcgtgggcgccatgtgcgcgcctgcgtgagtccgtggcgtcgccagcgtggacacagcaggaggcgcacggcacgtggccccgtggcccgtggcgcctcccccctggacgcaacgcgcggcgaaggaagcgagcgttccacgttagagacggcgacgacgcctcacgcccgcattggcgccgtgctctcctgctacgaggcgacgactacgtgcggccgcgcgcgcggcactttcagctacggaagcgccaatttcagctcgtgatcgatcggtttcattgccgtcggttgggcagcgggcactgtggcagcaatgcagcagtattcgccggaatcttctaactacgtactaccgatgttgcagcagcgtgcggccatgtgtctgtacgtggggcgtaataacgggggactcgatctggagtaggcggcggatggtgcggccggagaatacctctgcatgggcgagtgctctcgctccgtatcgtgcgatagttcgtccaccacgcgtccacgcgagcggccatgtgggaggagggggcaaccatcatgtgcccatataccggtcgcgtgatcggtcaatgccccgctctcgtactcgaatcgtactcgttgaaagcctccagctctgctagaccttgacatgcttagtaggtacaacgcgacagatgtgaaagacaagtggaccgtgacatgtgttgtcaaaacgacaacctcatatgtcgaaagacgtggttactcaacagtggttggaaagaaacggagtgtataaattttagaatgtttacttcgggatcccccattacatggccataggggactatttatatccccattacatgttcttactactagggttttagattatacagggaaatttacatgattacccttacgaaagggacatttacaggggtgcataatgttatggaggctcatgggcccctgatgggccgtcgggcgatcgccggccctatagcccctaggcttgatgggccggaaaggcttcttcggccctcgcgggggcgaacttgccatggcgaagttgtcttcctttggcagatactcttcgccttgcacccctcgcctggggcgcctctggcctggcaaggtattcgcacgacccttcgcctctcgccgttcttgcttcatagtcttcgccacgggtttcagcagatttggtcgaagggcctcatgccatccgccaacaagccccttgcgggcaagggtgagagtggaacttcggccgagaccgtgcaaaccatgtggtatggtatgcgacgccccctttcgaccgatgttcctgccgaaacctacattgttcctgtaaataaaatttgttatttgtgcggttggtattattttgccgctcttcgcctcctgcattcggtgggatatacacatatattttttcttttcccgggccgaaaggaacaatattgggctttcatctcgtgggcttttttactgtgctactcggtcggtgggaatttaccgtttcgcctacccttgcgacacgtggcgctttattattggtgggtaggcgaacggtcgcccgggtgagctatatattcccacccctctttccttttcaccaccacacttgctgttttaccacgtgcactctcttcctccgttcctttcttccacagcttttcttgacccctcaggtgtttcgcccattctcctccttcgccaccgcatacacgccgttcgccatggcccctcgcaagccaaaccctgcttcggcgaaagggccggatcctggccgggtcaatgatgacagcaccgcatttttgggggtttctctcgtggacgacgtcgagctggcgaagttggtcagctctggggcgttggttgatgggcaggctttcgccccagggaaagccgtggtgccgaagcctgtcaacaatcggacggtagtgttcgccgtcttttttgaggcggggctacggtttccgtgcaacgtgttgttgccggaaatccttcgccttttccaggtggagcttccacagctgagcccgtcggcgctagttcggatttccatcttcgattgggcgtgccggacttccaggtttgagcctagcgccgagctcttcggcgccatatttttcgccaccgtgaactcgaagacggtgattactccggctggaacaaagaagacagtgttcggaagcgtgaactttaatgttcgccccgagcggtccgatctctggctggtgaacgctgccatgtcgaagtgggaccgccattggatggcgaggtggttctatcacaccatccctttagaggctggttccgactcggcgaaagccctccggtgccggcgtagggcgattgcgtcgaaccggaaacccaagatcgccgtgaacggcgctatggaggcgcggttcgttctgctgcgcaaggtttgctcccgccttagctgccgcgacttggtggaggaattctgtatgcttcgcatctttcccctctcccagtcatggcaagttacggttgatcaaggcgaagaggttgacggtttgccgaacttggttctccttgagggaacgaacagtaagactgttcttttgctatacactcatgtgttttgatattttgctttgtctgaccttttaatgtagctataccctttacttttgcagcgttgactctcgaccaggctgaagccgaagcccgcaggatgatcggcgacgtgtcggtcgtcaagtttagccatctgttgacacgacaagcggctgggcgggcgaaccgagtttacaacagcgaattacctccccgggcgaacccccacaaagccgacgacgatgttggaccttcgcgaaagcgaatgcgcggacaagtaaagcttgctcctaggaagcgaagagttcttgcttcgtcagactccgacgccgacgacgaggacgatgccgaagagcatgacggcgaggaggaaggagaggaggaagaggaggtggaggccgtggctgaaaaggccgcgagcgaaacgatcgaagaccgcgtcgacacccctggctacactcctactccaagtccaggtcacaacgagaccagggtggagtcgaacagctcccctcttcgatgaaaggatttggaaggggcgaaggccctagttgtgttctcatcgggcaaggcggcgaagggggtccggtcaaaaagatctctaaaaagaaaggactcgtcgacatcgctcgcgttttcagcgacgacgagtcttctgacgagactccgacttcacccgctggccgcagtctggacctttcgaccgctccccttcttccactcggcgttgctggggcaggcggtagcgcctccgccgaacggatcgtgacggctgcggcgagggtcttcgggagccctttgcatgaaccagctgtttcgccgttggtcaagacgaaggggaagggtgcggccgccgaagcatctgcctcggagtattcgcttgtggcgcccccacttcgcccctggtgatttcgagacccgggcggaccttattccctttgtggagggagtaagcaatcttgtcctacccaccggcaccccgagcctattcaccgaactaaatgaattcgatgaggggtgttctgctattaaaagcttggcggttcgggtatgctttttctcccttcttcgttcgttttttttctcatgtgtctcacaattaacattttgttctcttcgcccgttcctgtcctgcatccagattcttgcggctcactgttcgacagagcgaaccgcgcgggcccgtcttgacggatttaagaaccgtcttcgggccaaggatgacgaaattagctgcaagaacttggaagtggaggccctcgccaacaccctcaaagaggcgaaagctgaagtcaagcgccttcaatccgagttggagaaggggaaagaggccagggctgaggtcgatcgcctcaaggctgaactggagaaggagaaggcccattccgccgtgctgactgattactataacctcactgagccgaagatggaggctcttcgcctgaaggttagcaaggccgaggcgagcgctgcggaggagtcacagcggttttcgcgggagatggcgaaaaccaccgaatccgcgagaacggcttgccaaacgctccgcctcgcccttactgacataggcgcgaaggtgcgaggggtccctgccgaagatgcctcagccttcgacttctccgagtggactcaacaggctggcggttcggtttcggattgcgccaccgcgtacggcgattgctgtgcgcgcgtatcggcggccttcaccttgggccttttgcaacagttcggttgcgagcacgtcgccgagttccctaactatgcgaagggggactgggagattagtgcgcagaatatttcgcccgctcttcgtgcatggcgaaaacagttctggcagaaggacggtcggtccgctgccaaggcgcgccttttggagcaactagcgaaggcagaggcggcagaccggtgcgaaggagaggacgcagcgagcgaagaggttggaggcgatgcccaggatcacccagaggtgtgaggccctccgccctttccttagattttttgtagtttcccttctttttgcgtttgcctagagaggcaaacgatgtatattcggcaggctgccggtaaccctccttattgtagccaaaaaaggctttttgcatatttggaatgtacgacaaacttagccactttttgatggttgaagtctttggcgtattattatttcgctcatttcgcattacgccataccttccctttcattcgcctattcttactatgtaaattgtgttttgccctttctgcactgtctaccagggtgttcgccgaaagtcgtgccttcggcccccttctaggagctagcgaagtcaaaactgttgcggtttcaacgttcggcgagcgatgcttcggccgattcgtttcgccccctggcctttttcgctgatcaggcgtttgccttggggtttttccacaaattatcaatcacacaaaaaataagaaggcgagggacacagaggttttatactggttcgggcctccgtggtggataatagccctacatccagttttttgtctcttttctctctctctctttttttcttgccgaaaggcttacatagtgccgaagggcttacatgacggtatgtacatttttcacaagttggcgatttgggtgccacccattctagacatagaagcacttgagagaggcggcgttccaggaatggtcgaactcttcgccttcgagtgttgccaggcaaaaggatcccgtcctggacttgtttttgatgaggtatggtccttcccactttgattcaagcttgccaaccgctactgggtttgccttcttccttaggacgagatgaccaggcatcagctcgtcggttgaacttatctgttgtaagttgccgaagtgcttgtggcatacttgcgcatgtgctcgagtgcgtcgactctgatcccctccaagagttcgagcgacacttcgcgccctttttcgcccctagagaacatcacccttggtgagttagccccttgctctgctggggtcattacctcatcgccataaagaagtatgaacgggctaaacttggttggtcttgtgggggtcgtccgaagggcccagagaaccgacagcatttcctctggccattttcccttcgctgcccccttgagccttttctttagtgcttctaggatcttgccatttgtacgttcggccgccccatttgactgcgggtgcgcgaccgacgagaacctgatttccaggttaagtccttcgcacatttctctgaacttgtcagagtcaaactgcttgccgttgtcagtgatgaactcttttggcactccaaaacggcaaacaatgtttttccatacaaacttttgtactactgccgaagtgattgctccgaggggttcggcttcaacccatcgagagaagtattccacagccacaattgcgaacttatacccgtttcgcgccaccgggaacgtcccaatgatgtccagttcccacctggcgaagggccatattggcgcaatgggctgcaaatcatactggggcgcggtttggcttcggccatgacgctggcaactttcgcatttcttgatttgctcaacacagactttcaacacaatgggccaataaactccttgtctaaacactttggaggccactgttcttgcggcctggtgcgcgccacatagcccctggtgtatctcctttgccatttcctcgccttcagcaaaagagatgcaacgaagtaagggttgaagtaccccggagcaatagagctggcccgagaccatcttatacttcgtggctctgagttgcaagcgctttgcttcttcttcgtcctccggaagccagccagtttcaaggtgtttcacaaacggggttcgccagtcgcatgggtcttcgtccaatttcacctggtcgatttccatcacctccgagctgtccatgggcacacttggtgcgtgtaggacttcgaaaaagatgccaggcgaatgtgggccaccacaagcaacagatttcgccaaggcgtctgcttcctcgttcagtcctctaggtaagtgttcgaccgttacgccggctaaacactttttcatggaccgaacggcctccaaatacctcttcatcccttcttcttttgcctcgaaggatttgtcaacatggcctgccaccaacttggagtcggttcggatcagcaagcgccgtactcccagtgctttcgcctttcttaggcccagaagaatggcttcgtattctgctgcgttgttggttgtgtcgaactgcagccttgcagcgtaccgaatcggcataccattcggcgtaatgaggactgccgcaatgcctgcccccttgtgcgaccacgacccgtcggaggacaccacccagaattgttcgacggcctcaggctcgggagcgaataccggtgtccattcagctatgaagtcagctagcacttgagacttgatagcagtgcgtgcaacaaaatgcaaatcgaacggggatagctctgccgcccacttgctgagccggccaatgacttccttgcctcggagtatttcacccaaggggtactgtgatggtactatgactttgtgggcctggaagtagtgcttaagcttgcgcgaagccattaccagggcgtaagcgagcttttccatttcaatgtatcttgtcttcgctccttgcaatgcttcgaagacgaaatagaccggtttctggccgaaatctgtttcttggacgagggcagcattgactgccaccggcgaagctgctaagtatagtagcagttcacttcctggtgctgggcttatcagggccggcgggctttgcaggtattgctttagctcgtcgaacgctgcttggcactctggtgtccaattaaactttcccgcaccccggagggtcttgaagaagggcaaacctctttcggctgcctttgagaggaatcgactgagtgccgcaattcggcccgcgagcttttgtacttcatgtacgctcgacggaggcttcacttgctgaatggcatcgattttctcgggattcgcctcgatgcctctttcggaaacaaggaagcccaacaacttgcctgcgcgaacgccgaaaacgcacttttctggatttagttttatgcccactgcgcgcaaattgtcgaaggtctcctgtaggttggacgcatggtcgaaagtcttgcggctttttacgacgatgtcgtcgacataagcttccacgttccaccccaactgcttgcaaaggactttgtacaccagcctggcgaaggttgctcctgcattcctcaggccgaaaggcatcctgaggtgacaaaatgtgccaaatgtagtgatgaaagatgttttggggatgtcgagcgggttcatgtggatctggtggtagccggaatatgcatccaggaaactcatgaatctgtttccagctgttgaatccacaagctggtcgatccgtggcaaggggaaatcgtctttcgggcatgctttgttcaggtctgtgaaatcgatacacatgcgccatttgccgtttgacttctgcactagcactggatttgccagccactctggatggtcaatctcttgaataaccctcgccctgagcagtttttggacttcggctttcgccgcttcttggcgattggcagacatcttgcgcaacttctgttttcttagcttggtatccggcttgactgctaggtgatgcatgatgagatctgccggaacacctcccacctcgtcggggctccaggcgaagatatcaatgttcttcttgagcacctctaggatgctctcaacttcttctttgcccatgtcgccccctagtgatacgagctttgtggggtcggcatcatcaatctgcacctttgttatcttgccgtgaggggtgtgctttggtgcgtgcttcggccgatcatgcagctcagcctcaacattgtgcactgctctgttgattatggctagatcgccttttgaagcggccgaaggttgaagccccttgaccactattactcctgtcgggccgggcatcttgagcttgagataattgtggtgggaaacggcttcgaacttgttcagggttgcacggccgaatatggcgttgtagttgtacgggatgtcgacgacgtcgaacagtacgtgctcttcgcgtctgttttcccccgagccaaaagctatcagcaaaagtgcttggccgagaacttgtactgcttctccgccgaaaccgcggagcgatgctggtgctggggtaagggcctggatgggcaaccccaacttggcatatgcttcggcgaagataacgtcggccgaactccctccgtcaaccaggattcgttggacttcgaagccagctatctcggctgagatcaccagaggatcttgatgcgggaacataactccttcggcatcttccggcccaaaacaaattagttggttcagatattgcggcgccccttcacccgccgaagtgatgttatggaccattcggatctgcatcttctcctgccgtttggataactgacctggcgggtcagcccttgtaatcacttggattacccttcgctgtgcatcttggtgttgttcggctgggggtgtttgctcctggactacttcacgaggtgcttcgacagttgctccctgttgcggccttggatcttgtgcattgccacgttgcttaatgtttcggcattgctccgtggtgtgcgaagagtgtccatggaaggtgcagtagaggtcttttcggactttcttgcgggctggctgctgatggttactcgcttgctgggcgtcgaactccttgcggagggcttgcacttcttcgacagtcatcacagccttgcccgcacggtcggttctgaacttcctccaggtcatgggggcttggccttgcctcggcggctgtccttggatcgttggctgagactggcgaacggagaggggaggtggttcggcaacttgaacttgtgcttgagcttgagcagcggcgacggaggctttatcgtattcagcttgtatagcttgccgtcgtttggaatcctcctcgccccttgcgaacctgtcaatgatgcgaagtaggtgctcaagcgtctgtggctccttgttggcgatttttcttgtgagttcgccctcgagcagaccagccgaagcagcgtttatgaccgacgcctcagttattcttgaacttggcaccgggcttgcgagaagcgacgcatgtactcccttatcgactctcccggcctttggcgaatgccgagtagatgttgctgcgtcttcggctcctcataggtgcctcgaaagttaaggacaaagacatcgcgcaattgctcccatgagtaaatgctattggctggtaaattgaaataccaagaacgggcgatgccgtctagagcaagatgtattacctttgccttggtattttcgtccccatgagccgcttcgatcgctgactcgtagatggagaggaactccttcgggtcagtttcgcctgaatagcgtgggacgggtgggaatttgatctgaggggggattggacgagtcttgattcccccactcagcggtagccccttttcacctcccgccctgtttaccgcaccttgctgcgggtatggcgtggcgaagggcgaaatcacggcttgtgcgtggggttgggctatagcattcggctgcccagctccgatcggaggtacttgctgagccgccatggatgggtcgaaggttggctgtgaccatgtcatggcggcttggattggtgcttggtttgccccgaagcctggggttggtgcttgctgccgaacggttggcgcctgagcagcgttgacgaagtcgaactgcggtccttgattccacggcgaagctcccaggcctggttgattcgacggcaaccaattaggcgtaccttgacttgcattcccctccgggtgagccaatggagttgtacttgaaatgtagtggggttagttgagttgctgaaggaaagcttggagttgcgcctgcagagccgaagccccttccgccattgtctgtgacgtttggccaggtggttgatgctgtacctgggcagcggctggttgaacttgcagttgcacgtgaggggccggatgcgctgctgcagtcgatggctgcccggcgaagtacattggcgcttgctcgacttgtggcggaaagggctaggtcgtcacttgctgatggacttgaggtgggatataacccgccgaatactgaaggattggggccgacgtgaccttggttcgccttgctacctcgtatgcttgttgttgttcttgcatttggcgaagcatgtcttggagccatgtcatgttctgtcgcatggcttccatgtttgcttcggcttgtgtttcagggtcagggctgacttgggcctgcactgcggcaaggcggttggggccgctgccggctgcgacggtgcggcttggggcaccaacagttggcttgtcggcaggatctccgccctggtctggagtgcccttgccgccgcagtcgccttcgccacatcggccgcgctcggcacttgcacagaggtggctggggccgaaggcggtagtgatggcgcatatgtggaagcagatggtcctcctccatcttcggctgcgggcgccgaaggctctgctccctcctcggcggccatgtctgctccggcgtcgctttccttccgccttgtaaccttctccttcacgaccttcttcagtggcattcgctctcagtggtttcgctcggagttccccacggtcggcgccagctgttgtcgaaacgacaacctcatacgtcgaaagacgtggttactcaacagtggttggaaagaaacggagtgtataaatttcagaatgtttacttcgggatcccccattacatggccctaggggactatttatatccccattacaggttcttactactagggttttaggttatgcatgggaatttacatgattacccttacgaaagagacatttacaggggtacataatgttatggaggctcatgggccgctgatgggccgtcaggcgatcgccggccctatagcccctaggcttgatgggccggaaaggcttcttcggccctcgcgggggcgaacttgccatggcgaagttgtcttccttcggcagatactcttcgccttgcacccctcgcctggggcgcctctagcctggcaaggtattcgcacgaccgctaggtattcgcacgacccttcgtctctcgccgttcttgcttcgtagtctttgccacgggtttcggcagatttggtcgaagggcctcatgttatccacaacaacatggttcgtacaaactactcccacatgttctctctatttgcaagatggacgctgttattcggttctgcgttctgtggtctgtaccacaagcaggagcccataggcgctcaaacgaatggccacatatagcacatctttagggcccatataatgcttttgtgacacagtcttctactcctctctggttcaatacaatcaaacaatcagcccaaaagtgataatggaggttatgatcttgctctactgatgagtacaaaggagaagaaaatttataacctttagccttcaaatgtgcaagttggtactccctccgttttttaatatatgacgccgttgactttttctcacatgtttgaccattcgtcttattcaaaaaatttacgtaattataatttattttgttatgagttgttttatcactcatattactttaagtgtgatttatatcttatacatttgcataaattttttgaataaaacgaatggtcaaacatgtgagaaaaagtcaagcgtcatctattaaaaaacggaggttgtacatttgaggttccatacaataaggcagtacaagatttacaatggcgtaactatagctggccatgtacaattcatttctgaacattatttatttatttccccttcccatgtgattgttacacagttccttcttttttcctcagaaaccagaccgagagcttccccagtaccattgattgcttttacaactttgacttggggcggctcactgttgcttcaatggtcccgtgtggttcatcggtcggcaggtacacatcatcagcaaactgttcaagaaaataaaaatcagttttcgagatatgagagttccggagtagcttcaattgcaatcccccagcatgagatttgctaacattgcacaagaacatagtggattataacatcatgtattttctctagattataacgttgcaggttgacaatacggcaacacttaaattcattccaatcatgaaacctagcatcgtagtatgactgtagtagccagaaaaaagtcgagcaactaagatttctatgaaccaatactctaaaataggggaattttatctccaaatccattatataattaagaacaataatgaattaacgactctgtttttgtatgtttcgttttctccaaaaagccgaatcaaatatatctgatctgtattaaaaaagagagagagagagagaaaagaacgataatgaattacggatataaagcatcagttcaagttcgtatttcttaactgatcccttcaatttagctattaaacagaaccaagacctcaagtgtgtttggattagaattgccagtttaaatctagatgtgaattgaaacccaccattagccctgagaagaaagtacccaaaagatcaggaaaacagaacaatacaaatgcagtgctacaattctcaccttcactaatcctggattttctttgttccctaagttaacagggataaagtggaggttcggcatccttagctgaacagatgctatatccgggaaccttaaaaatgcacacatatatttagtgaatgtatataagaaggccagaaggactaaatatgaccaagaaaaagttactgcaagtaacaaccaaaccagagttacagacctgttgagaacttccttagccatcaggtatagtgtattctgcactgatggactatacactccaacatcaggaggaccaaagaaagtatctgcaagaa

SEQ ID NO: 18588 - DNA, 25710 bp, Oryza sativa
aaaaaaaaacaactaataagcacacaaacaattggatgagcaccaagtaacttaatctcccctaaaatcgatgcaatagcctatgtcaaaactattcatgtacaaggcatactgggaatataaatgatgttgaactgaacagaccagaatagttaactattataggactgaactcgcttatctcatgccttgaatgaccatagctttaaatgaatataataaaatggtagaatagagggggatgacagaaactgtcaggtatataagaagagtagcagacctgcaccaggcagttacttctgttgctacaatcctttctcttgtatcaagaagaagtgtgtagcgatccctcacaaatttttcgaacccggactgagagagacaaggtggtgaaaggttagcatgcactagtacaaattgagcatatatgtatgacaaaaagcagtctggttttgttaaaatttatatttccttcgtttatacttcatcagaagttaactagttaaattattttgcttttctgacacttcagctagcactttacctcacatttttgcatttaattccttcaagcatgcgtagtagcacttgttacaagtttattcctagttcaaaagtacaatacataaactgtctttacaagtgaacccaagcaaccccagtgtgaaaggttagcatccggcaaaaatacctgagttgtctttagcagggagtatccttggattccagaatttatgagcaagtttccagacttcttcacaatgacctctgtgacgtgcttctcaacaccaagtttgaaccctaaaataagataaaatggaacacattaatgaaggaaaatatatattgcaaaatccaacttgagagttgcaagcataacaatgatcatgggaaatttgaccaaagcctagataaaggccaaagccaaagcttaacaatgaacatatttgtattctagatgcttctgaacaaacacatccggtttattacccaatattcttcagtaaaagaaataaagaaaatgtccaccatctgggacttatatgatccttaggactgctcatgctacctaagaacaagatatttttgttaccagtgtttagggatggtgaagtaatgttcaaaaggtgttgccaagggctcatcttcccgtcatttttcatttattcatccgaaacacatttgtaacgtttaggtacaaattaatgtataaatgtaactaaacagttgcttttgtagctgtggtttcacaatatagaaaagagaaaaaattgcctggtgaccctactgttgtaatttattccatttgcacaacgatccaaccaatactgggaggtaggtctggtgattcttagctccgttcggtagtacaagttcccaactcctactcatcgtcttccgcgcgcacgcttttcaaactgctaaacgatgcgttttttgcaaaaagtttctatacgaaagttgcttaaaaaaattatattaatccattttaaaaaaaatagctaaaacttaattaatcacgcactaaaacgctgcttcgttttgtatgccggggagtgagggttcccaacccttactcccgaacagagcctaagaatagctcgaaacttctatggcaggttttatgaggatttccaagaatatgtaaggatgcatctgtattacacgctcacgttgatctgcgtagaactgctcttgctgcaactatacttgtacggtgctctttcttctagtaatataaagccacttaaaaaagagaaggtttgagggtctagcttttgtgctctgattttagtagtgtgatggaaatttggtactgttgtgatattatactctgttattgttaaataaacctgggaaatttgacaccttgacctcctgacaataaaaaggagttttctaacttgagagcagactaaataatccttatgcttaaccattgaaacacacctcttctttaccttaagctactgaatgatcacgcaaacagaaagcacaagtgataaaactcttctcaccgtgggaatgaggcttcccatcgacaaccacacgctcccatggacgctcggcgatggtcaccgttgcctctgagacctgcccgaataggaaggcacccaaatatatcaataaaactcccaacttgcctcaaatacatacaatcagtcaaatcacacgccatttttatctacctgcgggtacagcgaggtgaaatgccttccaagaatcaccgcgaattcctccatggagacaatctccgtgcattccttggccttcacatacacctgaccgaacaaaacaaccacaccgaatcaatccagattctagaaccagacaaggaagcgcgagggatcgcgggcttacggtgttcttgatggaatcggtggcgacgatggcggagttgtcgtcggaggtgtaggaggggaggcagtcggagacgacgctgacggccacgttccactcgacgatgacgtggcctcccgcggccgcggggcggcgccagacgcgggagacgcggacgcgggacttgccgtgcctgccctggagctcgaggcgatcggccatggccaccgcaggggagggaggggtcagaggctcaaagcaacggatccgatctgtgcgagtgcgctctgcgctgtgcggggcgagctgctgcgttggacttggagatgggatgggccggggcggatgcgtacgggatctccttttgtagagggatggtggggcccactcattttgtagagggatggtggggcccggacacagtgggcggaagacgagagtgacgtgtcccacgctcgcgctgttcgagttggataatgtgatgcggtgagtcggtgacctcggaggaaattgtttagcgcggctccgacttcagctttattttttaaaaaaatacattaccaacgtgggtgtagtttatttaaaaagttttagctttacctaaaataaaaataaactggctaaaacactatcataaaataaactcgaaatagagttgtatttggcacaggttcaaataaaaaaataatatgaacatatattcttagctctcgaaatttatgaatttaaatttgtaattacagtgatagtgtttgaatgttgttcctattttattaaatatatattttaaaatcactatatttaatttctaaactctaaaattagttagtattaggatttgagatccagaggtgtacgatcgagcactaaattaacaaaaattaacgaagtggacaagcactactcccagaagtctaccacagtaccactacggtgaggatatagatgtagaaccgacaagctgtgtgtgacgtagttctacggtgctagcataggtacacacgtatctctatgtccaagaatcagttcatcacgtaattgctagatctacctaccatgtttcatgtcatcatgtgcgacgcgatattgaagcatgagattccacgagatttaggccctctttgcatcatgtcaaatcgaacatttgaacacctatataaagtattgaatataggctaaacaaataattaattacagtgtttggatcaaagactaaattttagtccctgtcacatcagatatttgatactaagtagaaatattaaacgtagactaatgacaaaactcattccataaccctagactaattcgcgagacgaatctattgagcctaactaattcatgattagcctatataatactacagtaaacatgtgcaaattatagattaattaaacttaaaaattttgtatcgcgaattagcttttatttatgcaattagttttattattagtctataaaatagtgtgcaaaatagaagcggcgtcattatgcatttatgcataaattgtggtacttctcttgctttattgtactttatgcacggattttattttgcataatttgcaaaagaaaaccaaaacttttattgctggaaaatacaaccaatacttattatagaaaagtattccacctccggacttccgcgagtcttagaaaataaagaaacaaatccccaactgccattaagtaataaaaacaattgaaagctaaaactaccacataggttttaacaattaagcccatatacgttacgccgtccataacgaaacaaagttcctctcgtaaccaatttcaagggtgtagcaccgttacatataatatcatgtttcttatgtgatagcatcataaatcaataatggatccagctttaacacatgaagacaacctacgtggggattgatattttttgataatttttttttgttatcagatactttatcattttggcaacgctaaatttactaacatggtgtactgacccaaaataaaaccattttttcgtagaactagacactcttctaagccaaccaccaaaaatatttctaccattttgaggagagggatttaaagcaaagaaaacacatagtcatgcaaaggatcctcttacgaagagagagaaactaccacttctatgtaatgaccgtacaaaacaaacttttttatttgatagtgtaaccacgatcaattattgacaagtaatttagatccaacaatcgcttaccttaacgagatattaagcgagttgttactggacgtgaattcaccgttccaaatccgatgaaatcaatgattgtctttcccgcatactgaggaaactgaaagacgcgaggatagttccctcaaaaaaaaaaaaagacgcgaggataaagcagagcggagctggccgtacctaaaaggctaaaaccaccgttcccgttcgcacacagtttgctgcagcacatagtttccgtctctgcttacgatgattatacttccaaatttcaccaatacaaaaacgtgaatctttgaaagattttacacgtgattacgtgagccgcaccagcgtccaacaagtgatgaatcatcatcatatcggatgatcattgactcgtgccgatgcacgtagagttagctgtacaccttataaaaaagtgatttaagccatgcagggtttggttggtgtggagttgcgaactgccttttctccaagttgtagcaatctggagtacttcgttgtggataaagtcgtaatggatagtgttgatagcacaggtccacacagcactatgttccaagcacgtattgggatcaacattgtcgtttcttttggcggagaagaataaatactactggagttgctgtcagtggtgaagccaaaacaaattaaagggggtgcaccactcaaccggacatgtagtggcacatagaattttcaagccatggtatacaaagcgtatgatggaaatatgattaaaaattcctactcagtattgtaagtattgtaagacacatcgaaccattgaataagggtgtgtttttgtgaggagaggaaagtagaagaaagcgtatgattaattaaatattaattattttaaacttggaaaatgaattaatatgatttttaaagtaatttttctatagaagatctttacaaaaacacacggctggggaagtatgtgcgcaaaaaacaagagatttttctccatgcttcaaaccaacgcaccctaaaactggtggagtatgagtactacatattagaatgtgataaaattcaaaagtcagatagctagtgccataacttctcaaattgaaattttagtacttaggataaatatacaattactccactttcctaaatcccaatgtaaatcataaactagtatcttctatagaaaagttactttaaaaatcatattaattcattttccaagtttaaaataattaatatttaattaatcatacgctttcttctactttcctctcctcacaaaaacacacccttattcaatggttcgatgtgtcttacaatactgagtatctcttttgttatggctcccttgattttatatttttaagtaggaatttttaatcacatttccatcatacgctttttataccatggcttgaaaattctaggtaccaccacacgtacagttgagtggtgcacccctggcttcgccactggctgtgcgtttggttgggcaagggcaacatgtagagcaaacatgtcgaaacaacgagatcgtagagtaccagtgtctccggtcaatggattgtttggcaatgaacttgcgtcatgaaaacgaactattctagattttgattcactgtccagactccaaacgtcgattttgacgtgcacgaccttttgacacgagctcatgactaaccgcagacgattttgggtatatgttttggagtggcaccgaaaatttttgtgcttcactcgttccaatataaatgcaatctaatacaaatataacatatcttaacactacatatataaatagacatatattaagattcgtattaataaaatatatcacatatgtattatattatgttgtacttatattacaacaaaagtattcgtatgcattaatttttagtacgggttatttttcaaataagttttctaaaagaattaatttgtcaaaatataaggctacaatactactatctgaatcaataactcaatttgagcaatttaccactaatagcacgtacacgcacatgcagagaagctcggttagtcgattaaatttacctacgctgtagtcagcaaatcagtagggcttcaccgctgcccatccactccctctttctctctctctctcttttgagcgattataatgaatatttagaaagtgggagggtgttttatacccgaggaagaaaacacccttccataggacggccctcgcggaggacgtcaaggaagccgcttgtaaaaaatggcagcccccaccccccctatagatggccaaataggtcgcctgggccagcatgattgggcataggccgaggctagtcgggccaggccatcccgaccaacatgttgggctaggtcgtgcctgcgcacgagttgcactcccgacccaagcacgacccaataagactcgggtcgtgccgggccggaccggccagaaagcacgatggctcatcgtgcttctctattaaataagtctatttttcatctctcatctctttggttgcgtcttatatggctagaataagtctatttcctccctcatctctttggaccgtgtcttatatggctgaaataagtctattttgtacacatctttctttgggttgtacctcaaatgtctaaattaagtctatgatggatccctcaactatttttctttggtcgccgagccatgagggcccaccgtgccgagggagcagcccagacacgaccgggccggcacgggccaaattgtcgtgccttgggccagcccgtcgggcgtcgggccatatggccatctatacccgctttctgggagggtggtaggtggggaccaacggtcatctgccatgtaaagaaaagctttgtagggacggcttttttttttctaaaaaaaaacaccctcccggagagctttgggcgattagttttgtaaatccctcaaacgaaaaattattatggtacataaataatttaaaagataaaaaaattccacgacgctacgagtaggctgaacagaaattcgtcgagaaactgaacttgattttctggcccatataggcaagaataagcaggatcatgggcctcctaaacgagaccgcaatgtccgataagagaacgaattcagcctgcacgagagcgtgccattcaatcgatggcccaaaaatggaataagtttactttgtgaccatcaaaagtgatcgaaatctaattcgtgtccctaaaccacaaaaccggatatctcgacttctgaactcttaaaaccggtgcaatttggcgcctacgtggtagtattgaccgggtctcctttatacgtggcgtttaggtggcatttagataaaaaaaatatatgtgggacccatttgtcatccacacataaaagaaattgtggggccgacatacatgtggagcccacaatcatcctctccccttcttcctcctccctctctctccattctctcgccgcggtcgggttcatccgggggcggcggcggcgggcgggagggcgttggaatcacctcctgctcgtggttcttcgcaaacgcctccgggtcggcgcagagctcggcggtatctcagccgtagtagccggggaactcaccggagagcgggcggaggtagatgacgcggtcggggccgtaccacgggttgccggggaactccatgacggcatcgactccaaccgcgtaagggttgcccttgagaccggcggtcgcatcagtgtcgtgacgatgaccgtgagcaggagggtgaggcggagatgtggtccttactgctcgcttctcgacatgggtcctccctgtcatccattttttttcgtggtggtggcggcggtggagttgtggtgcttcttgatatgtgcatatgcacgtatgcacgccaatttgtttgcttgttgttgaattgaacagcttgagattgtgatggctctattcgacagggatgcaaagtgacgagtagatattgcgtgtgccgaagatgggtgtgcgcagcgggttggcattgtccgggacacgaggctataccgcccacctccgccgccgctcccgtagacgccgctaccgcttgagctacgcggattcaaccggtgtggcgacgaggtgcagctgcgtgccctgagtacgattccggcgaccgtcgagggagatggggttgtcctgtcgcgtgggggcgctgctagatgccccggccaatggtggtgtgtggctttctgtcgtggcccagctcccttgctgctgtcgcctgttgtcgcccgccgccgtcgccgctccagtgcctgccgccgccactcccacgtctccgtcgctcgcaggccgccgcgccacacccgcgcctcagccgctcgcagcgcgtgggtcgccatcggcgaggaggccgtggagctcagcccgagcgccgccgccgtcgtcgctccagtgcctgccgccaccactcccgcgtctccaccgctcgatcgccgccactccggccctcgccacccgtcgcgggagagagagagagggagtggcgaggagggagaagaaactggagggagggaagagagagaagggacacgtgggtcccacattttcttttatgtgtcaatgacaaatgggtaccacacatattttttagttctaaatgccacctaaacgccacatgtaaaggagaccaggtcaatagcgccacgtcagtaaaaccgccctccaaaaccgtctagggagtcaaattgtaccggttttaagagtttgggggtcaagatatccagttttatggtctagggtcacggattagatttcggaacttattcccccaaaaatcgatcggcagtgctgtcgacctgagtccatggccgaagggccggataccgtggttcacttcatgttaacccagtagtagtttcatcttttagcgaagttattataaacgcaactttattccatcactctgtttaattccaaaacatcaatttgcttctactacagtgacgcctgaagacacaatcacacaagaaaacagcactatccttgtcgctgcatcttgtattctgacaggcacttgagaaaatctcgcacatatcgatcgttcacctcatcatccccaaacaccttggcgagctccttcaccttaaccccgaactcgtcgccttcctctcccaccatgactctcctcagcgcgtccacgatgtcgttggccgcgaacgagccgtcgtcctcgtcgcgagccacctcgacggcaaccttcttctcggcgagctgcctggcgttgaggccctgctcgaacatcagcggcagcagcaccagcctgacgccgttcgcgaggccctcggcgatggagttccagccggcgtgcgtcaggaacccgccgaccgatgcgtgagccaagaacttgacctgtggtacccagcctcggcagacgactccgcggccgttgacgcgctccttgaagcctcccggcaacccgtcgccgtcgccggcgtccggcggcgccctgaatgcccagatgaacggcagctcggatgcctcaagaccgagcgcgattctctgcagctgttcggctgtcagcttcacctcgctgccgaacgccgcgtagacgacggagtttggttcttgcctgtccagccaccgcaatgtctcctcgtggccggcgacgtcttgtggcggcggcggagggaacatccctattgggatcaccggcttctggtagagctcgccgagcagctccagccactccggctcgaactcctggttgctcctgacggcgacgagctggcatccttcgatggactgactgaaccggtagctctccgacacgccggattcgtccgggatcaagctcggtttgaacagctcgcgcgcctcgttgccgcggaacgcgacggtggtggggaaggggacgtactcggggacggcggtgaggtgcgccggctccgtcttggcgtacgggccgcggccctggagcgtctccgcgggaccgaagaagcagagcgccgcggcgccgaacaggctgaggaacgcgcacggcacgccgtgcctcgaggcggcggccggcgcccagtacgcggcgtagtcggcgaggacccagtcgggcctcgacgggcccgtctcctgcagcagccgagacagctcgcgggagaaggcttcgtcgtaggcccggcggaggtagggccggaggtcgttggaggggaggtcgatggtcgcctcggcgtgctccggcaggtgctcgacgcgcggcagcgggatgtccacgacgcggatgcgccccgcgagcgacggcggcacgtcgatgaggcggcgggtgttcctcggcgtggagaagagcgtaacccggtggccctgccgagccacgcgcttggcgaactcggcgaaggggaggatgtggccgaaggccagccatggcagcatcaccacgtgcatgctgccgccgacgccgtcgccgtccatccgaagaccgtggcgattggccagcacacaatacggagtattttccaaccaatttggagggaggagaagaatgggtagctctaccgcattggcttgactatcgatggtcaaatagggcggcaacgggcgtatacaaattgggaaggagcaaagcaaacaatttgtgtggctgcgtcaaggatgatgatatgtcatcacgcttggattggatgtaatgcagtatcactatcatgggtgaaattcagatggcgatatgcagcctgtcgctaataaattataaatatttctcctgcagcatcacgttgatggatactccatctgtgtcatggatgggaaggagtactccatctgcatggatgaactataaaaaaaagcgtatattagggtaggaccaatttcaaataattaaaaaaggtgaggcttcgaatctaatttgtgtaacccaccaccttatagagctagccggaagaccccatagacatttctactgtggacctactcaaaatttgaagccgtggggccataagcataaagtcccactacacatgaatgattatagaattgctaattctagaaattataaagggtaccccttataatttcgtttaatccctcccacaagcataaaggccttagttcgtttaaaccctaagagatgagaaatggaggggattgaggaggaataattccataccacaataggtgtggaataatcccctccaaatccccctcaatctacttgtgggagggattaaacgaccaaggcctaatattcactttccatcaattgatgaatttgaattatcccatcttatagcttgtgggtatagtttgtgaaaatatgagaaggacaaaacgaaatgatctaatagtatattttagtatatttcatgtcagtgtatgctgaatttgattatgtatggactttataataattggttgtagctcgttgagcaaatgccggaatattattccattatcaaaaaggacattttatacataatcaactaattatgttataaacttgaaattttttacttctgtttttatctcttataatattcgttgcaatgccttttagctagtactccatccgttctaaaatattacaacttttagcatttagattgtcttaaaatataacagcttctccaccaacatttccttctcaatcaatcacgacccatcaccattcaatttccccaccttctccacttctcaaccaattacaatctttcaccattttatttttcctacttttctaataatcgtgtccaactctaatactccttatatcctgggacaaatctctactattataaaaattgaagatgtttttgccggtacttttggtacggcatccgtgcttgattcggtttttgagttcaatctcttttggaaatacagatccgtgtttgagtcggtttttaattttgttcatttttagaaatatagaatgagtcatataagagatatctttaaaaaacttgcatgctaacttgagacgatcggacccctaattgtggctcatgattttgtaaaaagaatatccaagcgaattcccaaagtgaatttcacctaagctaaaccgtacaacaataataaaattaaaatagccttcacccgttgcaacgcacgggcatttttctagtatggtactacataaaagaaactatagtgatggtggtgggtccaccacagatgacagattagataatcagagcatgtagatcggtcgaacgttcggaccttgaaaaacccccaaaatacgtttcaaatttaaggttgaaaatccaatttttgactgataagtatagacatgggcgaaaagatgaggccgtaagtacatatactaggcgaggccggtggggggggttggatatggatatgacacaagttatatctagcctagtccaaatcgataatatgatgggctttatttaggaataagttcaccagacgttcctcagctatacgtcgagtctgttaaaggtctcctgaccacaataccagaaatgtgtaccctaaactatgtaaaaccatccaaaacaagatcccaaggcagtataggtacccggttttgctaacgtggcatcctaatcagcaaaaataaaaaaatgtggaacccacatgtaagtgagaaggaaaaatgtagggcccacatgccagcatcatcttcttcctttctcttttcttctcttctcttttgacgccgacaacagatggggagaggtggccgccgacgactccgcgccactcggcctcgttgacggcgacgacgaccaaccggcgcgctgctcggcctcttgctccgaacaacccaacccacaacccagcaatggatgagagggagatggccgcgaggagagcgccaagcctagctcgtcgtggcgtgggtggcgtgtggtgttgcgggcgatggggttcgaggacgacgactacgtagatgatgcggtcggtgaagttgtgaacaatggcgatggactcgcgcgccgccgctcggacccaggttgagcgccttcttcaccctcgagaacccagggatggcgtacgagaaccgccccgtgaacgtgtcggcgaacctaccgctggtggtggagccatcgttgacctccgcgcgagcgttgttgtcatcgccgtctccacgccctcaggaccaacggcaactgaggggataggcaccgccgacgcccccgccctcgggagcagcggaggcggaggcggagacgaaggcggcggccggcgggtgagagcggcgactgcctctttccccctcactcatcggctcatttgccccctcttcggccgtcctcctctctcccccctgtggccggcctcatcttccccctccccgaccggcaccagctgccgccgccgccgcctctcacccctttgctaccgacgggtgaagaagagaagggaagctaaaaaaaaagagaggaaaagatggaggagaaaaaaagagagatgttgactaggatgtgggccccacatactttttttaaattttttttgctgactaggatgccacgtcagtgaaattgggcatctatactacattgggaccttttgtggacggttttacgtagtttagggatacacatttttagtattgtggttaggggaccttaaacagactcgcgtacaatgagggacgttaggtgaacttattccttatacatatgacgtattgggccctagtccaacgtaacgaaatggatagggtctatcttgacttggaccaggcctacaacacaagtccatgtccttcgatgactgcggaaaatttatttgggccattaggaaatcaggattaggctcagagagaaagacaatagaattaggagtagattaactcaggcacatggctcgtcccaaggagacattgattgtaatagaagttccaattatcctgtcacgtcagtaaactactcaaacttctaacatcctagtccaaacaatcagccgtgctcatctgcagtaatccaagccagacattgatccatacccctatgccactgcctaagtcgaccagaccatcggtaacagcgagcccggagttgattaaggcgcaaacagccgagttcgcagttgagattagcatcagcagcgagttaaaaaggactacggtactgcaccctcctcaaaagagacggaggctaccgccaaatagaattgttagctgcaacacctaatctgcagcctagcgtaattaattaaataagctaatccacagatcttaacaccccaacattccctggcacgcagcgcacggtcagcagcagatggctggtaggaaatggcccatcttgtagccactaaacccaaaagaatatgcccgagataatacaatcaagtgctaaaagccacctttcaggagcctcaatggcatactagctgcgtggatacgtgtgaaaccagagtgtcatctgttcccatatctttccaacttgttggaaataataattcattagagcaaatcttttactataatagctaattcatataatagttacctataaatatatactaccacacataattaatatctggtctcacctctcatacacacatgtatattggagcccgtgttatagctggctataaatttgtagtccgctgctcttatttcttctttcttatcttcttaaaatatgtttatagctggtttacagtacatgctctaataacggcattctgatatttgatagtgacattaatcaatctttactccatagtgctggagtaccaaagttgtttgagatgatatttcgaagcacttcggtttggtgccaaacttttgatatttgaagtattaattttcaataccgcaggtaaaacatttcaatattctaccaattcttttgtagtgctaaaatctccctaggcttttgattatttactggtgtataaatttgttttaagaatattcagaactaacgagcagtagataattttttaataccgagagtgccccaggtggagagaatgatggcggtgggccgtcatctcctaggaagcagtgccaaacccttccttcctcctctcgtcccacctcctcgtcttgctccacagtacactcgcacacccaccacacgccgtctctctcaaaacaaaatagaagcccaatacagccagtacaccaatccccccactcccggtcccctcggattccgcccatgccgccttcccgccgagagccctagccaagcccgctcgctgcttgctaacccccctccgcgcgcgctcacccgagtcctagggttccagcgagcggcgaggaggtagctcgttcgcgcgcgcgtcaaatcccatggcgggcgccgccccgctgcgcgactccctccgccgcctctgcaccgacgtcggctggtcctacgccgtcttctggagggccacccgcgccgccgactcccagcggttgtgagcgctctcactctgatccccttcccctccctgaattttctcccacacacctcagttcaactcgacttgctagttgctaccaccagtactggtagtgtactccgtagttgctgccgccgtggtggaattggctgcagaagaactgcgcccctttttttttttgcttcctaggactgcaataaatgccattgattgccacctttgccgcaaacaactggacaattggtccttccgatggcgggttcattgattttggctggagctgagttcgaattgcactttcgtttttggcttttgtgtggcaggaaattggtgtggggggatgggcactatgagcgggcggccggagcgccgtcgatctccggcttcgaggccatggacctgctgctcaaggagaaggccgcggcgttgcggagcggcaccgggcgcggtggtggcggcggcgaggggcacgcggctgatggcgccgcgggacacagccatgacagggtggacgcgctcgtgcacaaggccatggcgcaacaggtccacgtcgtgggagaagggtaatttggttttcgttactagtagtgttttgttttggatttgtgctctggttctatgggggtagtggtgtgatttggttctgctattgctgttgctggccagggtgattggtcaggctgcactgacagggttgcatcggtggatcgttcacgatattgttgatgagtgtgaggaagaagatgaggtaattgccttcgatattgccctagttggtggtgtagctcaaatttaaaatatacatgccttaagtacatttaggactaggagttacaatgtggattgattcataaattagttgctctgaacatatgatgtactgttcatcataccattccaaattagagctgctgtttcagaggacaaatcccctttaatttgttttctaggtcactctgcttgctttgctaactctatttgttgtatattttttttgtttttctgtagcgaatgagcttgaatttcgttgttacaactctttagttccatcttgatgcaggtattgctagagatgaagggccagttttgtgcaggaatacaggtctttatgctatttctttcatgttccattaccatcagcttccccatccctcgtgttcatctaaagatgcttgcttcttaacagacaattgcagtgatacctgtccttccacgaggcgttattcagcttggctccacaaaaatggtaagttacttactcattatggcctcgtgaaggtgctgagattacctactccctccgtcccaaaaaaactcaacttctacagtttgaattttgtcccataaaaaaccactttctaccatcctacctaccctcagcacgtaaaacgagaaattttattccttcaatactctttacctacctatcactcttactattttttcaatgattaaaggtatttttgtcattctccatctccactaatttcacctcgggatgctaggaatgtattttttgtgggacggagggagtatatcctagtcctttgcagaacagtaaccctttatttctgctttgctcacactttcctgtactaatgaaaagaaaaaactttactctatcacgaggttcaaaatatatggttttctttatatatatttgtctgcccccaacccccccttttttttcatttccacttctgtttcctacttgtagtgaacttgaaccgttctgctgacaattttgaacagtgtgcctccacaaattttgaaataaagattaggttaggggtcttattctatatcctatataatccgtcctggatcctgatgagctagcagaaacaacaaaaaatgttccttctgttttttgttttatttgttcaattcaaaattcagtggtttctattttgtttcaaaggttatggaggaagcagcatttatagatcatgtcagatctttgtttcagcagctgggtagttcaactgcagttgttccgtgtggttcctttgtacaagattcgattatgagaactccatttcacaaatcacttggtgtgcctacctcttcgcactcggaagaccttgctggtggtggaaatacttataatgatgacatgattaaccaccagttcaggcatcagaagtcaccagcctcgacaattcagtcatttaaccctgtacaacagttctatgctgggcctactttctgtcgtccagtaactattgcatcacgttgtgatctcttccaacctgaccatggatcaacctttactttgaacagtcagtcagaggacaatagatcgacagctttactcaaaaatagtgtttcacattctaaaacatcaaatgatgccttttcacacgcttttaaccccctcaatgaacccaacgtctccatttcaggcagaagagagtgtgtaagcatagaacaacatggttcttgccgtaatggagaaatggaaataacaataggccgcactgcttcttcaagttgtacaggcaaaacaaatattatcaataaagtggatgatttgctgagtcaggattgtttggtaggttgtcaggcaagcaatgccacatctgtgaacagaaagtttcagacaatgtccattgttgataatacaaagcttcaagatggttcttatgcaattccacatgctgcacttgttgactctacccaatattcagactgctttcaatcgcttcttggcacaatccaaggtagttcttccagcaattcaaatgcaattcatgtggatacttctcataatgctgtccatggaaagagtaacttttgccctttaggagataggaatgctgctaattcaagtgacttggctgaacttctggcatcgccaataccattagagttgactgggggaaacgatttgtttgatgtactgcaacttcagcagaagccaaatggttcaaataatagtgaagtaaacaatcgtcaatcaatgccttatggttcagagcaagctgttaagtctctgattggatgtgtggatgatgatttcactggattgatcacagaagctgatccagaccagctcctggatgcaatagtttcaaagataatcacagggcacaagcagaacgtggataccagtgcttcttgtagtactacagtggcaggctttgacagaccacttcattctgattgccacctatataccacaggaccatcatcagggccaatattttgtaattttgccagtgttgctcctgtagcaattaaaactgaagggcctgctgcaggttccaggcaatcatcttctagtatagataaatctgcaggatgctctcagacacaggaaagttacaaatcacagataaggctttgggttgagaataaccatagtgtaggatcagatagtctttcaactggacaagcatctgacagtctttcaactggacagtgtaaaaggagtgatgaaataggtaaatcaaaccgaaagagatctagaccaggggagagtgcaagaccgaggcctaaagatcggcaaatgattcaagaccgtataaaggagcttcgtgaaatagtacctaacagtgcaaaggtaacagcaccaacacatagatacccctatattgacctttaaaataaaacacattatttatcatatttttggtacttagatttctgtttgattaaacagtgtagcattgatacattactggagaagaccattaagcatatgcttttcttgcaaaatgttgcaaagcatgctgataagttgaagggatctggggagccaaaggtatgttgcatgatagtacttatttttagttatgtatcagtatcttgtatgaacaaggaacagccattaatgagagtgaacatctagcacaacagataatgtggtacttttccttgttatttagtactccatccatttcttattataagttgttttgacttttttctagtcaaacttttataagcttgatcaaatttatagaaaaatataataatatttccaatataaaataaacatactatcaaaatatttacaatgttatatttaatgaaactacttagatatgataagtgttgctaaatttttctataaacttggttaaacctaaagaagtttgactagaaaaaaaaagtcaaaacgacttataatatgaaacggagggagtagtgaattagctgagcccaaaacagacaatctctacattcttgatattcttcgtcgttccattttcgtcattagcttgctgctactgataattgatacaggtaaatgacaggcattacatgatcaacattcaaatttcctatggtccttttggagatctcctggagttaagagtttcagaaatcagcattgtcttgtttcagcaagtctttttggaacctgctgttcataatgaaatgtgattgaagttgttttaaagccaaagttgtcaataaatgactaatttatctgccaatagcccaataggtcaaaattttcgaaattgactgttttgtatttttcgatggtgacagacctttactatcataaatttgtgaagaatgctattaacataattttctttcttcaatgggtacttttcaagtaatcccattagatttctaacttgattagccccgatagatagaaaagaaaggtagatttcattgctatatttcattttgtcagagtgttttttatgaatacattagtaatctaactattaatttactcaagctaccctaatccgtgtgagattttcttgtttcatggaagcagattgttagtcatgaagaaggtttgctcttgaaagataactttgaaggtggtgcaacctgggcctttgaagttggtacgcgatctatgacatgtccaatcatagtagaggatctcaatccaccccgtcaaatgcttgtggaggtatttgctacttctctgttttcttagttcttgtaaatgctactgcacggtaattctgagtgatgattcgaacatgttgtaattgttcagatgctttgtaaagagagaggaatcttcttggaaatagctgatcaaattagaggtttagggttgactatcttgaaaggtgtgatggaagttcgtaaagataagatttgggctcgctttgctgttgaggtattaaatctttcctcgtctctcttcaacttagtaccagttcttatgactatcaatttttctgccaaaacaccaagcaaaatcacattctagcgtgatttgattatgaagctacaagtggtgtggactgagtagtatatcaaagtttaattaaaatattgaaatttctgcaggcaaacaaggatgtaactcggatggaaatatttctttctcttgtccatcttctggaacctagcactgggagctctattttgtcagcaggtgttgagaacactagcctgccgcgcgatagtttctttccatcgtctattccagcctctggtttctccaactgcttgtgacacgatgtaccatacctcagcaagtggagcgctgtgagtgggtaaagtttcacctgccgtgaccttttctccctgccttgttctagctgccacagatagttacgctgactccagtatcttgttgcctgtctccacggctgacgttgtggcaaattactgttcagtaagggagagatgtgtgttttgtcctaaccttaaactacatcgcagccagcctttgtgagggaaagaagctttagcgtaggaaattgttgttttaggcaggctccacaagtgtaagaaatgcagtacataaatgattagagatttagagttaggatagcatcaggtttttctgctatgtaatatctgcattcatgtgcccatttggctctctggatctgctaacctggttgtgtatttgcagttcggtctttttcctctgttcagcaagtaccacttgaatgagtgcctcaccattttttactgaatactgaggtgtgtaatttggaaccgcagattaacagaatacacagattgtgattactctaagtagtacgagtaccaaggagtagataatggacttgcctaatacgtatccgtatctcattacactcattacgcatatccacaatatttcaggttaggatcccattaaggcaaagttcctccatggaggttactattgtctttgttgtattcctcgtttttttttctagccctgggatgtagctagagtgattctaatcccaaattgaatacgtgtagcatgcaagatcgaggaaaacacagcaaaatagtctcttgaaccaaagaaatgggattatcctcaaaagaataaatgagcaacctaaaaacagctcagttgagatacacatatcttttctctaggcacaatcatgttctctcctcttgatccaagtaaatttggaaaaagaaaaaaatggcagcaaaaagaaagaaaggagaaaaaaaaagaagaagaatgaacaatggagtggtggtcgtcatgatgggtaaagcgccaagaagctgggagacaagcatggcgaggccctccagaccctggagtgcagcttgagcacctcgtgcgccttctccttggtcttcaccccgcactgctccgaccgcagcgccaggcacagcttccccaccacgccgcactgcgccatctcctgcagcaccgccggcgtcgccgcgtgccgcgccaccgaccgcagcacgcgcaccgcccgctcgctcgccgcctccgacacccgcagcaccttcttccccaccacggccacgcccgccgcgtgcgccaccagctccgcgcgcccctccgcgcacgtgcacagccggtccagcacggccagcgccagctcgcacacgcgccgctcgggctcgtccagcagcagctccaccagcgccgccaccgcgccggcgcccacgatcttcacgcggtgccggccgtacgggcagagcgcggcgagcgcgtggagggacgccttggtggcccgcgccgagacgcggtcgcggaccacgccgaccacctcggcgaggagctccgcgttgaggccgatcacccacgccgggaccaccgcgtcggcgagcgtcctcacgagctgcaccgcgtgcgcccgcgactggagattcgacgagcggagcacggccgtgagggactccgccaggttgccgtgcctggtcgagacgccgatcagctcctgctccgggatccggagcgacgcgaggacaccaaccgcctcctcccgcgccgtcgagcaggcgctgccgctggtcacgacgcgagatagcacgtcgaacaccccgccctgggactccagcattgccctgctatcctcgcactccgccgccagctcccgcagcctcctgagcgcgcccacctgcgccgcggcggcgtcggacaggagcgacgcaacctcgtcgctcgaaaccggtcgtagcgcggccacctcctcgtccacggccgacccgggggagacggaggccgcccacgactggatcaggcggcgcagggtgtggttgggcgtgagctccagcccgtgctcgagcggctgccgcgtgacgggacacgtccggcgggcccccggcgcggcgagccaccgcgcgatcgcggcgcggtcgtacgagatccccgtagggagcgtgacggggtcgcgcatgagctgcagcgagatcgggcagacgaagtaggacggcacctcggccgccgcgctcgccatcgctgccatatccgtcaccagtagtaggagtgcaccagccgatcgccacgccacgcacttgttcaccggaatgcgcgcgagggccaagaatatataccgcgagatggcggtggcgcccggtggtgcgcgttcgcgagtcgtagctgttcttgcggctgcgggtagggagaagaagaggaggaagaagaggaagacgcgcgcgtcgcggaggttgcgcggctgtgcgttggtttggtcgcggttttaatttaaggcgcgggggattcgtctagtggcgttcacatgcgtcgcgtcgcaccacatcacatgctacgccgcgctttgtttactcgtcgctcgcggttggggtcagagggtgctgtatttgcgttttagtcccttgggtttctttaatttggggggactagctccctttcctccttcacaaggagaggcttttgagtttcggtttgactttaatttggtgaggtcatgagcgttccgtggctaaggtttcctctgacttttgatggtttggaaaaagtataaagatgacactgggaaattgggagctcaatgtgaacgtcttgtgcataaaatcaaaggttagtctgtagtaagatcaaaggttattattttgtatgattatattcgaaagaaaactgtacaatgcttaagtttcttttgtggcgttgattattcgggacacgtttatcttaaaattctactccaaattttgaagatttagtacaactattctaacttcatggcaccgcaaataagaggtttaagattgaagaattttgatccacatgacgagttgccatgctatgatagaaggcaataaggtatcaattaattgtaaattattgccagataagtaagaatgatgtgacactaacttactttgatcacccaggtaatggattgcccattttgcatataagtgataaatggacttctttatttgaaaatgacgcgcgtcgactatagaaactcatcaccgtcccttcagttacaaaatgctccttttcctcatataagacgaatagtccttgctttgaaacagtatcagtacacacacaattgctatcaatcctcaatcagtaactactaaccaatattatttctcattttgacctttgctccagtttcctcggagaacaccaggaggagtcttcccataattcactcaatcccaggtctccttttgcaaaagtaacctattccagtcagttgatggattggaacagtgggaaaaggctccactggttgacctggaaaatttccgagattaattaacaaaaccgagccggtcagaagcctagcgattagcgctggctctgcactgttaacacttttgtttattcagatctctgaccttgccggtgccctgcatgttccgtttctcttgaaatgtgcgcgcccctgttcgtattaggtgccctaattgagggcttgagtgcttgaccaactaattcctcaattcttttttagtgctcccctgatctaaccagatgatcagctcttatctgtcattttgagtttttttttctaatatgatcagctcttatctgtcatcttgagggtttttttttaatcattgatcttcagaatctttctctggattcatctttcaggtgatgtacatgatctttcttgttgatgtgacaccaaagattttctgagggaaagtgatcttttctgtattaacagatccgtgattcagtgaatgggttgctctctaccagttgtatccttgtagcaactagagagaaaatgagaaagcgatgtccactaggttaatttgtaggccaacttatggaatcacagtactccaagtcaccaaagctaccaaattagcgttcgaaaacggctacatatatagtagtgattgattagtaactcttagctccaattggaacttgagaactggacccaattacctaattggaccactagctagggttattttctgtttccaatggagtaattagtgagtgaaggagtaacaaaattgccaactaacctaattgttaggttcaaccaggagtttggtccaccgttttgccaaatctaggggtagatatattattttggatttttcagaaaagaaaagcctcgtctgatgtatatctgtcacttgcaattaattaaggctattgtcagaacacatgagagaccatttcctcctaaccttgcatgttgttctccatcatggcatcatgtcactggtacgttt

SEQ ID NO: 18589 - DNA, 176 bp, Oryza sativa
aatttgaagatgatgtaagcaattcaccagatagtacaccaaaggaagctaaaccaacaaacaatgaagttaccaaagttacccgaccccaagaaaggttggtttgctcccatagctacagtatttgaatttctgtatctattttttcttctcttcacagtttacgcaatacttat

SEQ ID NO: 18590 - DNA, 538 bp, Oryza sativa
gacaaaaatttaaataaatgtgttccagggctggagaaaaaaaaaatcatatgatcatctaaacagatgcggaaaaagcatttgacacaagtcaacattcttataaaaactttcaacaaattaggtatagcaggaatacttctcaatataataaaggttatatatgacaagaccacagcttacatcatacccaatgatgaaaagctgaaggctctttcctctaagaccaaaaacaagacagggatgctcactctcaccactgctattcatcttagtgctggaggtcccagccggagcaattagacaagaaaaagaaaatgcattcaaattggaaaggaagttatgaaactgtctctgttttcacatgacatatatcttatatacagaaaattgtaaagactttaaaaagactgttaaaactaacaaatgaattccggaaagttcccggatacaaaatcaacatgcaaaaattagttggttttctacacactaacaaggaactatccaaaaaagaaatttagaaaaccatactatttac

SEQ ID NO: 18591 - DNA, 280 bp, Oryza sativa
agcacttggtgggcgttgttgtgcaggcgcgtacaccgcgtgcgggggaggcgcggcctacctgtgggtggccgtggcgtgcagcgtcggctcggtgtgctacgtcgtcgccaaagccggccgtggtgttcggcgcggcgcccgacagggccgtgctggggctgcaggccaagggccagctcgtccgcgtggaggccatgtttctcatgtcgctcgcgctggccgccgcgcacatcgccatggcctaccgcgccagctgccgcgagcgacgccgcctgct

SEQ ID NO: 18592 - DNA, 733 bp, Oryza sativa
agaaccccagagtccgcacatcctcaaatacaaagcacttccctagttagatgtaggttagacttcccgttcgataaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatggagaagaagagcgcaacatgaaacgtaagtacaaaagtacccgacacccacccagatcccaatagaatccgccaaatcctgcgggaaattgtaattccattcaccagctcctacatttaattaacaagagaactattgtatttatctaacacctggattatctccacctttcatttgatccctatttatagattacgctgcgttgctaacgggccgcac

SEQ ID NO: 18593 - DNA, 7057 bp, Oryza sativa
agaaattctttttaaacccggttagggttaagaaccgggactaaagattatagcactgcatatgattttcgcttacatatgtgtttataaaatagaagttaatgcattaacattatttaaagtactaaagattaatgacaattacttcgaaaaattatttttgtctgtaataaattaagtggataaatcgtaataagcaaatatatgacttataattaataaaaattccaatatatatatatatacttagcatatatatgaatgatattattatattggtaaaaactctaattaagatatgtatgtacatactgcatgatttaaaattaataaaaattgtaatcatcatatatacttagcgtaggaattatattaaattaaatgctaaaaactctaattaacatatgtaaatgccacatgcatgatttaaaccttttaaaaattcgaatagtcatatataagtagcatatgaaagatagtaaattaaattgtgaaaaactctaatatatgaatgatagttttaaaaatatattaaatttaatacttttaaaaattctccagtcaattataattagcatatgaatgatagtaaattaaatgttaaaaactctaattaacatataaaattgccacttgcgtgatttaaaacttttaaaaatacaatagtcaattataattagcatatgaatgctagtaaattaaatgttaaaaactctaattaacgtacatatgaaattgccacctgtgtgatttaaaacttttaaaaattgtaagtatcacatataactagcatatacatgatttgaacttgttgaaacctctaataatcgtgcgtaattaacatatgccatacatcaattgatttatatggataatcaatacatccaaaatagtttacatcgtgtacacaataattacggcattacatcggcggtgacggttgaccgcacgtactttctcctcactattgatccctccttgtgatcgctgcgtgagtaaagggtgtcttcatttgataggaggatgctagggtcaatcgtcaccgtgaaagggggttgcccatccaactgatcgtaatcctcgtcagtcttgtcctcaactccgacgatttttcttttgcctgggagaaccacttgacgcttaggctcatcaggccctctggccttctttcctttgctagacatgtccttcacgaaaaagacttgcgttacatcattggcaaggacaaaaggttcgtccgagtatccaaccttgttaaggtcaacagttggcatcccactgtcatcaatcattacgcctccaccagtcaacctaacccattggcaccggaacagaggaaccttgagaggaccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaagccaagttgttggttgatcgactcgttacccatgagatgttgtcgtagccacgcggggaaagtatcaatgtgatgccgtgtaatccatacatcggacttaccgatgttcctggcgcgaactagagccaagtgctcctcgatgtaaggagctaccaatgaagagtgttgcagaacagtgaaatgggctttacggaataaattgttgtctaccgtcataattgctttccttccgagagttccctttccccgtagtctcccttcatggcgtgattccggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgtgtcattatattgaaaaatgaaggtggaaatatcaactcaaaactgacgagacattgcaccacttcattctgaagggcatctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcgccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcgtgaccatcttcgctctctatatgctggcttccagggccctttccgaacactactttaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcctcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaaccccttttcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttatttagcaaatgaactaaatttctatatattctttcttccccacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttaaagcttgctcgggcagctggaggaggaagaagacatatatataggggtgggactttagtcccggttggtagcaccaaccggggctaaagatcaccgggatctttagtcccggttggtattaccaaccgggactaaagttaacatctttagtcccggttggtgttatcaaccgggactaaagataccgggagggcctgacagaccctgacagcattcgaaccgggactaaagatcatctttagtcccggttggtaacacaacccgggactaaagatcaaatatgcccgttacccttttgaaccgggactaaagaacatctttagccccggtttttattgcatccgggactactgtggaaatcggccgaccgacgaaagatggtttctccaccagtgtcatgcttaaagaacatttgatgatgaatcgagtcacaataaaataaatgttaattgtataaatttttttgaataagacgaatggtcaaacggtggataaaaagtcaaccgcgtcatacattaaaatatggaggtagtagcatgtacattacataggtgaactgatgagccataatatttaattttagcaattccagacaattgcaaaaataaaagccaattctaggcaacttcacaaataaaaacatatagcttggttacttacatctaatcctatatatgcaggtggaaaaataaagtgagcacaaaccttagcatattccatgtgtgattttgtaataaatgcttgcatgaaactataccaactctatggaatgaatccaggaagcaaaaagtgcagagaagcgtagttggaagttcatgaaacatttttgtctgatatatatatggaggcaattgcaggttgttggttaaaaagaaaaagaaatcgaataacacaccaaagaaatcttgcaaagttattttacgttagtatagtgaattatttggattgatcagagatggtaaagaaagaagcacttggggacttggagagatatatatgtatagagagactgggaaaagaggctagatatattgccgcgctgttcttaaatcacatggcagctcggtaggtgaggctctattcggtgccaagggtggatttagagtgtaacaagtgagggccttggcccccacttaaatttgcagtgagtggggacaaatatcccttgacactttttacttccttaattagtctacctgagcggtagatccttggcccctactcatgctactttctgactccgcccctgttcggtgcctgcttgcatggatcgaccttgtcagatgtagatggagacagtggtcgcatcgttcactacctgtgattatggatgagatgatcttcacaaaatatgggaaaattcctaatggagtattgacgaagatcgatgccgctcacctgcaagcgaggcaaataatttctgccgccggtgccttttgtgctcgttggaacggacgcaaatggacgctacggcctaggagaaaggtgagagtagaaattacggagtacgtcgataggtgatggctgggcttctattctatatatgagagctgcactgttcttgggcttgatctgtcagtgttcagaacttcagatagcttagaaaaccagatcgctgttggatggaggtgtcaattaatcgaattttgtttgatgacgcggcttcacctggaactgtgcacaaggtatgcacgtcgccgtcctcgtacgttgccccctccggtggataagaaacaacagcaaaccgcagacacagtacacggatatagcgtgaaaggcaccgaagaaagaagaaggctgcaaagatcagtacagaacccactacgatacccataatgcaaacgaacacaatccatgcaggccgctgaagaagtccgaatggtaaaagcgactcatatcctgcaacaatgatttttaaagtatatattaaattttattttgcacaactgttgagcagaaacgaagtagaactgatgataataataaatgagtaaattttgaaataataataaattagtgaattttagaaaactcatatattttgcggccagtgtaacacgtaaccacagctccttacttattttatcacataactgctgtttttttcttctggtcgaacagggcatggcggcggttcatcggcgccggtggcggagcaggccatggaatggagagagaggccagttccggcagcacagtggcgtgcggcgactccggtagtaatcttgcgtggcggcgggctcgggcaagggatgcgcgaggcagcgctgccaaaccaaggatgcggcggcggtgggggggggggggggg

SEQ ID NO: 18594 - DNA, 9088 bp, Oryza sativa
  unsure (1)..(9088): unsure at all n locations
gtataattaacttcagttttgaatgaggagaagctacgctacgtacggcggccggtgaacttggcgatttctctccggcggccgagctaattaacgtttcatgtccggccggcgacggcgagagaaaccgaggaggaagaggagggttaaggcggtctcattagttacctttttggctagctgcagtcgacgaggctgctcgagctcgaagacgatgaagatatggaggtcgatcagggtcgagcaggagtgatcgatccgcggcggtggcagctggcaacaagcttggttgagcgcgcgcgcgagctcgatctcaggtgtgggggtttgctgctgcggtggcggcagctcgatcgcgcgtgcgtcagcgtgcaaggacgaagctagcagctgcgtggtgcgcgcttgcggcaacggcggtgacaatcgaccggcgttcacgcgcgcgcgccgctcccccgtcactcccgcctcccggatcactctcactcccagctagctaggccaggctaggccccagcgcacgtgggcccaaaccatctccgtgggtttctaggaatgaatttatttataaaacataaatttgagaaaagaaaaggtgaatttcacaaaactactacatatgagatacgctgaccaaactatcacaaacctatgtatttaatattgaatttatcacagagctacagattttatagtttaaatcactatcaccactattatgtttgtatagttttattacaaaattggttctccgaagaagcaaaaacagattttgcgaaaaaatatatacacaagttgttattgtataaactttaaatgtataaattttcgatatataaactttgcataaataaattttataattttaaaaaaataaagaaacatttcgcaataaaaaatgaagaaacaaaacattgatatggcctgtgaagcttatatataatctctagatgctctctacccagattcaccgtgcatctatctagaaaaggaaaggaacgaaaagtactaagcccaaaagaaaaacaacgagatcggaggcccaaatagagcaatctttgtctctatgacataactttttttttcagaatttcagttccaatgataaatttattcaacacgtcacgagaaatgccaactattcctagcggaaaatatagtggcttgcgaagcgcgttaagtaatagtaagaaaactatgctagacaaaacttgttaggcacctctatttgtatcaagttaattactaaaactatgctagacaaaacttgttaggcacctctatttgtatcaagttaattacttgaagtaattctacttctattttcagataggagctcttgtttatgtcatgaacaaaatcaactatagagagtgttctagaaagatatactaccatacgccaactatacaatttccatgaaaactaatattaacatgtttcatagggaatgtgtgcaaagctatttagctgcagactaaacgatctggaagaagtattaatgtttgatgcccaatgtatagaatgtgtgcaatgtttcatagtgaatgtgtgcaatgctatttgatgcccctctcgccatggcccaggaacggtggcttcttgttttggtagtcactactcactagaagaagcaaactagtcaatgatcttactattatatagttgcgttatttagaaagttatgtgtgtactaaaatttaaagtatatgtgtatttctctgatgtttatttccggacatcctgccgctcaggcgaccgccggagccggggggcnctnncnccnccccccccaaaaaaaaaaaaaaagacgtgtgcacgtgctcctggccccaccacatgtccctgcccccacctgctacatgtctccaccacatactccgttgcaacaaatcacccgcatattttggaaaccctacattaagagaatttgtttctttttttttccaaaaaaatgtttcactatgtatagatctaatgttccagtgagttgaaacattctttttaacaaatcacccgcatattatggaaaccctctattaaagaaattcgtttcattttttgtttcacaaaaaatgttttgtaattataatgtttcactatatatagatcaaatgttgcagtgaactgaaacattttttcactatttgttgaaacattatttttatataagatgaaacaacgcctgatttaaatgattgaaacattttcgatctacttagtgaaacaattccgatatacttggtgaaacaacgtgcaacatttaaaaataattcaataataagctaattttttttcgtcggaatatatccatgtgtggtcttgtttttaaagatttaattgcaacgaatttaatggtgcaatcggatcatgatttggataaataatttaagagaaaaaatagtttaaagtgtttttgcacgtatgcatcttgctgacgtcagcatgacgtggacgcccgatttttcaccctggatcaggcgcccgatgtgtaattgcctttgtttatttctctatgaatatctatatacttacccatggagctgatgactttgtcagaatgcatcatgcatgtcagacagtggtatataataaactgagtataaaacacattctacataataagttcgttttatgatctgggcaaagggcagcgtaaacgtaggtcttgattctgcattacacatgaagcttgccgtctctaaatgccgattcttacaagaacaaaagaaggaacaaaacaaaatttcatctcccttcaattatttataagaaaaagaaacacctagctctcacaaattctacctctaggtgatttacccataatagaagaagagatgaacaactcaaagagggtccaaatacagagccaagtgataagcatgcatttaatttgcataagattagtttttttccgtattgtggcctaagaaccatttttggagggaatgaggaaatttatcactggattcggtaaaacaatgtgaagggaatggatttattgcacccataagtgaccaaaaaaaatcaagcataccttgaaataagatttgatattctcatttgaagtccaatgtgacaatcttacagcaagaacaagagctgatagtaataagactattgaatatcctgccatcacataccattctggaactatcaagcaatgactcacagtcacaagtcacaaccccttcccttccaaatgtagcaatgatgatacttccaaaggctcttttcggtgtaaagatgtttccaaattgatggattatttcagagggattgcaaggtgctcaattggacatggtattaccaaattctaaatgggaggatgtctggttggatggacccccaatctattttcagttcctaagactcttcgatcatttgctgttgatggaaatgtttctgtgaaaagctttatactatctaatcttgaagacaattttcaactgtctctatcacaacaacctcatgcagatttcttaaatttgagggaattgataaatgaggtgaatgtgggacatgattgtgatcaatggaactacatatggggcaatactagatatacttctaaaaatttctatgcactaaacttcagagcaatacaacctcaccacttttgttgtactccctcagtttcaggttacaagacgttttgactttggtcaaagtcaaactactttaaatttgactaagtttatagacaaatataataatatttataataataaattagttttattaaatcaataattgaatatattttcataataaatttgtcttgggatgaaaatgttattattttttctacaaacttagttaaacttaaagcagtttgactttaactaaagtcaaaacgtcttatagcctgaaacgggggtagtaattattttctattattcttatcaataagtttccctaccgtggggacctcccctgatgtgttctattaaagaaaaatatagcaatgatgaaaccatgcacccctaaaggcctgaacatccacagcactgggagtccgtattgtgcatggaacactaaaccctaaaacccttctgaaacaaggaaaattttcaaaaagaaaaaaaataaagaagtggagtatttgaaattttaaatccataagaatattccactgaagtccaaaagaacatatacaattaaatccctgtggaacagcttgtttcgtatgaatttttacaaaaaagcaaacgtaaggtaagacctcatgctttctccttctgtcttgattttcgatatttttcctatcatccaaataattcaaaatattcccaaaatttttatttgcttggtgcctatctgccaaagttaccaaacacaccttgttctcgactacattgaggagtgcctcggatgaaatgcctgagctgcagaataagtaatgatcattatctgttagacacaatgcacacaatgtttgggtgtaattatccaggtaacataccgatatttagatggcacttaccctacatcgaagatgggtatccaaaacgtgtcgcatgtctgtgtgaacaagtcaaaggaaccaaagtcgtccagtccagaagcagaatagttggagaggctggcttggtgacccaggaaagcggcagagcagaggctcaaccccaagcatatcatatttcataatccatatgcagcaagaagcctgtgttcttagtattcagcaccaactgtgtggtgatggcccccttgagtgcaggggtctctccagcctctgggaaatatggcagtaacttcctcagtttaagctgtgaaccatttttggagtgaatgaggaaatttatcacttagatttgataaaacaatgcaaaggaaatggatttgacacccataagtgccataaaaatcaaacataccttgaaagcagatttgatattcttttgacatccaatgtgacaatctgacagcaacagctgttagtaacaagaatatcatcacaccattctggaactatcaagtaatgcctttccttccaaatgtagcaatgaggaaaccgggcacccctgaacatcctcagcacacaatccgttaagatgcaaatgactggaagtctgcattgtgcatggagtggacaaacaatttgttactatacttctctgcttgtcaataagtctgcaatttgcattacctctacgtctctgatagtatcgttataatattttgtgcaggtataatttctcgttacaatgcacagatcctcttcatccagatatgtatcttccatatcataaaccttatgtcagttccatatacaggtgctccaggatagtataaatctcatcaaatttgggatggtagaagtctcctgctaagaactcatgaacaacactatccacttcaacccagctgcaccctgctgttttgtcaataacctttctcctcatcgatagctgcacatcctcaacagcatcccattgctggcctcgagctagggtgtttctgaggagaacatagttgccaggattcttgggttcaatcctgatgagttccttcgctgcaatctcaccgacatcaacatggcaatgcttcctgcaggcattgagcaatgctccccacacacctgcatgtggtttcactggcattgtcttcacgaaacagtgcgcttcttcaatgagcccagctcgaccatatagatcaaccacacaagcgtagtggtctggggattgctgaactgcatatgtggttttcatcaattcaaagtagttctttccgtattccactagcccggcatgagcacaagctgatagtacgccaagaaatgtgacggcatcaggttgcaacccagagtcaaccatcgcattgaaaagatccaatgcatctcttgcatgtccatgttgcgcaaaagcaatgatcatcacattataagacactgtatcctttggatatgtctcagtaaacaagaattgagcttggctgatgcaaccgcacttggcatacatgtcaatcaacgaattctggacatggcaattcatctcaacacaactcttctgtaaaagtccatgcacttgccctgcaattgtcaaagaaccaagctgtgcgcacgcagacatcaaaacagccatcgtcgcagcatcaggctcgaaccctgtcgcacgcatcctattgaaaaccttgactgtatcagccaacgatccttcctccgaacatgcggcaatcatcgtgttccagctattcacattcctcactgtcatctcatcaaacaattccctcacagtggcagtatcccccaaatgcagataaccggacatgagtgtattccacgagattgggtccctctctgccatcccatcaaacacctctcgcgcggctcccatatcaccggcccttacattgcacgccaccatagtgttcccgaccaccacgttcttcacgggcatttcgtcgaacaccctccttgcatctcccaccaggccaatattcccgtacagatcgagcaacgcagcgcccacgtgcacggaggagcagcccagcccggcctttcgccaagaacgcgtgcacctggagaccctcatggacggctcgcaccttcgagcagcacttgatcacggaggtcacggtgaaggcgttcggccgcgggcccgaccagagcatgagcgcgaacagcgcgaccgcctctcccgcgacctcgagggcgtgcgaggaggacgacgaggcgtgcctcgcgtaggcggagatggtggccgtccataggtacacgttggccgaggcggcgggtacgctgtcgaaaacggcgcgggcgtggcgcggcgaggacgacaactcgacgagcgcgacgtcggcgcgggcgggcagcgggagcccccggatgaggaggtgcgcgtgcagctgcctcgccgccgccgccgccggggacgtcgcgccgcggcgggcgaggccggtcaggagcgcagggagcgggggcggcgccggcatcgaggacggagttcgcgcccgcgtctcgccgccgccgccgccaaatggctttgcggcatggaggtgaagcgcgtgtgcgcgcgagggtattttgctcttctacactgtaaaatttgatacggtctcaaaaataatctttggcttatgatttctcaaaggtttatagcaaaaaaaaatattaatttcaaatatcaattcaatgataatatcttcagcaaataaaattttaatttatattgtactaattatgggtcaaatattttagtcaaatcttataatgcgtgcacgtcttatattatggattggaggaagtataaatatttaaatatatttaaatatcaattttcctcgagcaaaaacaataaggcatattgttattgaatacatccagtaggtggattattcaatctgttggatatgatgacaaatgttaaaattgtgtaaaatagtatgaaaaataaaatatggctttctttttctgaaattgacacttcaaaaagttattgtgtatttgtgtatctccaaaaaaaaaaagaatcttatttcgtaatggtttcatgaaggcttaaataaaattatgattctcatagatctcgtttaacatgtcaaggagaaatgagtattacaacagcacacattagattccaagattacaaacatcagcaagcccttttttttttgggcatgcttgataatttatccagcactcatagacccaaaaaaaaaaaattgcacccttgtttattattactcacgtcagattgatgtctatacaagttagggagtactcccaaattattttcgatctataaatggcattatggcactacaaccttggcagtatggcactcttcctttgtcatctcagtcatctgttcaagttttcttatgcttttccatgcaagaacatgtgaactggagactggagactggagagactggcaaattataacgttgatcacaaatccattgttcagctgtttgtcccttcatctattgccctcagagtgtggcgaatggcggttgtttgcaccagaaccagggtaatcattgagctcaaaccccatacttccactacgggtgaattccgattcttcaaaatcgatagcctgaacgttttcaaaagatcatcaattcagcagtgttgtcagattcagataaacagactgaacaaaaaccagggcggtttttccatgtatatatagctgatcagatagtctccaagatcttatacattatatatagcatcacataaaaggttttcgaatctacttcaaactgttgtataaactataaattatctcagaaatcaaataaataggacccatgaatcaaaattgaaacatgagggagaatagcatctatatatagactggtttacacaacttaaaagctgcagcgagaccaagcagctagcatctctttgaataaactgagcaaaaacgaggatagatagcacatctaatgcatgatctgagttctgaaaacaaaaaacctgtattacctcagtcgttgcatcagaggttggagttgctttgctttcctgtagcactcttagacctatgaatggcaaaacaaacccccagaattaagaagagattaagatccatattccctatgacatgggatagagtttgagaatattgccatggggaggttcactacttgatacatgaatgaaacaacgcgaaaccaaaagccccatgactatatatggcaaagataaattcctcatcctcctacgatgtcctgtgcatatatagttgcttctctaatttctgtgatgtttgcataggacagtgaattcattggtcttatatagcagcttatcatggattaaaattctttgctcaaaagttgtccacgatgatgtgtagcccatcaatcaaagtccaactattccctttactttttccatgatccactttcttgcaagtaaagtgaaggaaacatttttcaactgagactaagaattgtgtgcacacatgacatgcctctggcagttcaaagggagctctctttcgtagcaaaatagcaggtatgctttctcttaataaattaaatatagagaataaagacaccgaatcttggtgattaaaattcttatatgccttgagtatgagtacatgtgccacagtgttacagcccc

SEQ ID NO: 18595 - DNA, 1359 bp, Oryza sativa
tacagtagttcatcaacaactgaagcaaactgtcaatgctgcagactctcataagtcatagcatcccccctggcctacccgtgtacaagacaacactccaaaggaagattttgcacagctagaatcaacaaattggtaaagtaaaagctcccaatacctgccaaacctaaaaaaaaaagacattgaacaagcagtcacattatcatatggtgtactccaatatgctcttcttcgtcttatcttttatagagaaaaaggtatagcacaataattaaatgcactgtccaggtgaaaattccataggcttttctttggtatggaactagtattgatcaaggcctattagactgcaaattaaatagttgcaaacttcccatgtcgataggatcgaggaatagggtcaagaaacatgatacacaatggccttttacaaggtggggacgaaaatgcccccgtgttctaggccatgggatgacgtccttaggtctatcaaggttcgacctttgttcttgtgatatttttagctattggctactactcccgaagagctgataatactaatgggtttgaataaggacgcggtcttcgaaaaataaattttgaccaccattttctattataatatatatataatatcaataaatataaattttactaaagtactttttaacactaatctatacacattttgttaataatggaaatggattacactattctatacacatggttctatgtttatgacaaacattttcgaaattattcatactcaaatattttaaagtttggcgctgtctctgacggcagtagcctctcatccacatcctgcaacatgtcggtgtagtccccatggatccgcggccatcgccatccgccgtgatcagaaaaagcctccggcgaactgatgtcatcaaggaaaaagaaaataaatggcgtataacaaactgttgtgtgttcgttttgatcagctcgtgttgaccagatttccattgacggtatatatatgtttgtgctgattagagagagattaattagtacctgatccctaccatgttcatgtcgatcagtggtgataattggtcgatctctggccagttccgagctgacggtggtaatttttttactttggttgttttttgctttgctcgtgtatgtgctccggtttcttggatggtggtggagagaaagattacagcctttgccgtagcaggctgttcattgcactccccttgtgaaagggcatgtagcctagtagttgcaatgacttgagtagcagcctaaggtcctgagtttaaatctccataggagtgaatttcagattgggttatttgaggactaaattccatattcaataggcta

SEQ ID NO: 18596 - DNA, 580 bp, Oryza sativa
tgccccgcgcgttgcatagcaggtcattttgtcattttagaaccacaaaacatacttgcgcatatatatagtacgttagagatcatatcttatatttgataatggttaaggcataagaaatagtcaacaaatgaatatatttttgcaatcattgttcagtatattaaaacgtccgatcattgaatctttggacgtcaatttaacaataaaaaacaacagtaacaatatttagtaacgccatgagacttacggttccatctaagtatataaacagtctatgagattagccggatagcatacaccagttcaaaagaccaagaccaaagtattgcaaaatactccctccgtattttaatgtatgacgccgttgacttttcgaccaacgtttgaccattcgttttatttaaaattttcgtgcaaatatgaaagtatttatatcacactggtggagaaaccctttgtagtcccggttcgtaacccccctttagtcccggtttccaaaccgggagtaccaatccgggactaaagatcgagctgaccatttttttttttgcatggaataacccggagtaaagatcga

SEQ ID NO: 18597 - DNA, 1036 bp, Oryza sativa
tcgaacgaacgttaacgtgaaatgccatatatatatatatatatatgtatatatatatatatgtatatatatatatatatgtatatatatatatatgtatatatatatatatatgtatatgtgacttcgcatttgactatatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagccctgtaattagacttatcatataagattgtgtagtgttctaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgaatatatatataagattactttatttgtaattagacttagtatataattattgactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaagtggtgcgacaagtagcaattgactattgtagtcttaattacacttagcatatacgcacgaaacacttagcagacatgactattttagtcttagcatgtaatattatttgagttttaatataagattactttatttgagattagacttagtatataattatttactacggaaatggtgcgacaagtagcaattgactattgtagtcttaattacacttagcatatacgcacgaaacacttagcagacatgactattttagtcttagcatgtaatattatttga

SEQ ID NO: 18598 - DNA, 6850 bp, Oryza sativa
aaatggtgcgacaagtagcaattgactattgttgtcttaattagacttagcatatatgcacgaaacacttagcatacatgactattttagtcttagcatgtaatattatttgagttttaatataagattactttatttgtaattagacttagtatataattatttactagctagggttgtataatatacgtcacctagacttagcttatatcacgatttgtaattagacttagcacgtaagtttgtgtagggttctaatgtacgacatttacacttagcatacatgacttagattgttaaaacataaatgtgtcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgaggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaaaaagtaccatcaccacttggggtcaggaggctatagcgtcgcgatcccaaagtggaaggaaatgaaggctagcttgattgaaaggggtatcgaacccgcaccagccaattggccggaacgatcgaagttctggtactatgctcacggtggaacgctcaacccagctgatggctcactggtattcggcgttcagatacgagaggctgcgcaacgactaacagatgcagtggaagcctcctctcagggcacgttccgacccgacagagatagggacgagctgacactcgccctgcagactccagagcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccgccatctcctcctcatgatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaagggcccccccagctgcaccgcctgcccacacaagggcaacgaagaaggcgaaagttgacgccgacaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaacaggagatcgagccgttggttaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggattagggatacggacttcttgcaaggagatgacattctctggatcaatttcacacatatctacgaactataccagctggacgccgtcgacgtctctattatgagttgctggattttgtaagtatatcgttcagttagatttcttactatacgtctcctttaattaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgttcgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctatatttatatttctccgattcaaatacatacaagtgtatattaattagatctctcgttgtttgtcatttatttgtagtgcgcaaagcaaaagcagggaaataacttgtgcggctattacgtgtgcgagtattgccactgccttgcaaaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatacatatatatatatatgtatgcatatatatgtattgaaacatatatatgcatggtttatatatatatatatatataaactatatatatatataaaccatgcagcaacagggccatgcaaaaaaaaaaatggtcagctcgatctttagtcccggattggtactcccggtttggaaaccgggactaaaggggggttacgaaccgggactacaaagggtttctccaccagtgtgatataaatactttcatatttgcacgaaaattttaaataaaacgaatggtcaaacgttggtcgaaaagtcaacggcgtcatacattaaaatacggcgggagtattttgcaatactttggtcttggtcttttgaactggtgtatgctatccggctaatctcatagactgtttatatacttagatggaaccgtaagtctcatggcgttactaaatattgttactgttgttttttattgttaaattgacgtccaaagattcaatgatcggacgttttaatatactgaacaatgattgcaaaaatatattcatttgttgactatttcttatgccttaaccattatcaaatataagatatgatctctaacgtactatatatatgcgcaagtatgttttgtggttctaaaatgacaaaatgacctgctatgcaacgcgcggggcaatgaactagttttacagaagttcatccccagagaggatcccagttctagaagggtttacatgagtcacaaaatgggtgcaattgttctctgaaaagaaagctaaaagaggcaattatgttcaaattaaatttagggaatgagtggtatgacaaaatccgtttataaatcctgtttctcaactatactacattaatcagcaccaagaatggaggatagtgggttttagagttaagaaggaatctaaattaaagtgaccagagagatttagttgagtcgacagataagctgaggaatgtcttattaatagatgaaccagatcagctaatttgtccacattagaagaaggggcttataaaacaaacactataaatgtacaaatcgctaaagtttcgatgggtgagagacgggcgtgatggaggtctagaagagtaaaattcctccaaaaataaacactttatatacatggctgggagagagaggctggccaagtgatgttcagctagtaaaaagaaaatgaaaaagaattttgtaaaatgtgttaggaaaaagagtctactaatcatgttctcctcaaatgtcccattgctacatttgtgtggtgtatcatcagagatgctttagaactatcatgtttatctgaacgttttgaatattttaaatttcatttgcaatagtttttttttttttttgggggggggggggggcttgtgtttgttggggttctgtggttgacaagaaataattgggtctttgaaaatgtcttgattaaatctccaatgtaggtggtctactagtagtatctttttgttttagatctcgtgtgctacccttgtaaacctaagtttagaagacttaaagcaaagggattttgctttcaagcatccctgaaatagcttatggtcttctttcattccttcagtagcccttttctcttttttagcctttgtaataactttaacttttatttgtcctctattttactcgttgtaatataaacggcagttctcctgccgtctaccagttaaaaaaaaaggaaagttgaaagatacatatccaacataattaattctaggaaattgttttgatttttctcaatctgacatttattatttccagtgtatgcatatctagaacaataaattgccacctacctttatagatgtataaactcttactgagagaacaacctctgcccatctatataaagccgtgttcattgtaggaaataaaagcacacaaaaaccttttatctagaaaaaaaatttccgcaacttatttgagtagttcttatcttactcatagaggagtgagaaattctagttgtagaatgagtcaagtaatgcgtgttttactactactgtgtcttctgatcatttgttcggagcaagcaagtttgatatcatcatgggaatatgatcaagatcctagggagttacacatggggaatcgtttatcctctgcaagcagctcgctactcaaaaaggatttagtgaagcctcccggtcaagaaacatcctatgtgagttaaaactactccgcgtagaattttcattggggcattagatatcttcatattttgttgcaatccttgattttctccttgattgcccccaaagatctaaaaattgctaatggactagtttttccttccttcttcagttaagtgttttgacccctctagaataatatcgcttaattttgtccctacttccttgctcgtggaattcccatactcctttcatgttctcacatgcccattccgtgaccgttgcggagtggaaagatcaatgagtaggacatcaacatggctgcggtaggactaacccatactttggatatggaaagaaaatatagtatatagaaaaaggggcaatttcgtttctacccctactttgatgtctaatattgattttacccc

SEQ ID NO: 18599 - DNA, 2834 bp, Oryza sativa
aaaatgtaattatctgttcctttagatattagtcaatgtgcttcatgtaattttaaatatactcacaaaaataaagttctaaagctacatgcataaaatggggacaaaaacacaattaatgagcatatatgagagggtataaatgtcattttgtcaattacttaataccgttaacttcaccatccaaagtaggggcaaaacaagcgttcagtttaaaaaagtgagggtaaaaacgaaaaccctaaaaagtaggggtaaaatcaatattagacatcagagtaggggcagaaacgaaattgtcccatagaaaaaagggtggaggggcaaaagggtaattacagagagataaaggaatagaatgaatgaaaagggtgaaaacagcaaaatattgttttccaaagagggtagaacctagtaatgatctgataatgcgaggaaatcttaatattacaaaaactatgttaatattttataaagatagttacatacttcaaatgaaatttataagatttgtttctttacttgttagacataattgttttttgggaaattagacatgatttttaatggtatcagccttaattgctgcaactgcaaatccctaatacatatttacctcaatgagatgttgggtatatgattttggtcaatcccctatcaatatcttctatggatagatatttgtatatatacatttttttgcaaaaaaaaaggctgtttgcaatgatcttataaaaacatggtagtataattttgtagagtcaaatattttattacatttcttactgtagatcttaaagcatatttacttggcatctgtcgcaatgcgttggcacatttcccagaaagatataaattgtctcagattgttatttatgtgtgagtttttccacagcaagctcaatgttattcgaacacatcaccctcagatgagcttcttggtgccatggcaacatttgatgtatatgggttcccaaatttgaacaaggaccaagtaagctcagcagatttagcggtactaaatgagcaacgccatgatcttactgacggaaatgctttatttgccggatggatggtatgttagttttctcaacattttcacaagtataacatatttataagtataaataccatttatgtgattgttttatttcatatgtaggtcaacccggtcatctcttcatggtgacagcaaaacacatttttatacagcgtggacggtatgtagtttgttgcctcttcgtattatttaattaccgcatgcttatactatcgtgtataacttaggatcttttgtttatttttttacatatataggttgataatggtgtctcgacaggatgctataatctggaccgtgatggttttgtacctgtaaacaattcccctataactcctggagatattttagagccaactaatggcactctgagtatcacaatcaagatatttaaggtttgtagttgaatgtattgatgcttttttgtcttaatctttttttgaaacatcataaatctaaaagcgaattagtggatactgaattgggtgtcaaattaataaggtgtatgaaatgtaaatacatggtttagtgacactaggttttcattttgttcacagtgtttattagtttacattttttttatatcaactgacatcattggtggatatttcaattaactttatttgcttttattgacatgcagaaaaaagatgatggtgactggtggttgtactttggacatgataataacaatcttagccctgtaggattttggttgagcagtgttttaaccaatttggctgaccatgcaaacgtcatagcatggggtggctacacctacacacaatctactactccctccttccctaaatgtttgacaccgttgacttttttaaacatgttcgaccattcgttttattcaaaaacttttatgaaatattgttgacagaaaacacgaggcctgaaagatctgcttaactccagtgcaggtccaaagctcgccttagaatgtatgagcgtgtcagttgatttgatcctataatcaacaagaaatagaagcaaagaaaccgcggttaaatctataaatgatagtcgatcggctagaggccgatgacatatcatttatctttgagccgatgtcatatatgtatcgatcggcagtcatgaataaataagaaggaactaaatctactcgatcggctatagatattaacaatatatactccttatatcgatatatacttaaatcaagtgattgggatagatcaaaatatatattaataatgggactatatatgttcatagcatagccgatcatatagatctagcatgtatcggctaatacttcgataccactctatactaagatgttaaagcaggtagaatatattaaacaaaggcctaatatacttaaatgcaataagatcttaaaataaagggtagatttaacatgtcaataaagtatatagggtaaatatagttaaatcagataagatcggctgaaactctgatgctaccctaatcggcaaccagaaggcaggctagagattgattttctaagcacgacttaatagatcaaactcaactgatacaacattaagtatgaaaagaacaacaatatctagacaatcaagctgctggaagcttcatagagtggtagatatcttatataatctaaatcaacatcgaaatctaacctaattggctgccctctaccgacagatgttagccgattgtagattagatagcggcattgccggagattatgtaagatatatgatagctcgacgaattacataaacgagatcagagtatcataaagatggaagcacta

SEQ ID NO: 18600 - DNA, 9290 bp, Oryza sativa
gatacggccatggccggagattatgtaagatatatgaaagctcgacgaatgcacataaacgagatcagagtatcataaagatggaagcactaatcccgagaacgctaagttgtcataacaagttttaacctcttgttgaagatcgaaaccgatgcagctcaacccgaaagtaagaactcgtcgaaataaaactaaagcaaaaagggtggcgatgcgccgaaattgtattgaacgtgtgtgttcaaagttacatagggctcgggtctatttatacccgagaattacaagatatgtccataacggacacgactaatatctctaacaaactctaagataccataagtctttatggcagacttttgcccaagcgtatctctaaagaaattacataaaacatcctaattaatagataaaattgccttcttaggactctatccatgtgcggcaatcaccttgaggtgcctcaactcaacccgatatcatacatcaagtcgcattgccggaatcggctgcatcggcttacctagtccgactcagacccagccgatcctaatcgtagccgatatggactccagccgattcctgctctgtttccgaacccgatctccgcctccgacttcgtttcgatctaatcttctttctcgatgctgatattaccaaatttggttgttaacacatgccccccaagtccggaatatttggtaatgtttcggatttgctgtaaatcgaccccgagcaagtttcgcactttgccgttttccgaccgttactgccgtgctttaaatactaaccgtcaccctcgagaaatctcacaccgtgacttccgttttcaccgctcaagcgaaactttgttctctctctctccgacgattcctccgatgcaaaagcgactcccaggcgacttcatcttcggcgagatttccgcccgcagcgatgtcatcctccaccaacctatctgatgtgccatcagccgagtacgctgaggtaagtcctcgtcggctagatcccctttcttagcagcagatcgattttctcttatcttatatcgctctctttttctcggttgtttcggatttgcagcatctctccaacctagttgcgattccaagcctatcacacgaaaaccactattttcttggcccaatcggcaatctcgaccccactgatttcatcatcggtgaaaccaaccaaatcccctttagactagccaaccctaacctgggtcactggaagaataccttcaagtcttggccatctctcgaaaaacctactcctgataagagctggaccacctggtaccaacgcgtattggctagtaagaaagttcactgggatgagattggaatcggccaagcgcttgctctcaccatagccaattctgctaaggatgagcctctgatggctgccgccacctacttctggtccaacaccatcaatgctttcttattcaaccaagggccgatgactccaactttaatcgacatcaccatgattactggatttgatgtaacttcatcggctaaccctatgagtatgaacaccaagaaccaatttgacttcaagaccaaaagcataggtggctggtctggctatgtggcggcatatatgggccaagggtctgttactcctcgagagcatgtagctttcttgctcatgtggctggaaaagttcctcttctgtggatctagttgtggccatacaaccaactggcaatttgtagtcgaagcctgttggcagatggcatgaggcccttcgactaaatctgccgaaacccgtggcgaaggctatggagcaagaacggcatgaggcgaagagtcgtacgagtgccctgccaggccagaggcgtctcaggcgaagggtgtaaggcgaagactatctcaggcgaagggtgcaaggcgagggccgaggaagcctttccggcctatcaagcctaagggctacagggccggcgatcgccagacggcccatcaggggcccatgagcccctataacattatgtacccctgtaaatgtccctttcgtaaaggtaatcatgtaaattcccctgtacaacctaaaccctagtagtaagaacctgtaatggggctataaatagtcccctagggccatgtaatgagggggatcccaaaaaaagaaattcaaaattcaatacacttcgtttccttccaaccactgttgagttaccacgtccttcgacgtatgcagttgtcatttcgacaacagctggcgccgaccgtggggacctccgagcgaaaccactgagagcgaatgccaccgaagagggtcgtgaaggagaaggttgccaggtggaaggaaagcgacgccggactagacatggccgccgaggaaggagcagagccttcggcgcccactgccgaagatggaggaggacaagcgacatcacaactgccttcggcccctgcaacctccgtgcaagtgccgaacgcggccgacgtggcgaaggcggctgcggcggcaagggcactccagaccagggcggagatcctttcaacaatccaactggtggtgccccaagccgctccatcgcagccggcagcggccccaaccgcgcctgccgttgtgcaggcccaagtcagccctgaccccgaagcacaagccgaagccgacatggaaaccatgcggcagaacatgacacggctccaagacatgcttcgccaaatgcaagaacaacaacaagcatacgaggtggcaaggcggaccaaggccacgtcggctccaatccttcagtattcggcaggttatgtcccatctcaagtccatccgcatgtgacgacccagcccattccgccacaagccgcacaggcgccggtgtactttgccgggcagcaatcggccgcagcagtgcattcagcccctcacgtgcaactggaagctcaaccagtcgctgcccaagcacaccatcaaccacctggccaagcgccacaaacagtggcggaaggggcttcggctctgcaggcgcaactccaagctttccttcagcaactcaaccaacctcactgcatttcaagtacaaccccatcggcccacccggaggggaatacaagtcaaggtgtgcctaattggttgccaccgattcagccgggcctaggagtttttgtaacgccccgattttcgttcgggaataaaaatcaattaataatacatcttctagaaattaaataaaagttaaatcaatttaatcaagtgaaattatagaggaaattaaaatttcctttaaaaatcattggccgggaatattttgtaatattcttggtgccctaatgtactctccggaattttccgtgaattttcggagctcgagaaatagttttaaagtcacaaagatcatttaaccaattaaaataaaaagaaaacaaataaaatcctccctcctctctttgggcccctttcggcccaattccccccccttctctccctctcgggctggccttctcccacggcccgctcggctctctctctccctcaagtctgctttacctccctcgcccgttttccccactctctctccccgacaggtgggacccgaggccccacctgtcagctcctcctcctacctctggctggccggctgcaaccgccagggccgcccgagccaccccacgacgccgccgtttccgacctcctccaccccgcgcgcgagcccgccggtcgtgggaccccgtcgccccacgtcctccacccttttccccactctccccacgaaaatcgccgccggttaacctctccaccacccccaagatgccccggctatctcgtcggccggttgccacctctctcgagcacgatcccatcgttccaagcccataaaaagcatccccggcctgccctttccatttcccccaattttcccgagcttctcgcgccctgtactgctctcccctcgctgctcccatcgccgccgctcaccggcgactctccatccgctcgccaccgctgctacagccgtcgccgtactgttccgccgccacctgcggcttcgccgtgccttgccgcacctcggccccgctccgttttccccattccatcgttggaaccccctccccaccgcgctccctctctccaccactcaacgacgagctccagccgccgctcctcgccgttgcagccaccaccgcgccgtgccgccgccaccgccggcatcgccccgtcgagctccaccctggtccctactccattttcccatttcgcctccggaacgccgccgccacacgcaccacctctctccctcaccatggccacctccagccgcgtcgcaacgccgcttcggtcctcgccgacccgcgtcgtcgccttcctcggctccgcagggacggggagatcctcggccactggccctcttcgccggaaatccacccgagctccacctccctcgtcgccggtgagctcctcctcgtattgtcgtggtcggcagtcgtttccatttacctcgcaccagttctcacctccataggaggctttgagccgtgaccgtgccccagccgcgcgccccgtggccgtccgatcggcttgggccaatccgggccgtcggttcccgtggaccggcggtggaccgcctcggtggtcccggtccacggtggaccggtgcccttgtgccactgaccggtggggcccgcttgccggcgccacccctcccctttgatgacgtcagcaaccctcttttcctttggaaaaataaataataattgcgtcataattcgttaataattctagaaattcatttaaatggctcaaaacttctaaaattcatatctaattcattcgaactccgaattgagccgttcaacttgcaaaattcatctaaaattgagatctacatgtttgtttagtttttatgtactgtttctttggtttttattagagtttttcctcgttttgcgtgccagcgtgtagaatccgtcgtttcggaagtccgcggtcgcgaggaaaagagttcggaagatcaaagtgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgttctttgtcaaccttgggtaataaatcgcctagcttgtgttactttgatgacctagctagaactatatgcttaaccatgcttcattaccactagctcagttgatggggtaattacagttttagaccttttagtatcagtatgagctgcgtgctcgagacatctggccatgcttcatggtcgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgactcaatacactgtagttcaggtgggttggttgggcctgttcaacgtggtgtagcgttgatcagtggagattcaatattactttaattactcaacagttttactgttttgctcaataaaatgttttacaactgcctttatgcaaatagccacaaacccctgcttgtatccccttgcacgtctgcatcgttggtgtggcttgctgagtacggtggttgtactcagtcttgctattattcccccttttcagaagtgtagtgcttctgagctgaagacgaagttagaagaccaaggctcagaccccagttgagttttgcctgtggaatggagctgaagccccgctaggatcgcctttttccgctgctgctgcttttgtttcggtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagttttgccatggaatcaaggactgcagttcgacttcgtcaacatgctcaggcaccaaccgttcggcagcaagctccaactccaggcttcggaacaaaccaagcaccaatccaagctgccacgacgtggtcgcagccaatttttgacccatccatggcgactcagcaagtacctccaattggagccagacagtcgaatgccatggcgcaacctcacgcacaagctgcgattttgcccttcgccacaccgtacccgcagcaaagtgcagtaaacagggcgggaggcgaaaaggggctaccgctgagtgggggaatcaggactcgtccaatcccaccgcagttcaagttcccacccgtcccgcgctattcaggcgaaactgacccgaaggagtttctctctatctacgagtcagcgatcgaagcggctcatggtgacgaaaataccaaagcgaaggtaatacatctcgctctagacggcatcgcccgtttttggtatttcaatttaccagccaatagcatttactcatgggagcaattgcgcgatgtttttgtccttaactttcgaggcacctatgaggagccgaagacgcagcaacacctcctcggcattcgccaaaggccgggggagtcgataagggagtacatgcgttgcttctcgcaagcccggtgccaagttcaagacataaccgaggcatcggttataaacgccgcttcggccggtctgctcgagggcgaactcacaagaaaaatcgccaacaaggagccacagacgctcgagcacctacttcgcatcattgacgggttcgcaaggggcgaggaggattccaagcgacgacaagctatacaagctgagtacgacaaagcctccgtcgccaccgctcaagctcaagcacaagttcaagttgccgaaccacctcccctctctgttcgccagtctcagtcggcgatccaaggacagccgccaaggcaaggccaggcccccataacttggagaaagttcagaacagaccgtgcgggcaaagctgtgatggcggtcgaagaagtgcaagccctccgcaaggagttcgatgcccagcaagcgagcaaccatcagcagccagcccacaagaaggtccgaaaagacctctgctgcgcctttcacggacgctcttcgcacaccacggagcaatgccgaaaaattaggcaacatggcaacgtgcaagacccaaggccgcagcagggaacaactgtcgaagcatcctgcgaagcaattcaggagcaaacacccccagccgaacaacgccaagatgtacagcgaagggtaatccaagtgattacaagggctgatccgccaagccagttgtccaaacggcagaagaagatgcagatccgtatggtccacagcatcactttggcgggtgaaggggcgccgcagtatcggaaccagctaatttcttttgggccggaagacgcagaaggagttatgttcccgcatcaagatcccctggtaatctcagctgagatagctggtttcgaagtccgatgaatcctggtcgacggagggagttcaaccgatgttatcttcgccgaagcatatgccaagatggggttgcctacccaagcccttaccccagcaccagcatcactccgtggtttcggcggagaagcagttcaagttctcggccaagcacttttgctgatagcctttggctcgggagagaacagacgcgaagagcaaatactgttcgacgtcgtcgacatcccgtacaactacaacgccatcttcggccgtgcaaccctgaacaagttcgaagccatttcccaccacaattatctcaagctcaagatgcccggcccgacaggggtgatagtagtcaaggggcttcagcctttggccgcttcaaaaggcgatctagccatgatcaacagagcagtgcacagtgttgagaccagaccgtatgaacggccgaagcacacgccaaagcccacccctcacggcaagataacaaaagtgcaaatttgtcacgccctgaagttcccctcccttgctctaaattcataaaataaatcgtccgaagaaattgtttaatttaacctagagatgaatccctaattaataaatgcaaataataatcggaatcgacatgtggaatttttcttggattctacatgtcaaaatatgctaacaggatttttagtggaattttcagagccttgggaataattttaatcaattaaaatagcaaagtgcaatattaaatccctggaaaaatcctttttcctttttatcttttcttttccctgcttttttctttttcttgggcatggcccatttcctcccggcgcggggaccgttcttccctcccactcccgaagtccacccggcctccctctccctctcgggcggtgacaggtggggcccacctgtcagccctttccctaacctccggccgcccacgcccgcgccaaccgccgtcgaaaccaccgcccacgccgccggtttccccgtttcccgcgcccactccgcccgtaccgcacgcccacgtcgccgcccactttccccgcacctcccgccagctcgcgcgcccgcaaacggcgggggatttgaaatttcccccactctctctttcttcctccaccccctccactactccggcgaaattgcgccgttcccggccacgactcgccgccccccctcctatttaagcacgcccgcaccttcccctctctttttcctttctcgggcgagccctcccgagctctccatcgctcccgcgcctctcatcccgccatccgccgctcgccgccaagctccggccgcactccgccaccgctagagccgtcgccgcaccgcgccgtcgacgccgccgggttcacaagattgtgcgccaccccgtccgccgtttccccggtcaatcccgccgccggagcttgcttctcctcgcgcgccggt

SEQ ID NO: 18601 - DNA, 10727 bp, Oryza sativa
cggtggtcttcccccccccccacgccggccaactcgcggtgaggcgcccctccccctcttttccccttcctctccctcctagcgccgtgccgggccgagccgccgcttcggctgtgtgccgccgcctgtgcgccgcggtcatccgccgccgcttcccgcgcctccggttgccgtcgccggcgaccgtgcgcgcgcgccgccgccctcgccataaccggccggccggcttgaagccgagctgagccaggccgccttcctcctttccccgtgagccgcgcccctcccgccttgtgccactgccagtggggcccacgtgccggcgcccctccctctctctcttgagccgctgactcatggggcccgcatgccggcgccgccccaccccttgctgacgtcagccctggggcaatattgcgcaataaattgattaaggcttttctttaatagtaaaaatacagagaatcttctaaaaatcataactaattcatccgagctccgattaagtccattcaagtctcagtaaattcataaaaatgtatagaatccattaaaaatggttttgtttcctgtttcagtagtcttatagcatgtcttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcattgttttacaatatcatgtgggatgggtcctattactcagctatatgttgtttcccttacgccattgataacttgggtattaaaatgactagatgttggtttaggagatgcttagccatgcttagttcaactagtgcacaaaaggggatcacattaaagcatagactttgattattggcaatagttttggattagtgccaccgcaatggtgttggttaattaaaatacacttcatggtgggctgtgggtgcatggttttgctagacgtgcccatggcgattaaggaccggttcgcgggatgccctggaagaacttatcgtacttaccacaagccagcgtgggcaacggctgggcttgtagtgtagcttttctctagccgacgtacccaggcgagggtgggcatgatggagttgggtcggccggggtgtccggttgatcggcttccggattcaccgcggcacgaaaggggggctgcccgttgcctgctggggacgggggcgaaccctaaggtgtggtgcgatcggttagagagggttatgcgaagggtcctgtcacggcctctttctggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcacccctagtttagcttaatgaactggtgtagttcaggtggttggttgggcctgttgcaacgtggcgtagcgttggacagtgactggttaatattgcttaattactacaactgttttactgttttcaactactagttttaaatgcctgctttatgcaaatgaaccccgtagcctcctttggttatatcctgcatcatacctcctctaccggtatgacttgctgagtacagtgggtagtactcagtcttgctcttttcccccacaccagagttgaagttcttctcatttggagaggtcttgaagaggttggtttcgtcgctgccgtcaagggttgcctgtggaatggaatcgcccgctgcaggagtcaaggcttcaggcttagctcgctttaccttttccgctgcatttgtaatcttttatatttttgtaagacgtggatctgtatgtcaacaattgtcgtttgtgtaccctggctggtcctggacaggggtttaatacacattcagcttagaaattctggttcgtgaatttctaggcgtgacaaaattgatgacgccgaccccacaaagcccgtatcactggggggcgacataggcgaagaagaagttgagagtatactagaggtgcttaaaaagaacatcgatatcttcgcctggagccctgacgaggtggggggtgtcccggcggatctcatcatgcatcacctagcagtcaagccggacattaagccaagaaaacaaaagttgcgcaagatgtctgccgatcgccaagaagcggcgaaagccgaagtacaaaaattgctcagggcaggggttatccaagagattgaccatccggattggttggcgaatccagtgctggtgcggaagtcaaacggcaaatggcgcatgtgtgtcgatttcacagacctgaacaaagcatgtccaaaagacgacttccccttgccacgaatcgaccagctcatggattcaacagctggatgcgagctcatgagtttcctagatgcatattccggttaccaccagatccacatgaacccgctcgacatccccaaaacatccttcatcactctattcggcacattttgtcacctcagaatgcctttcggcttaaggaacgcaggagcaactttcgccaggttggtgtacaaggtccttggcaagcagttggggcagaatgtggaagcttacgtcgacgacatcgtcgtaaaaagctgcaaggctttcgaccatgcgatcgacctgcaggagacattcaacagcttgcgcatagcaggcataaggctgaatccggagaagtgctttttcggtgtccgcgcgggcaagttgttgggtttccttgtttccgaaagaggcatcgaggagaatctcaagaaaatcgatgccatccagcaaatgaagcctccgtcaagcgtacatgaagtacgaaagcttgcaggccaaattgcggcactcagtcgattcctctcaaaggcagccaaaagaggtttgcccttcttcaagaccttccggggcgtaggaaagtttaattggacaccagagtgccaagcagcattcgacgagctaaagcaatacttgcaaagcccgccagctctgataagcccaccccccaggaagcgaactgctattatacttcgccggtggcttcgcgcaagcttaagcactacttccaggcccacaaagtcatagtgccatcacagtaccccttgggcgaaatactccgaggcaaggaagttactggccggctcagcaagtgggcggcagagctatccccgttcgacttacattttgttgcatgctctggtatcaagtctcaagtgctagccgacttcgtagctgaatggacaccggtacttgcccccgaccccgagcccgccgaacaattctgggtgatgtgctctgacggctcgtggtcgcacaagggagtaggcattgcggcagtcctattttcgccgaatggtgtgccgattcggtacgcagcaagactgcagttcgacacaaccaacaatgcagcagaatacgaagccgttctcctgggcctaagaaaggcgaaagcactaggagtccggcgcctgctaattcgaattaactccaagttggtagcaggccatgttgacaaatccttcgaggcaaaagaagagggaatgaagaggtatctggaggctgttcggtccatggaaaaatgcttcaccggcataacggtcgaacacttgcctagaggccaaaacgaggaagcagacaccttggcgaaatccactgtttgtggtggcccacattcgcctagcatctttttcgaagtcctacatgctccaagtgtgcccatggacagctcggaagtcatggcaatcgaccaggagaaattgggcgaagacacatatgactggcgaaccccatttgtgaaacaccttgaaactggctggcttccggtagacgaagcaggagcgaagcgtttgcaactcagagccacgaagtataagatggtctcgggtcaactttaccgctccggggtacttcaacccttacttcgttgcatctcttttgccgaaggcaaagaaatggcaaaggagatacaccaggggctatgtggcgcgcaccaggctgcaagaaaagtggcctccaaagtatttagacaaggagtctattggcccactgtgttgaaagtctgtgttgagtaaatcaagaagtgcgaaagttgccagcgccatggccgaagccaagccacgccccagtatgatctgcagcccattgcgccaatatggcccttcgccagatggggactggacatcatcgggccgttcccggtggcacgaaacgggtataaattcgcaattgtagctgtggaatatttctctcgatggatcgaagccgaaccccttggggcaatcacttcggcagcagtacagaagtttgtatggaaaaacatcgtttgccgtttcggagtgccaaaagagttcattagtgacaacggcaagcagtttgactctgataagttcagagaaatgttcaaagggcttaacctggaaatcaggttcgtgtcggtcgcccacccgcagtcaaatggggcggccgaacgtacaaatggcaagatcctagaagcactaaagaaaggcaaatggccagaagaattgctatcggttctctgggcccttcggacgacccccacaagaccaaccaagtttagcccgtttatgcttctttatggcgatgaggcaatgaccccagcagagctaggggctaactcaccaagggtgatgttctctgggggcgaagaggggcgcgaagtatcgctcgaactcttggaaggggtaagagtcgaagcgctcgagcacatgcacaagtacgccacaagcacttcggcaacttacaacaaaaaagttcgacccacagagctgatgcctggtcatcttgtcttaaggaagaaggcgaatccagtagctgttggcaagcttgaatcaaagtgggaaggaccgtacctcatcaaacacaagtccaggacgggatcttttcgcctagcgacactagaaggtgaggagttcgaccattcctggaacgccgcctctttcaagcgcttctatgcctagaatgggtggcacccaaatcgctagcttgtaaaaatgtacatacagtcatgtaagcccttcggcaccatgtaagcccttcggcactatgtaagccttttggcaaagaaaaaaaaaggggaaaaagagaaaaaagaaaaaaaaactagatgtagggctattatccaccatggaggcccgaaccagtataaaatctctatgtcctccgccttcttttcatttttcgtgtgattgataatttgtggaaaaaccccaaggcaaacgcctgatcagcgaaaaaggccagggggagaaacgaatcggtcgaagcatcgctcgccgaacgttgaaaccgcaacagcttgtctcggaaaataactagccaaacgacgttacgattcgatcaacataaaagcaaaagtgtctctttcgacacagaatgctacaggtcgaaaacgaacgacgaaaagctaaaaagtcagtacacctattttgctaatatgcgcaaaggggccggcatgttccgacctaacaaaaagcacaaaatgtgacgatgcgaaaaatagcgaaaaggaaataaagcacgtttctttattaacttcgaaaaaaataattgaagaatagaaggttcacaacacgatacaactcactttacaagtaaattacatcttcgcccctgtaatcattatccctccctaaggaatggtcagacgaactaggttcgtcatcactactaatatcatacacaaccttaagaggagtagggggcgaaacacagaccaaactgttgcgacgctgaaagatcatttcctgacgtttcgtcttctgatgatttcgccaaaagcgagccatatcctccaaacgtcttgaatgaacaaggtcgtaatcttctaagattcgcccggggtgcgcccgcagccagtcggcaaccttgaaaaccttatagctatgaccgtttatctccatttcgcgataaacaggacgaaatggacatcgcaccttcggcaggtccttcaatgccacaaatttctcgttttgacttcgccagctcccggaaggggaccgaatgcacaacttccggtgaacgccctgatagacagcgcagagaaagcaaaacacagcttacatagtaagaataggcggaaggagggggaggtatggcataatgcgagatgagcgaaataataatatgccaaagacctcgaccatcaaaaagcaattaagattgtgtcatatattccaaatgtacaaaaaggcgttttttaaggttcggcggcagcctgccgaacgtacatcattcgcctctccaggcaaatgcaaaagtgggaggaaaactacaaaaatctaaggaaagggcggagggcctcacacctctgggtgatcctgggcatcgcctccaacctcttcgcctgcggcaccctctccttcgccccgatctgccgcctccgccttcgccagttgctccagaaggcgcgctttggcagcggaccggccatcattctgccagaactgttttcgccacgcgcgaagagcgggcgaaatgttctgcgcactaatctcctagtcccccttcgcataggtagggaattcggcaacgtgctcgcagccaaactattgcaaaaggtctaaggtaaaggccgccgatacgcgcgcacagcaattgccgtacgcggtggcacagtccgaaaccgatccgccagcttgctgggtccactcggagaagtcaaaggctgaggcatcctcggcaaggaccccccgcaccttcgcgcccatgtcggtaagggcgaggcggagcgtttggcaagccgttctcgcggattcggtggtcttcgccatctcccgcaaaaaccgctgcgactcctccgcggcgcccgcttcgaccctgctagccttctggcgaagagcctccatcttcggctcagtaaggttgtagtaatcgatgagcaccgccgaatgggccttctccttctccagttcggccttgaggcgatcaacctcggcccaggcatctttccccttgtccagttcggactgaaggcgtttgacttcagttttcggctccttgagggtgtgggccagggactccacctccaagttcttgcggcttatttcatcatccttggcccgaagacggctcttaaaaccgtcaaaacgggcccgcacggttcgctccgtcgagcagtgagtcgcaagaatctagatgaaagataggagcgggcgaaaagaataaaaggttaattgccaaacgtaaaaaaaaagagggaagaggaaaacaaagaaggaaaaaaaggcatacccgaaccgccaaacttttaatggtggaacacccctcgtcgaactcgttaagttcggtgaacaggctcggggtgccggcgggcaagacaagattgcttactccctccacaaagggaataaggtccgcctgggtcacgaagtcaccagggacgaagtggggcgccgcaagggaatactccgaggcagatgcttcggcggccacacacttccccttcgccttgaccagcggtgaaatagctggctcgcgcacagggctcccgaaaactctcgccgcagccgacacgatccgttcggcggaggcggaagccccggcggcggcgctaccgcctgccctagcaacgccgagcggagcaaggtgagcagttgaaaggtccaaactgcggccagcaggtgaagtcggagtctcgtcagaagattcatcgtcgctaaaaacgcgagcgatgtcgacgagtcccttcttttttgagatcttcttgaccagacctccttttgccgccttgcccgacgagaacgcaactagggccttcgccccttccaaatcctttcgttgaaggggggagctgttcgactccaccctggtctcgttgtgacctggacttggggtaggagtgtagccgggggtgtcgacgcggtcttcgatcgcttcgttcgcggccttatcagccacagcttccacctcctcttcttcctctccttccccctcgccgtcacattcttcggcatcatcctcgtcgtcggcgtcggagtccgacgaagcaggaacccttcgcttcctgggggcaagcttcacttgtccacgcatccgctttcgcgaaggccctgcatcgtcgtcagctttttggggattcgccggggaggcagttcgccgttgtaaacccggttcgtccgcccagccgcttgtcgtgttagcagctggctatactcgacgaccgaaacatcgccgatcatcctgcgggcttcggcttcagcctggtcgagggttgacattgcaaaagtaaagggtgtagctgcgttaaaggtcagacaaggcaaaataacaaagcacaggagtgtatagcaaaagaacggccttactgttcgtcccctcaggaagaaccaagttcggcaaaccgttagcctcttcgcattgctcgaccgtgacttgccatgactgggagaggggaaagatgcaaagcatacagaactcctccaccaagtcacggcagctaaggcgggagcaaaccttgcgcagtaggatgaaccgcgcctccatagcgccgtccatggcgatcttgggtttccggttcggtgcaatcgccctatgccggcaccggagggcttttgccgagtcagaaccagctgcgaaggggatggtgtgatagaaccacctcgccatccaatggcggtcccacttcgacatggcagcgttcaccggccagagattggaccgctcggggcgaacgttaaagttcacgctcccgaacactgtcttcttcgttccagccggggtaatcaccgtcttcgagttcaaggtggcgaaaaatatggcgccgaagagctcggcgctgggctcaaacccggaagtccgacacgcccagtcaaagatggagatccgaactagtgccgacgggctcagctgcggaagctccacctggaaaaggcgaaagatctccggcaacaacacgttgcacggaaaccgtagccccgcctcaacaaagacggcgaacaccaccgtccgattgtcgacaggcttcggcaccacggctttccccggggcgaaagcctgcccctcaaccaacgccccagagctaaccaactttgccagttcaacgtcgtccacgagagaaacccccaaaaagccggtgctgtcatcatcgacccgcccgggatccggtccttttgccgaagctgggtttggcttgcgaggggccatggcgaacggcgtgtatgcggtggcgaaggaagagaatgggcgaaacacctgaggggtcaagaaatgttgtggaagagaggaatggaagaagagagcgcaaccggtaaaaatggcaagtgtaccggtgaaaaggaaagaggggtgggaatatatagctcactcgggcgaccgtgcctactcaccagtaataaagcgccacgtgtcgcaagggtaggcgaaacggtaaattcccaccgtctgagcggcacagtaaaaagcccacgatgggaaggcccaatactgttccgttcggcccgggaaaagaaaatatataaccaccaatcgcacgaggcgaagcgcggcaaaataataccagccgcacaagtaacaaacttcattcgcaggaataatgtaggtttcggcaggagcatcagtcgaaagggggcgccgcataccataccacatggtttgcacggtctcggccgaagctccaatctcacccttgcccgtgaggggcttgttggcagatggcatgatgcccttcgactaaatctgccgaaacctgtggcgaaggctatggagcaagaacggcgtgaggcgaagagtcgtacgagtgccctgccaggccagaggcgtctcaggcgaagggtgcaaggcgaagactatttgccgaaggaagacgacttcgccatggcaagttcgcccccgcgagggtcgaggaagcctttccggcccatcaagcctaagggctacagggccggcaatcgccagacggcccatcaggggcccatgagcccctataacattatgtacccctgtaaatgtccctttcgtaagggtaatcatgtaaattcccctgtacaacataaaccctagtagtaagaacctgtaatggggctataaatagtcccctagggccatgtagtgagggggatcccgaaaaaagaaattcaaaattcaatacacttcgtttccttccaacctctgttgagtaaccacgtccttcgacgtatgcagttgtcatttcgacaacaaagccttagaatcaaagaaagaatttcctttgggcaaaaatccttctcggctatctgtaccaaatgttgaacaatgcatcggctaaaatagccgtcggctcaatagttggagcaggtggaccatggtggctgctgcaaacttggttaaacctgatagtcatgaaggttgtccatcggccctctgtgacagaagctgaattcccactgccagagctgtcgcgtcccaaaacgactctaaaatacaccctctaaattatgcctagaataattaaaaaccatgtgaaagccttcaacaattaaaatgtgcaaagttaaaagtcaaataaggcttagaggatttttgtaaatttcctaaaaagcctaaaatgtgtaaataaattttagtggaattttcagagcacaaataataattattaagaaatgaacaaagttaaaatgattttataaaaagaaaaaccctaaaagtcccccttcc

SEQ ID NO: 18602 - DNA, 33832 bp, Oryza sativa
  unsure (1)..(33832): unsure at all n locations
gggtgcacccgttccactgtggtccgtgtgggttccgcgtgggccccactcccgtggacccggtccgcgcgcccctccccctcgggtgacgcaataaacccttgtaaaattaaaatttaaataaagaaattcgtaaatattcattaaaagagcatataaacttcaaatggccataacttggccatttgaactcagaattgtaccattcaagtctctaatttttccttaagaagtcaagaacccatttttgtgctttgttcttgctggttatatggagtttattagagtaaaagccttttcttttccattggtcgtgtagacgctgcagcttcgaaagatccgctcttcgtggaggttgaagccgacgtttgggaaagcgagcaaggcaagtcacatcatccttgaacatattgaatcccagtttataaaattattttgatttaaattattgcattatcgctttatttaaattcccgcgttatcactgttttatctagccatgcctatttacctttgttatgaccttattattgctattgttattatttccttgttcaccctagaataaacaaaaccccaactagtggacactctactcatggtaccactagtatgattttaggcagatgcttcgctggttaattaggcaacattatgtggttttacaactctagactttgggatattcatatcacctggacactacggaatggttggattattgtggaattggattcacacctccccctctattcaaaatcctcaaaatggttttaggctgggctcggggtgcatggttttgatagtagcacatcggccatataaggaccggtcttcgggcctctgttgcaaagcactaccgtacttccacatgtctagtggataaggcttagtttgtggctcagtctggttataaaaaaagtacacggatggagatggacgaagtcgggggtcgatggacatctctaggacaaatgaaggctacacgagctgcggcctggtagtcgagatgtcatggcacagggccggtgtcctgctgctaggggctcagtcctgcctacctgatccgggggttccggccgtaggtggggttgggtcggtactcttgtctatggctaggatgggtcggaaactatgtcacgtcttccgtccgtataccgtggtggtatgtggcacgtggttacacgtgaggaagatgtgtcttgtgggtaaagatgtacacctctgatcagagtataacctattcgaatagccgcaccctcggttatgggcaagccgagcaatgtacccaagttagtgtttttaattcttaaaacctgcttaacaactaaaatgtggaatggttggcctgggttggcttgggacgagctgggacccggggtcgggttgccagttcggtctgaatcatcgtaggccttgggttaaggcaggctcgtgtgggttcacggccttgattaataatattatatagctctagaatcgtgtttacaaaatagctttgagcaactaagtgtcttttaatgctgtttactgcaaactctaaccctttatactataacccccttgtactcccttgcatttattctgcacttgtgggtgtgtcttgttgagtacgatggttgtactcagccttactcaatttttcccaaactcagaagaggagttcctggaagatgaaggctttggtgtctagctcgtgcctgccgtcaagcgcctatggtcgtcgccctagtcttccgctgtttttcgtttgtcttcttgtgtgctgggccttcgccgcccatgtaatagattaattaattacgcttccgcttgttaaactctgaattgtatcaacttttggtgtaccttgcctcctgggacaaggaataatgcacgcacgtaaggaacgcccgttgggttatttccggtcgtgacaatccccctttcatgaacaagaaatcccaaaaactggccagccgatacaccaaaagcacattttgtcgggttcatcttcaggccatattttttggttctcttgaaaaccttcctcaaatcggctatatggtcctctatttctttagacttaacaaccacatcatcgatgtagacttcaaccaaccagccgattaaatcatgatatatgtaattcatggctctttgatatgtagctccagcactcttcaagccgaaagtcatgacaacccattcaaataagccgattgcaccagggcatctaaaagctgtcttatggatatcttcttcagccataaagatttgattatatccagcgtttccatccataaaactcaaaattttgttccctgatgtagcatcaaccagctgatcagctattggcattgggtattcatccttcgttgtagccttattcagatctcggaaatcaatgcacaccctgaccttgccattcttcttaataactggaactatactagaaacccattcagcatatcggcaaggacgaataaaaccagcatcatacaatcgtttaatctcagctttgacaggttcaagcatatcggctttacatctcctcggaggttgctggcgtggtctaacccctagtttgataggtagccgatgttcaacaatcaatcggctgagtccaggcatctcataatactcccaagcgaagcaatctctaaactctcttaacagctctattagcttggttctaaactctggagataagttcttactaataaatgtcggccttggccgatcgtctggacctatgtctatttcttccaaatcatcggccgacatgaaaccttgaccttgcttgtcatcgagatcatctactgtatccttagtgtagacatttgaaccctccacgatgtcctcaaaataatagcttgggttctccatcttcaattggctgtatattagaatcggacactttcagaaaatctccatcccagacttttccagataaacaatcaaggccatccatctcccaaagagctaaatgggcactggcaacattaactgacctgtcagttggcacgatctctatcttgtcgccttgccattgaatcaaacattgatgcatagttgaagggatgcaacaactagcatgaatccaatcccttccaagcaataagctgtaagaacccttcccatcgatgacaaaaaaagtagtaggaatagttttactgccgactgtcagctccacattcagaacacctttggtttccgatggattaccaccaaagtctttgagcaccatatttgtcttgatgagatcctcggcatttctacccaactttctgaacgtagcatagggcatcaaatttaccgcggccccaccatcaaccatcattttagacatcggcttcccattgacatagccgtttatatacaatggtttaagatgccgattctctgtcccctcaggtttctcgaacactgcctgttctggtgacagaaccaacttagctgattcctcttccacctcgtcgacatcggcttgatcgatcccgaattcggctggcagggtaaagaccatgttaaccggtgccatcacaacactcttcccttttgccaacctctttgcctcatcggctgcaacatcatcggctagagtaacctgattcttaacacgccactcctgccttggctttgctttcttcagccgatgattaatttcttgttcaacctcctgaaggcgctccctgtttctcaatctttgaacccttctcttctgattcttcatgaaaataccagaatgacaccattgattcttcctgattacattgtcctcttggccatgatcttgattcactggaccaaatctttgatgaacagaaattcttgtctgccttagccgattactcctattatatgatcggcttgatctctcaatgatatcactgcacccagggcagttttcaatagatggcaacctcatgctctcattccagcagaatctaaagaattcacaatcccaatgagtatcaaaaccatcatcgtattcttcatgatgcttctcctgctgcttgtcatacttcctctgatatttatcgataatcatagccgaattcgcctgaaaacccgttgcacggaccctattggctgtttggccagctgtatgcaccatattaacaggaaaagggttaccatcgaccttcatcggctttttggaatcatcaaacctaatcttgcctccctcaatggccacctgaatttgctgtctaaaaaccttgcaatcgttaatagaatgagacccagaattatgccacttgcaatacctctttttgcctaattcctcagccgatgggattgtatgaccagcaggaagttgaatttgcttctctcggagtagcagatcaaagatcttgtcagctttagtaatatcaaagtcatacttctcctcttttccagaactttttacccattggcatggtatgacctttttactcctcacccattcggctgcagctatttcagaatcatcgtcatcatcatccgacccatacatgtacggacaaacatgattaacattcttagagcttttcctaacttccgcagacctatgctcatgcaaggttactttctgtatcatatgtgacaagctatcaaagtcttcagacgagaacttctccctaatcggagcaatcataccctgaaaggccagatcggctaactgggcatcggttaaactcaagctgaagcatttgttcctcatctccctgaatctctgaatatactagtgcacaggttcatcatgccgctgcttaatcgctgtcaagtcagataatttcatctcatgaaccccactgtagaaataactgtgatattgcttctccaaatcggcccaactattgatcgacccatatggcaaagaagaaaaccaagtaaaagctgatccagacaaagataaccggaataacctaaccttcagagcgtctacagccgatgcttcaccacactgagctaagaatcggccaatgtgctcataagtcgatacaccatcttgtcccaaaaatttagagaagtccggaactttgaaccgattgggaagaggaactctctctcaaaccactcagggtaaggctgccgatacaagctcccagtctcttttggtttaagcccaaactgttccctcattacgtcagcaatcacatcggcccatggtcgttgctgagctgccccttgtgactgttgttgcatgggtccgaactgaccgtattgagatgcaaactgaggttgagccaatccccctgggtgatattgggcttgcggggaaggaggctgatattgataattcaagttacccccttggtaattatgaaggttcggctggatattacgtaccaagtgctcaggaacaacttgaggcattactgtgccatctggctgtacgtggtgaaccaagtgttctgggacaacttgatttaaaaattgttgtacaggctgaccaccaggcgttgcaaacccggccgatgtgcttactgaaccctggtgctggatcggctgaacgatttgctgtcttaatggcgttcgctgaatcggctgcagaggctgttgccttggtggtgtttgcggaactggttgcatgacctgttgctggattggttgtacaacctgctgaattgggggtgtctgctgaatcggctgctactgaatcggttgctgctgtattggatcaacaacaggttgaggtggcagaaacatggcagcaacctgatcttgggttagccgattcgcaacctgcccactatgctatggatgctctctcattaacaaccgagggttcgccggctggcctggcgccatcactgatagagcaggtagggcagttgatgccggcgccgttggctgagttgttggtgcaacggagggaaccggctgaatagatggctgaacatcggtaatcaaataccgataatttgggaagacaccttgcaaataaaccgggcctgcagcctgatgctcagctattgaaccatcggctattgacttcatcatgtttgataaggtattgactaacaccccagactaattgatcaaagcatgatgcaccgcgtaatcaacccgatcttggaagttattgaaaaaatcctgtgccacatcactattctgattaagatttcctccctgcagcccctgagcaccatcaccttgaactccatgcaccccgtcaccttgtactccatggactccttgagaattgtcgccttgatttcctagagagccgtcggtagcacctttgatactcggctgagccgagccgtctggagcttgtttcccatctccatccttagaagaactggtcccaggatcatcagcaaccacttttattttgtacttctgaacaagtgtccccttgcgggtctgcatgaatgagttcaagaactgatcccgtgcttgctgcaacattgcttcaaactctttcttctgttcaggtgtgaatttttctggatcgatcggcacgacgtttccttcattgacatcagtcaatcccaatttcagcatcttttccttaacagagcctgggctagatggtggtggtggttgtttctcggccatgaggaagaattgttagctgactacttaaaggtcccatcgggcgtgccaaaagcgtgttgacagaaaacacgaggcctgggagatctgcttaactccagtgcaggtccaaagctcgccttcgaatgtataagcgtgccagttgatttgatcctgtaatcaacaagaaatagaagcaaagaacccgcggttaaatctataaatgatagtcgatcggctagaggccgatgacatatcatttatctttgagccgatgtcatatatgtatcgatcggcagacatgaataaataagaaggaactaaatctattcgatcggctgtagatattaacaatatatactccttatatcgatatatacttaaatcaagtgattgggatagatcggtcgccatgccgagacagtataaatcacttaaatcgaaatatatattaataatgggactatatatgttcatagcatagccgatcatatagatctaggatgtatcggctaatactccgataccactctatactaagatgttaaagtaggtagaatatatcaaacaaaggcctaatatacttaaatgcaataagatcttaaaataaagggcagatttaacatgtcaataaagtatatagggtaaatatagttaaattagataagatcagctgaaactccgatgctaccctaatcggcaaccagaaggcaggctagagattgattttctaagcacgacttaatatatcaaacttaactgatacaacattaagtatgaaaagaacaacaatatctagacaatcaagctgctggaagttttatagagtggtagatatcttatataatctaaatcaacgttgaaatctaacctaatcggctgctctctaccgacagatgttagccgattgtagattagatagctgcattgccggagattatgtaagatatatgatagctcgacgaattacataaacgagatcagagtatcataaagatggaagcactaatcccgagaacacaagttgtcataacaagttttacctcttgttgaagatcgaaaccgatgcagctcaacccgaaagtaagaactcgtcgaaataaaactaaagcaaaaagggtggtgatgagccgaaattgtattgaacgtgtgtgttcaaagttacatagggctcgggtctatttatacccgagaattacaagatatgtctataacggacacgactaatatctttaacaaactctaagatacaataagtctttacggcagacttttgcccaagcgtatctctaaagaaattatataaaacatcctaattaatagataaaattgccttctcaggactctatccttgtgcagtaatcaccttgaagtgcctcaactcaacccgatatcatacatgaagtcgcattgccggaatcggctgcatcggcttacctagcccgactcagacctagccgatcctaatcgtagccgatctagactccagccgattcctgctctgtttccgaacccgatctccgcctccgacttcgcttcgatctaatcttctttcccgatgccgatattaccaaatttggttgttaacaaatatgtaaaactatatgcatacataaaaatatatttaacaatgaatcaaatgatagaaaaagaattaataattacttaaattttttgaataagacaaacggtcaaatatgtttaaaaaagtcaacggcgtcaaacatttagggatggagggagtattaggaatcctagtcctgcaatgggcaatgggcaatggcctggagaaaattcagcatcattcagagatctcaagtttgttgatgctaatgttcagggctatgatcctgcaccatggcctgtcggcatccattgcttgtcaactaataagaactgctaccaattaagttagtccatatttagatggtgtattccattttggacgtcctggtggttgacaaggttgaaaatttttccaagtcttaatggcaaataagttgttctcatggaaatattttgggcttattatttgcatatcccaactgctttagcaagaacagaagaagtcatgttaagcactccctaggcttgtttcattcatgattaaccttaccataacttagtggagaagtattacaatctctgcattaaatgcgtgtcttggagacaacacgaatattgcccgtgatggggcccgtcaaatcatgccgcctgacacgggggacattcctgtcagcggccgtcaaggggcaaagacttttgggtccatgttcacactgctcgtcgtcgttgcgcttgaaggccacaaacgtgaaacagtgaaggacccaccggtcagagaccccccacttgcaccgggaggcggcgatatccgccttaattatattaaggcagacgtgccaccctcgattgtgacgggaggctaaaatctctcatcatgatcgatgggacggggccaggcgcacgccgcctggcacgcgtggtagtgcgcctgacgcctcggtcccatcagtcaatcaaccggtcatgcctgctcaggtcaccataaatgcgggtaggtgggcgctcgaaggcaaccacctaacccgttgcacatggttcccggtggaggggttcgggggagcccgaccccttggtcacacgagagggcggccgccacctagtctcgggcctaacccccctcgtgggtaaggccacgtggtgctgggggcagtctcctctctctagtcttgatacccccggacccgtatcaccgacaccggcatctatattcaatcggatatatgcaccctttttttttagaaattataaacttagcctatcaaataaggaacttagcgctcaaataatccaatctgaaattcactcctatttagatttgaactcaggaccttgagatgctacttaggtcactgcaaccattaggctacatgcccatttacatatgacaatgccaatggcattggtgctatcatgttaaaccacggtgtgccaatgatgttagtaccgtgaaaagggtttattctcggaataaaatttctgggtttatttgtaaaataagttttcaaataggctacagtcacttcgttgaagacaaccgcaatggttacatgtgtaacacgtaattgccaacgattttttttaatattctgggtttgaatagatgatgggagagctttagcaagaacaaagaagggatcatatgttactacattgagcctgaagaaaaatatggtcattttaagtttaagaactccctaggcttgtttggttcatgattattaactttacgtggcatatctcttttctaaacaacaaagtctggctaacaaaatggtaacctaaacataggcaatgttagcatgaaccaagctgtcacagcactcttcgtcatgccagatagaaatggcatacttaattacacacctgcacaattcttttttttaaaaaaagtaaattttgttttggacttctttctaccaaagtttcaccttggacctcctgttgacattttatgttgccgatgaaagcctgcaccttggtgcttgttaacatgtattttgattatttgaactaatacaacaacaataaactcaaaactaatgtatatagaacagaagatgtacacattgaatttttgccacaagttcaaaagaaacttttggaatttaagtttggttatctcacatttttcttttggaatattctcatgattttgcaacaaagtttatgaaaccacatgcatgttccaatatgtttttacatacatgagttttcaagaatgttttcaaatgcacaatttgcataatcaggaaaagtgtgcctaagagaatgtgattaacaccagcttctgagttatgttaccatctgtagaaacagagcatgtcaatagcacccaccaagcgaattctttacaaaaatatatgaacgatattcggatgagtttactaaagccctcgactctgtatactacataatcaagcactaataaaaggaaaatgccgtttgtattcgtacagaccaagcacaccagtaaatcgaaccacatagttttgacgctacggtattcgggcagatacaacacatattggaatagtacagtgaaagcttaaaacatggagaccgaaattcaagatggtaagcgagtcgacattatcaatatattgtgttatggcctatatcaactatcaagccctcgatctttgttccatcgagctttaatttcttccagttcgtcatcctgtcattgaagaaatcatgttatttagtcaatcctatgctttcattccagaacaagtgatttctctatcctgagttaaaaggacgttttagaatcaagtgaacaaatacaattacaatttagaaagcatatttatttacgtttgcaaaatatatatagttcatgtgctcagtggaatttctttagtgtgtcactgatgcataaagaaagaacatgaaatcactttgaaagccattatgaatagaatcgcaactggtatgtcaacgcacctcaaaccgatggtagatccactcagcgtataagccatcaaggaagttctgtggtgcagaattgttgttcatggaaatcactttgaagaaaggctggaaggagtgcttgatattagcattgtcccactgcaagtgctccaacaattcttcctcacaatgaataaccttcatattacatgggacggttgtgaaaggcagtgttgtcagctggggacaacccaagatttgcaagcactccaatgaaggaaagtgaaaggatgagtcgcagatagtagtcaaactctttaaataaattaaagtaaacctttttaggcaaggctgcgaaagagatattctttctttttcatctgtatttggcagattatcattgttagaagtgcttccaattatttgctgtagtttttcgcaattatatactatcaggtcttccagataaggaaaatgttgaacccacgatatgtttgtcaagctaatgcatgatataaggtccaatcgtctcaggttctgaaagagatcctggctttcaactccttcccataatacatctgtgaagtaatggccacatatgtagagcttctcaagattagaacttcgatgtggcctgttgctttcaaatacaatttgttcctcatgtgtgtagatgtataactccaacagattcctctgtatcagatcatttccgaacaaactgtctgaaaatgcaaaccttttccattcgtctagagactttgatttaatgattacacagagggatctgacaggtaagctggttttgcagagcatattcaagtattttatcttgcctacagtaattccaagagctttcaagtctgtcatgcattcaagagcaccaaatggtggttcaaaagaagcaggttgttccaactgcaacgagcaaaaatctgcaacctgcagtctggagagctttgacagaataacttcgggaatctctctgataggatttgacctgagaagcaagtactgcaacttaaaaaggagtccaagctcttgaggcaagtctttgattttattatctgataaattcaggtaatataagttcacaagtttgcacacttcactgggaatggttttgagccagttccttgagaggtctagatattgaagagatataaaaaaacataagctactcactgaacttccatgtaaatcattattctggagtatcagcacagtaagcttggtctggtcctcagaaatggcaggcagttgtgccatttcagtgcccactgataatatccgctccgcattacaccaatgtgatactgtttgtacaacccatttattcttctctcttccttcgtcaccaacaatccaaagtgccatgtcacgtatcacatcgtgcatttttacaagcctgtcatcatcagtttcctccaaaaggcacttgtctaccaactcacgaattcgtgcatatcctgcgttgtaacatctatgaatatcctcctcctctactagacccagtcccatccagtactcagatagtttgtttctatctaacagataatcatcaggccataaggcgcatgatgtgaaacaatctttcaaattagtatcacttagatattcataactgagtttcagtcgagcaaacacactttcttcattgcaaactggcccttcaatctcattaaggcgtgattgctgaagaaagtcgatgcaattctgccattctcttggatgcctcttggtagacatggccctgccaactacaataagagctaacggcagtccagcgagttcatttgcaacatcttttgccagtttaagtacaagggggtgattttcaataatttcagtaccaacattttccttgaaaagatgccatgcatctgtttcatccaggcaatctattttaatcctttgcccattcttgacacccatttggccacaaacactttcagagcgtgttgttagcaacaatttttgtttgtaattgccaattgagataacttcgtttggaatcccaaccttatcaagatcaacatgttcccacaaatcatccaataatataagaaaatttttacttttgagaaattcatatatgataactgcctgagattctgtgtcatccttcttcaccagcatctgttccccaacaattgcgtcttgaaccttcaagtaaaaaagtacttttgtcatttggagcaaattgacagagagcttaattaaataatgttgtaaagtatttaaaattagaagtatatgcagttttttgaaatatcaaaatgttagctggctgccaggagcccttatttaacgctagttattactccctccggtcagttttatatgctgtttccgacagccaaaatatgttatgtgtaagtcatttcgttggtctgaaacaacaaatatttccgtccggagggagtattacatgatagtagtacctgatggcagtcaatatgaagactgttagtatcctagaaatcgttgctcctataaaacaaactataattttagctggagctttgaggctccatgaattgctcattaggtcgcttaccctagatggtttgtaatttttgtcttttgggcaagctggatgcattcatctttgcaacaaatatactttagcaagatacagaaacatgtacatcaagggtcaacagttagcttcatctaattagttaaagacaaactttgatcactccctcgttaaagggagcacaacatacctttgcaacagagcaacctttggaagcagtaactcgaataacaacatcaaaagcagggtttttgtgaaacaagttgttgatctgatggagcagatgtgtctttcccacacctccagggccccataacccaaccttgcttacagcctcatccctgatgaacttgacagcgaggctgcgataccgatctgtaccagttaggcttacgtcagttatgggcacttcagaggaagcctgtggcaccatgacaccatattcttcaaacatgccctcactgtatatcttctctgcagcctgacagtttgctgctgcactcttggctatcatgtagtagtttacacagatacaaggggacaggctccccatgcacttggtcctcttaccatactttgcctggattttttcagtctccacacatacatgctcagcgcgcttcagccatccttcaacttcattcctccgctgcataccttttcgcatagggctgtccaacttggtctcaactagggatgaaaacggtcgggaatggtcggaaacagtacattattttattacttttttcgaaaacgagcgcaaacggtcaggaaatttctatatttatgaattcatctatttagtgtcaacttcaatgctacgctgacagaaattaaaaaaactaaaatttgaaaacggtaacatcggtaaaaatattattattatattagttttgcggaaacggtatcggtacggtcgggaaatttccataccgtttacacccctagtctcaacatcgctgagcctctctcttaaacgctcggtggcagcttcgagagcgcgcacacgcttgcgggctttgaagaagtaggcggcgtactgtttcgagaggcgtatcaaggagatcaggatagcaccagagcacttgatgccgatgatctccatggagtttgtggtattccttcaaccaggagaattttgtctgtgtttattaagagtgcaagaaccaagaagaccaaaaagttgtcctgtgttcaataataaggattgggttcctatctaactgacatcttaagagaaaaattaatgcaatagcgatggcaaatattattacatgaatagaagattcacataggtccaaaattagatggttcattcgatcatttaacacctaacagatgtattctatggaatcaatctgaattgatgagttcctttctggtgttaactaagaagaaaactgaatagttatcaaaagcgataggccgcacatagcttcaaacttttcgacatatgtgaagcctattgttttgttgatagttcatggtattgatgactaattaacgtgctttcagatgttattagtttaacatctgatggatgatgatgcatgcattcagtgcaatttatgcaggaattcctttcttactgactgagtctacaagaaaaaattaatataaatgacaaacgatgattgaactcacacgttggttaattctaaactagacagctaactataatacatctggctgcaggcatcgtatagctggatagcagtgcgtataaattaaatacttaattttagacttgggtgcagtgtgcatactcaatattaccattacaataatccataagaatcagttttttttaaaaaaaagaacatgccaactgaaataaaggataatggaagttgctggttccgtccgtcgtcaattcctgcatgacttaagataaggatagacaacaaatcgagctcatgcttgaaggcctcgttgttttggcttatgcttattcctataagtcaaattttaaattttaaaacttaattttgaattctactctttgtttttttatcgtactttattttacaacatgcttatcagtcgctaagaacattatattaaagatttgtacatggttagtcttttatttggtaataagttattcatataagcacatgaataagtgattatttatccaccgacacatatatacaaattaaattggctcaacccgttgcaacgcacgggcatattttctagtacctaattaaaaataagcaaggtttccctaaaaaaaaatttcgtccgtctttttttatttttcgcccttttttctttttttttctgtccgttttccttttttttttctcagtctgtttcttttccttctttctctccgattctttttctttttttatccgtctgtttttttccttctttccgtccttttcactctttttcttttttcttttttcccagtttttccgtctgtatttttcgcctttttttccatctgcttttttctcttcgccttttttcattttttccctctgctgttttttcttaatttttttctatgcctttttaccgggttttttcatatgtttgttgctgtttttttagttgtattttctcgcacgtggtaagcatttgtttttttatgtgccatattttctacgcccggctgaacactagcgtcgccggtcgatctgccttcccatgcgttccctcttccaatcgattgccaaaaatcaattccccgctactcccttatcattttcctatgattttccttttaacgctgctttaattcactgaatttaatctttatttaaaaatcactgtttttatcccgatgtttgtcgctctgattttaataaaaacggaaagagaagatcgagtgtatcaaaaaccctcgaccaattttgaaagatcgagaaagattcgaccaaatttgatgggaggatcgattttggcatgtacagacacgacattgtctttcggaggttgaagactacagtcggatatgcgagccggacctacacagctccacttgacaaggaaggaacgaaatgagcttttggtctaaaaccaaagagtaaaatatataacgatccaaaaatatttttacccgttgcaacacacgggtattttttctagtaataataataatagtaagaaaacaaaaaagagctctgacgacgtgtacgttttcgtgtgtcgtttaattatttttatgccgagtctgccgatgtttgtcttgataatttgcttatttttttctatgtaagaattatcgatgatttatgggtgaataggtaatctagtctctcaaagttcactaaaggcacaatttaaaccctgagatttaattttatgcacataagtccacataagtcctcttaagtattcattttaacttaaaatcatctttggaccaacttaatatgcctcatggataatcctaatcaacatttgaattaggaaatgtcccttttgctcctaatctgcatagattagaaaattacacaagaaaagaataaataggacagaagaaaagaataaataggattgtgcaggtactttccattatttaatggctacggtatacataaatttttttattgtacttaaattgctatgcattacgtctaagaaaattcgttgtgcgtaattttttttaaaaaaatatcatataattgttggatatatgtccaaattaaagttaggtatacagaagtcccatcttacaatttatttttcttgtatatgtggatgagaggtattagagtcattattaatagagatgcgcatgactttttataaagagagaatctcttatatgccactgaaaatttgtttgatcccttggatgccattgaaaattggcacttcccttatatgacattggttcaaattttcgctccctctcatgccattgccgtccgttgactggtagttgactgttgataggatgtaatcacttgtcatttttttacagaaatgacaaaaataccctttggcccaaacatgagaatatggcccaatcgtccaagtgggccaagcccaacatccctctgatgcaccatgtcagtaagcctgaacatgtattttggtactgtgttagtatgcattttggtactatgtggtcatttaaacagctccctataatatttgttgcatattctgtgctactgtgtatatctccatgctctagcaaacaatctgttggttattttagctatttagccgtgcattacaaacaatgtgcaattacacattatcttaaatgtctgtcagaagcaatctattatattgcttgaatgttttgtcatactgtgaaaacagagaaatgttgtgctccctagtaaatattgttgaagcttttgttcgagaagcacatggtcaatgtatgtggaaaatacattaatgccataacagattgctttgttctactatgaaaaacagagaaatatgtgcctcaaaattatgtgactgaaaaatattcatatattcaatatatagattaatgctatacattcatatattcatttattccaaatatatgtgatgcctagctaaaaggtagtatataactgatatactaacacctactgcatgcctatcaactcaagaagggcaaatacgtcatttcactctacagttaacagtcaactaccagtcaacggacggcagtggcatgagagggagcgaaaatttgaatcaatggcatataagggaagagccaattttcagtggcatccaagggatcagacaaattttcagtggcatataagggattctctcttttatgaatgggttggaccagatgcattgtttaataattaattaatacatgtgggttggaccacatgcatgcaccgttttatttataaatatatagctctgcaacgcagcacgtatacaggggagagcttttacaagaaggcggaaggccaccacgcggagctctcttgctcttccattgctagttttgcttcatctccctgcctgtaagaggtgcaaggtacatttttatattgtagtgtatactccctccttcctaaaaaggttaattcttaaatttctactccccgatctaccatcagtcaaaaaatacagaagtttaatctctggagtatatatgaccaatatcctaataaaagttttatttaacgtttcattctcaagttatcgtattcggacgttcaattcttaagttcttgcactgtatcccacccacctactaagttgttgtaccgtaggtacaatttactcataaaataattatgaagaggaagagggaaaaaattcatctaaatcaaactaggcttaggctatttccaagactatgaaactagttaaaccaaggattgttttctaatttgtactaccagattttagaaatttcatattttttataaaaaatatgttgtataaattaaagcatataaattgacggtagcgctattctatgctctacaacgcggaatattagttcaagcgccgcataacgccctctcctttcagttttccccttttttactccctcacctttcctccgcatcccaccttttctcagttcatttttttgttttttaccactccaccttccgtgtttcttttttctcttttcatctcatccgtgatttttctgtttttctttccttctctgtagttttttctgttttctgtttttctttccttcttgtaaaaatattaaccagatttttttgtttttctttccttctctgtagttttttctgtttttctttccttctctgtagtttttctgttatcacgtccgtttagtttttctttccaagttttcctttttctagtatctccgcacgtttcaaaagtaacgaatttactcccagcctcccacatctgctcattcaaaagtaacaaatttactcacatgaatgcctccacatcgtatgctgccatacctagatggtcgtaaaagaattattaccagcttacaacgctggtaattcttttaccaatataaatattgtttagattttgtggtccatgagtaaaacaattactatcttcctcttgatatagcccatgatcttgtaaccaccgtgttgtaatatgtttacatgatcttgtagccaccgtgttgtaatatgtttactgatgtgttcaatacacagtataagagtaaaaactgaaatttcatggtctacgagtaaaacaattatcaccttcctctcgatatagccatgatttcatagccaccgtgtagtaatatgtttactgatatgttcaatacacaatataagagtaaaaactgatactaagagtattgttgatctgtatcacaaaatagtcgtatgaatgaaaaaattacaggctcaatcacacacaagcgataaaattacgccaaaaaatgattcagccaaaaaatccatccgatggctttgctggatcttgctatgaggatgaagagcacggtctgtgccttgtgactggtagtggagagggcaaccgggtggcgagcagtagtcgatgatggaatcatggaaggatgcgagcagtagtcgacgatggaatcatggaaggatatagtagtgtggtatagagatgagctcgacgtagctcagtagcagccatccatcatctagcaagcacgaaaaaaaatgcaaaaacattctctttcacgtcaatacgaatgacaagcaaatgaaaaaaagcgaacaacctccatcaccggtggactccaccctatcctctgcggccagccacatggagcacgatgtgcaaatgtaggacctgtgcagcccatcaattgagatcaggtaatactggagattgcacgttaatttgatttgaaaaaaaaattagagcttcatgcgtgaagttgaaggagagtatgcagatgcaaatcagagtgttatttccttacttgtttgttatatcaatatcgccgatgtggagcagccgctggttgctgctattggcccaggtgaacacctccttgctggttaaggtgatgcctagcgtttggcagtgaggtccgaagtagtgccttcgcctcaaccgctgccagccaccgctcgctggccaccaccatcaattgccacggtgtcgtcgtcctcctgcatggtgtgtcgccgatctgtgggctgggctgggatcgattcagatcccaaaaaaaggaaaaaaacatagtggggcgagagtggttggttgggtacgggataaatagaatatataccggaagcagagaagttgttttttatcaaagtaaatcatttactccgataatggtgggagcacgatgcgggacgtggggtgggatcggaagcaggggagttttttttattatcaaagtaaatcgtttactcgaataaaggtgggtggttgaggcgcgcgataggagtaaatcgtttactccgacaacggtagaagtgggatgacgaaacgtggggtggggtgggcctgggctgatgcatgtttggcgctgcgctcctaacagtagttctaataaattgatttcaataaatttaattggtttttatgtaaacttaagcatattttttcatattattttcaatccaccttattttaaataatattttataggatcgtagggatcgtagaatcaggatacaaactaagatttcatatgatcgtgtgtaaatgaatactaagattagaataccataaaaattaggatactaggtaggatcaatatcatttcagcttggtacgattatagtatcgtaaaataatataatacggatcgggatactgacaaccttggttgatagtaacattaggggctagattgatctcatttcatccaactacatctaattaatcccatatatcgctattaaatgccatgactaacctataaagtcacgcaataaaattgtgtactggagggcttaattcagggtggttggagcaagggtgagtgaaggtaggtagtgtgaaaattaaatcagaggtgattagtaagaatacagtactagtatatttcggatacagggcctgtttagttaaaaaaaaacttttccaaaaatatcacatcgaatctttgaacatataacatatatggagcattaaatatagataaaaagaaaaactaattgtacaatttgcatgtaaatcgcaagacgaatcttttgagcctaattaggccattattagccataggtgctacatagtaacccacatgtgctaatgacggattaattaggctcaaaagatttgtctcgcggtttccatgcgagttataaaattagttttttcattcgtgtcaaaaaccccttccgacatctgatcaaacgtccaatgtgacaccaaaaaatttttatttcaccaactaaacaggcccacaatttaaacgctataaaaaccaatattttgatatggagggctacatagataaacgaatagagatgtaactataatagacatgcaatgttgtcatttaattttcaacgaataaacgagtagataccggttagatgatgatcaatttgaaaagatctaaaagaatattcttaggagatgattaaattgggatgtggatggatcgagtacgtatgtacaggtagatagactcgcatccatatacttcctccgtccataaatgtttaacgccgttaacttttttaaatatgtttgaccgttcgtcttattaaaaaattaaataattattaattattttcctatcatttggtttattgttaaatatatttttatgtatatatatagtttaaatatttcgtaaaagtttttaataagacgaacagtcaaatatatttaaaaaagtcaaaggcgtcaaacgtttagggacggagggagtaccatatttccatctgaccttgtttactttgttaattaatttgctcacacatattgtattgtgcaggcaacaacgatgctaccgagttccatatgctccatgggccaaatcccaagaacttcaccccattcctatgggatgctgccaaagcagatgagcaaaggacatcctcctacggtcactagaggtacaatagtttttattgggattgatgttacttgacatgaccaagtccctctctcctatactaatcgttctaacgtggagtagtaaaggcaggagacaaattagctttaggtaaaaataaccaaactacccttaattattagttgcagatagttatttcaatgcttacgaaattgtcacaaaataattgcaccagccatgcctgctacccaaggaatatttctagcatggagtacaattatttaaacaaaaagttcgaataccccctaaaatatggcgctagttcgaattatcccctttgaattcaaatactaggcattttacacccgagttcttaaatctagacaaattacccctaatttaatcatgtgtagttttcagcttacgtggcacacacatggcatctgtcagaaaaacaaatactccgtaaaaatctggcggggcctattgtcggtgatgctttttttcctcaccctcaatgcctcgctctccaccaacaactcggaatcgaccagctatccgccgcccgtgctccaccgacaaatatctccttctcctctatacgatgaacacctagaggaggaacccaccgatagagggtggtgggacaccataacctacttgccttcctcttcatttcttcccctcttccgagcatgcttgggctttagatgctcaccgctgcatgccatccacccgactccctcagcgaagaggtcgacgcagatccaccagctccgtgcaggaatgagctcctcggcagcgacaacgatgagcttgatgcctactggcctctcctcaattcggcactgccggctatcaatttgatggggcggcgcctcgaacagaaggctaaggagggagcagaaggaggtccaggagaggcacattcgatggccaaaggaggaggtggagccggtggtctcgatcagagtggctccgtcgatctagaccgcaccagtgcttaagcccactcactgaggtccgtggaggcgaattgccttcgaagcccaagccaaccaagaggaggtggtgtggatccgaacttggttcattgtcgagagatcgagtttgctctgcgatgggtggatccatcgctgtgatgttgccaccaccaaccaccgccattgttccacctctaacatcattcgccgccccgtgcacacttggcccacagccgtcactctaagtcccatctcggcaccgtaacttgggaataaggggagtcgagaggtacaagcccctcctaggcactgccctcctcatcggcaagcgcatgcaatggaaaagctgtgatgcgatgcatgcgctagcatgcttgtgatgctgaggagaaggcggcgtgactctttgtgctaaggtgatctttgtgttgatttgtcacgcccagaaattcactgatattttccgaacttatttgtgcataaaatcctcgtccaggaattagctgaggtacacaaactgacaatttaatatacatattcatcaaaataactaaagagattaacacttactgaagaggcacttagtccacacaacaaagaaaactgcagcggaaaataaaatctagcgaagctccggctccactcccacaggcagctcaactggggtataagctaaacgtcttttccctctggatcctttttcttcaactgaggtttaattgattattgcaaggtgagcatatgacatactccgcaagccacacagcaaatatgcaagtgcacaaggatatcaaatgatggcataatataggctcatttgcaaaagcagcatttagcaaacatttaagagtaataaaacagtggagtaattaatcatcaattttaatcaacactgaacagcacacccatgctggtcaggcccaaccctcctgaacaaccatacccggctgtacagatctaactccaaaccaggagctaagcaaactattaccagttatagcatcaataattattgtgagaggtgtgactctaatcatgaaaaacattgctcaacccgcccatgaccgcgggcacggctattcgaatagttttactctggccagaggtgtaccactgtacccacaagacacagccccaaaacatgtcaccatgctctcagtaccaccacggtacctcggaacgggactgtgacagtacccttcgcacaacacaacccaccacagcgcatcattcctggatcataatcactccctctacaaccagaggcatggactccctagcgacccccacggacttctcgccgcttctcagtctggtgccccgcaatgaaccatgctatataaaaaggtaaagccgttgcccacgctggcttgtggttggtacggttaatgtctcacatcagtagctcgcgaaccggtccttaattgtcatgagcacggccttcaaaaccatgtgctcacaacccaccattatcaagttttagttggcaagtaattaattaatcaatcacgattgaccatcgtgagctaccattaaatataacaataagtgatagtgtaacattagttatcccaatcatgtgctaatatttctaagcatggctaagtaattatgtctaacatctagcggaaccaatatataaagctcaactagtcaaattataataacccaaggtatcaaggaaaagggtaatcaatgcaaattggccataacaaaggaatagattcacaccacccggtgacattcgagaataaatgtacagttgaaataaatagagaatttaaatataggatcaacatgctcaaaggaattgtgtttgggatctgtatgacttgccttgcaataatcggtcttcaattagtcttctgaacaacttccgacgcactcacgaaccttcgcaacgacggaaacaagctaacacgcaaaacgagaaaaaagactaataaaaaccaaataaacagtacataaaagtaaacaaacatgtagatcataattttaaatgaattatgagacttgaacggcctcattctgacttcatatgaattagttatgaattttacaagattaattccaattaaacctattaaagaaaagactattccaaattaattaaacaatttacaaataatttataactgaaatataagactaaagcatcctccggaaattattggaatgaacttagtagacgacatatagtaaaaacaactaatatgccattgaaaaggaataacatgatttatattgattttggacagctgagatcaactttgacctagttgaccaaaattggatggctcggattgatctgatctaaggttttagatggctgccacgtgggatctgagagacggcgtggcacttaggtggcagcgacggcagctgacaaggcaatgacatggtaaccacgcgggatcaacgccggcggctctattcggcggtgaggacggcaaatggcggtacaacggtgaaaaccgagagcacggagaggaagaggaggacgcgacgatccttaccaacacttacgcagcgatgaacagcgaaggagatggccgacgacaagctccgaagggcggcgagatactggtcaacgatgacagcggcgttccagcgatctttggcgaagacgagatggtggacggtgttctccttgcagctgcgaatctaatggaggcggcggcgaccgaaggcgacgacgggagtgcaaacatgttcatggagtattgcattggtaagtagaaagttgagcactattagcgatggtggcctccactgggactgtcctaacttagccatatattccatgctatacttacgacaccataataaactttgttgttcaagtttggtgtccttcagggaagaacaaagagatggaggtgaccaaagtagttttttaaagtgttttgagtagatttgtggtgcagtagtgtagatacaatttgtttatggtgttgatcattactactaaattttttatgatatagatagaatactctcttttgaaaatgaccgagggtaatcgttcgatgatattttaaaaaattatagctcatgagacataccaccacgataatatccatatcatcattttattatttatattttggcaaatatgtatagtgaaatagttctaaaaatataaaaacattttgagaatcttaatctcaaacaaattataatttaatcagaactacttgaaaaacacaagtgttgaagttattattttctaataatagatccaatctaatagtgtaaaataatgagtccaccaatttaagtgaaaatcaacggtgagattatatagtgcccatgtggtggcttagaagtgagtgccacgtagcgacttaagagcatccataggaggtttaatggacttttagtatataatagaatttttacatatgttgatttaaattgtgaagtgatattgccctccctaaaatatgttgtgatttttttgaaaagttatcatacatatgttggcctcatgtgccgtggtgtatttaggaccataatataacttttataatttaattaaagaaatacaacatgatcgcaaattggatatatataatttcaaaataatttagaagatggtttaaagaatatttattgggtattttatattttattatagatattagtttaactatatatatttatattatatttctgaagtaatatatttcatatttatattgtagaaaaaaccgtccatttttatatatctatgtttattggttgtcttttctatctatgttcgtacgtatggttttttcccgttaaaatcgcatgtactactcgtacgtcgtaagtactggagaacggtagtaccatagtagcgtttgtatctaaacagaatgaagttattactttcaataatagatgcaatctaatggtgtaaaataatagatcaacaaattttaatgaaaatcaacggtgagattatatagtgcctatgtggcgacttaggagtgtttataggaatgccacgtggcggcttatactacaagaatatatttaatctgtcacaaaatttccgtgatattttcagaaatcgtcatggatatgcaactattgatacaaggcccataataccgtgacagtttatcgatttcatcgtaaaccggcccaaaaactgtgacgttatatcaatttcgtcgcgatttacaaatataatattaaatacttcaaaattatgaatatcaagatctacaacttttgttttggtcattttgctatatgactctgtttcaataatttcaatttgaatttcaaattatgacaacttcaaacaacattttcaaatactaaatgatttcaagtgaaaaagtcatcaacaacaaaatatctgtaacttttattttgatcatttcttcatccaatagtaatattgtttataaaattttcacctcagccctagtggccgtgttttgccctagccgacggcgtacggtacgtcggtacataccgtggattaatcgatctccggctcaaattaatcgagccaaatcagtgcatgcatcaatgcatgggttgctgatgtgcacaatgagactcaccgatggttaaccggggattgacgaagcttggacagtgaagtctactccgggaacggctcaacgtacgggggcggtggtttcgcacggacggcgttggcgagttagggccatcggctaggaagaaggttagaaaaacatgcgcaagtgatcgatctattgctcaccggttgcggagaaatccacggctaagcttgacggccgagcggaggaagacgtacaatgggcgttctcctcgcttgggactcatcttggggttttctactcctgggagggatgcaagcttggtggtgttgcagtttggctagctggaggtggctcgagttagcgggaacggcgatgtcgatatatcggtggctgcagctgaggacgaggacggcgttcccgttgttcacggtgtcttcttcacgcagacgaggattggcattgttttctatttattccagatggtaaaagacttcttgtgaaggaaacagaactaccattttccttataagactacaatgcaccagatactgaatttctccaataatgtagccagaccaaccaagttgtatagattaaacgcatatttatcagatggttgccagtcggcagtaaagaaaattaagtgataatattatttctgatatgataatttcatttttaaacctaactaggaagatagcccgcgcatgtgcgcgggcttttaatataatgttgtttgaattttttttacgaatatttgcacgcaggtaatttttttcttgaaatattctttgattctatactaaacctgtttttgtcaataatttatttaggatttttttgacagtggttatgattttcttctaattacccttgtaacatataaattgtaaagtagaaatacttcaaaccatacagtcttgaatttatgagaatatattgtatggcaacaatggagtttctaaactttaaataccttttctttttttgtatagtgctccctctgttttttaatatataacaccatggacattttagatatctttgactattcgtgttatgaaccacaaattaatgttatgagagagtatatttatgaagagtgccatttatatattgatttattcggtttttatgatttgtttgcatatatgtggaataatttagctttgaatatttgtaaaatagtatatttgatttcataatatatactaagatttttagaaatttctaaggttgtttggatagcatgtaaatgttgtggatatttgaactattgagataaatgttagtgcttattattttacatgtaagaacatatagttggatccatgcaactacaaatataatattttagataaataccactactatttacaatatcggctatgtgctactggaatttggggaaattagaccagtgccactccatcacgttttccgtaaaaaatctctgttaccctcaactgcacgtgggacctaactgtcagttccaacttcacctccctcccctctcttctctttccccttcctctctctccaccaccgtcgttgacaaccaccgttgcagccgccatcatcgaccacctccgtggtgggaggcctcgagagccactaccgttgccactgttgtcttcgaccccatccatggtgggagggctcgggagccgccgccaccatcctcgacgccaaccgcggcgggaggcaagggagccgccatcctcaaccccatctgcgcgggagggctcggaagctgttgccaccgccatcatcgtcgttatcctcatagcagtagcggggatggaggaagagatggggaagaaagaagagggaggataggggaagatggaactcatatatgggtcccacgtctgggggtctgacggaaaacatgatggaattgcacagtgtcagtttcttcaaattttagtggcacgtagccaatatcataaatagtagtgacatttatctagccacatttatagtgacatgatccatttaaccctaataaatatatgggtttaaactattgatttaattgtaaagctagactacaaccattcaaattaagtctagcaaaggaaaaatagagccaagtgccctagctagattactaaacattttctatcatcaatcagaccatcaacctgcttagggcctctaaatataggcttatgcttatcggtttcgatttttaagttagatttttagcttatatgccggtggagtcatacatctgtcttacataagccaattttttttccaacctagtttttttatttaatagtagtatataaagagtggcttatggctttaaaaaaaccaaaaaattgcttgtttgtttatgagtggcttatttttctcttctaattcgaagatcttttatagatttttggtgtgcatatgtatgcatatagatcatccataactgtgtggctatctagctagcataaaaatctatgcgtgattgcttggacagagttgggtacgtacgggacgcaggcagcggtatgtactgacatacgtacagggatgaaaatgaccgagggtaatcgttcgatgatattttaaaaaattataactcatgagacataccaccacgataatatccatagcatcattttattatttatattttgacaaatatgtatatccatagcatcattttattatttatattttgacaaatatgtatagtcaaataattctaaaaatataaaaatactttgagaattttaatctcaaacaaattataatttaatcataactacttgaaaaacacaactaaattgtgttgaaattattattttccaataatagatccaatctaatggtgtaaaataatgggttttaaagattgatcagatggttgataatagtgggcctaccgatttaaatgaaaatcaatggttagattttttaattgccacgtggcaatttgagagcgttttaaggagtgccatgtggtggcttgagaatgtttctaaaaagtttaatagatttttagtatataatagatagatagatagatacccttgtgcaacatgtccttcaaatgatgctacatccctcaagatcctgcatttatagtaggttgaatcaatagcatatggaaaaaagaaaaagggcactgctggcatacatgtaggattgcacaattctgtatgtttcagttatcagagaagttgatccttaagcttgttcgatttggagggaactgaagggagattgaggaagataattccacaccacaatagttatggaataaaatcctctctaatccctctccttggggattaactgaacatggcttaaatagaaaagataatgacatacaaagcaatgggattgaagaatggcacccacaactgagtttgagatatccaattatttatccaccattagttcctacagtagcattttaatggcgcctactagcagggggaaaatctggcctattccagccaaaatcaactggaatattgcttatcaagtactccaagcttttagcagagggaagtccaccttggtatattttaacatatatttggttattgaacatttagaacatgcacaatatttgtgcaaaaagattataagaaacttttggactttcagtttggttcatctcacatttttcttttgcaagtacacattctcatgttcctttttggcagtaatgtttgtaaatccacatattatacatatgggagtttttcaagaactaggaaggtagcccgcgcgttcgcgcgggcatgagtcgtacgccaagtttgaggtatttataaaagcgacatattaacaggagaacatctgccacgatttctccataaattatttttgtcagcattaatttattctttaataatattttaacctattagatttatattatatcaaatataagtagtatctataagtaattatttataatattcttcatcattttaaaaaaaaggtagatttattttctttagaaaacatgtcaacgaaagtaaaagtaagtgtaaaataaaaattaaggtgtttttatttttttaattgtataatatattatcataatatgttaaaggatgaattgggtgggacattaagctacacgaaaaatgtacgggtttatatagtctaatatgattgatatattttgagaggcgatctacctatgaacatttcatgtagagtgaatgagaggctccacgcaacctagcaggaatacaataacgtcgaaatatcattgcactgtaatatttttggaatttcatgtaccataaataaatacttgttaaaaggtataggagcgcacacatgcatgttatgcagtgagccagacagagattctgatagactttgtttttttcccaaaagatagatatgatgttataaaaattggatccatcggtttaaagtggaaaccgatggtcgattatatgagtgttttttaattaatagaatgccacatagcgacttagaagtgtttataggagtgctaggagcaatcatatgtatgatttagatgctatgatcattttaagatcatttatttatcttttaaatttaaaatatcatttatttacaaaagcatcaagatcaattcgtttatgtaaatagcccccacgtgtatgttgtgagaaattaataaagtttttttatgaagaaattaattaagttggtagaaagtcattagatgtctaacaatgtacttttaatgggttagtttcattaaaaaataagctagcatattttgattttcaatgacaaattttaatattttcttttatttagtggagcactcaagatggatgtaggtctagaatgcaataaattcaatatagatattaaaattatatatttatttgaaaaataaaaatagatatataatttatggtacaaataattgtaaagactcgtaaaattaatccggcctttattaaaaagtctaaaatagcacgtttaagtataaattagttaatatatttctttgttagtttaatgcgtacagaatgtaacgggtataacctttataaactttatttaaatagtgtatgatttgaaaataatgctcaccataaagggttcacgtatacctttatttaatgggtaaaaatatagtggtgtaaactttattttggaaagaaatatatcataatataatcatataagttatgattatataaaatttaactatattaactgttatctcgattatatatatatgaaaagaaaaaggagggaaggagatggaaccgtacgtacgtacgtacggatggtgtggaattgtacgttttaagatcaatctagttaatctgacggtatgtactagtggacccactattttaagtaaaaatcaatggatagatgcttttcttttttctcagaatttctttgatttctctaatttattagagcaccaagtggcggcttaggagcgtttgtaggaagattaatggacttttagtatataatagaaatagatattttgaaatgaacaattgaataatcaggaaaaagccgagaatgaaaaccacttccttctacatcatcaccaacaatttctgaatcatgttaacattcatagctacagattatgtgaacatcacccaagtgaactctttacaaaaacatatgaaccttattatagtgagtttagtaaagcactcataacaggcataggtagttcctatacgtactaatgaatcacccataaaaagcataggcagtttgtatacgtacgtacataccaagcacaccggaaaaccaaacacgtagtttggacgttatggtctcgggctaatacagcgcatattgcaatagtatagtgnnnnnnnnnnnnnnnnnnnnnnnnnnnnnnnnnnnnnnnnnnnnnnnnnnnnnn

SEQ ID NO: 18603 - DNA, 167 bp, Oryza sativa
tgcatttatgaaagtatttactatcacactggtggagaaaccctttgtagtcccggttcgtaacccccctttagtcccggtttccaaaccgggagtaccaatccgggactaaagatcgctatctttagtcccgggtgaaataacccggagtaaagatcgatctttag

SEQ ID NO: 18604 - DNA, 10244 bp, Oryza sativa
  unsure (1)..(10244): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattcatatctatgaatcggcctgaatacctccaggatgtcgacgttgtatctgcacgttttcaggcaagttataattttaacatgctaggaagctaggcatgtccatatgtgtacctccttttcttgaccgctgttcatgccatgatgtatcttctgattctgcagaggagagatgtttatggagcttgggaacaataccttggcttggaacatactgacacaacaccaaaaaggtcttatacagccaatcaggtaatcagtgttggctaataatggtttttgcgtacaattcaaaactggcaagaaataatctgagtgtttaagatttaagagtgtaaatatctgtttatttttatatctaagcacatgcaaacccattttacgaatgtgagcacacaatgttcgtatttctattctaaacaatctgctgtcaatccggttaacctgatgccgaacaaaataagcgtgcagtttgtttaactaaatgtccaagagattaatgggctgtttgctgctttgcttctagtgaagtgagcaaatcagcagcctcgcaggtctcttgccttgctatattcagattacactgaaaaatatatttgctaaactgatttgtaaaagctgatatgcaccactgctatacaaaacaaatgaagattatttacacagatatgatttgcatgatctttgcaaatgaataagatttgaaatgtagaaaaatgttacacctgctatgtttttccaatttctaaaatgaaggctaactgtccaattggatgtgggttgttggtctatacgtgcacgtacatactcaattcagcatccaatctatatatcctatatagttggaaccaaaaatctctacatgcattgagccacatcacctagaaaatatttgccattggatctttcatgcgtttaatctcaaccatccttcatgtattcagttacatttcttttatttattgatggtcattacttctatgcattcatatagatgacacttattttcctcctgcctttattttcaaatgcaatatttctgcagctcaatgtaatatttttctgctcaatagttcatactaaatctgtatatccaaaattgttctactatacctgcaacaacatgtggggtatcatctactccctctgtcccaaaatataagacctagaaccggatgggacatttcctagtactacgaatctggacaggtactaggaaatgtcccatccattcctaggttcttttattttgggatggagggagtagttagtttgatggatatcccgttcgatagaatcaccactgcacgtgactacatgagaatcttgcctatagtcacgtgcagtgttgaaaaaaaagtaaagggagaaatgagtatgtttacttttttcattttgttttgtaacagtgttgcatgtgcttagattaagaaaaaattcgggtgtaaacgtactcatttctccctttacttttttttttcaagaaatcattactggttattttgggctaatatttttgttgcattgaatgcaatgtgtgcatgtgtaaaagtaagctgggttgattaatggtgtttcgaaattatctgtattattatagcagtgttttccatgtaattgttctttactctggttattcaaactatgcagaatcgtcacacttttgagaagcctgtgaaaatttataattgagaagatttatagctgggcttgaagccctgaacaaaggcctcgtctggatagcatgccatgccaaagagagatcacaaagtaagacaacctcaacagaagaaacatggcaacaaaacatatggccattacgctgaggcctatattgcttcccgctggttgacgccgttggtgcagcttactcgtgatgtagtgggcgtcagggattttttttcaaggctttccatcttgtttccgggcaaaacaattgtgtcgagtgtgatggccccgctaggataaggtagatgttgctttatttgtgtagagcaaagctggtacataagaaaaagattttggtaggggcatgtatacagaattatagccgtgactgattgctttatttgcttctcccgtttctgttagccttggagcagtgggagaatcgtataatggggtttggtgttggttccaattttccatgtctattgataaaatgtaagagaataatttgccagatagtgcagctttcagttcctgttagcataaccttgtgtcggtgctgttctattcgttgtgatttgacaacccatgaagatcagtttacagtctgtcatttgcttgtaaaattacgtggaacccttgttttaatccaatatctttgcttgtcatcgcttgtgcaaacgggaataatttccattattggttccatcctctgatgcatcgtttggcttgctctttacatgctgttctagaaagtactataagcttgttaactgggaaaactaatatgatctccttggagaaaggattggatatgatcatgtgagcgcaagtagtagctggtcactttcgcagaaaaatgtaaacttggggaagaatatgtgacccaaagtgcaatttaggagccaaagaagcaacaaccagccgaagttttagaaagcccaagcgttcaacaaaatagggattaatatatgaggaggctatctactctttccgacccacagcaaagtacagttttgcactgtttatatttaacgtttaaccattcatcttatttgaaaattttttataattagtattcttattttttattagatgataaaacattaataatactttatgtgtgactattttttttattttttataaatgttttaaataagacggacggacaaacgttggacacggatccccacaactgtacttattttaggacagagatagtatctgttttgttgaataggcatatgctcatgctcctgtagtacttgtagtactctgttgatcccaaaatatattaattaggttcaatacaatcaatcttcgggggggtgactagttggtgcatatgcgccatttacggaactcgcgcatggtgatgtgggtccacttttttcttaggcgtctttctgttctgcatcggaaaaaaaaatctccttttctttacggggaaagatcctcccacgcgtgtttttttttcttctttttttgtgttgactgaaaaaaaaataactcagatttgaaactttttaaatcaacttacattcaaaaactttcaagtccagatttgaaagtttaaacttatatttgaaactttcaacttcgatttgaaaattttcaactcagatttaaaagctttaatctcatatttgaaaactttcaagtccagatttgaaactttaaatatagatttttgaaaacctttagctcggatttggaaattttcaaatcaaaatttgaaactttcaactcgacttcgaaaacttttaactccgaatcaaaattaaatctttagttgaaacttttcaaatctgagtttatagttttcaaatctttacttggaacttttcaaatctgagtgaagtttacaaaaattgagtcaaaagtatttgaaatttgagttgaaagttttaaataatttgatttgaaagtttcaaatattaaggttaaagttttcaaattttgagttgaaagttttacattttttagtgaattctaaatgaaagttttacattttttggtgaactataatttttttaggaagttttagattttatttgaaagttaagaaaattacgtatagattttcaattttttaagtaaagaaagaaaaaaaatcccaccaataaaaaaagaaatgttatcttaatttagtctgtaattattgaaaactacttaattaaactaatcatgaccttatctaatccctttgtaaccacacacgtatggttggccagagacgtgtatgcgggcgtgggctaaaacacacgatctttgttgccggtgtgtacgcactaattagtaatcgcgctatcttctaatactaatataaatccaaataggagattgatttggagcgttgtgtgagacgttaagattaagtggtggggggagctttctcgttttaggggaatttcatgggaaaccatttcatgtgaaaatcatgtaaaatatgaatagcacgacaacgactacatgtaacacaaaacatgagaacgttgctatcttgggattaaatatctatcacaaacatcctaccaataaatcgaccacaacaactacgaaggcgaacagtaacgaagggtaatctcgggcttcatcccccagtccacccgtcaaaaatatatttatacaattataccattctaaaaagggaatttgtaaaaatcacctcataagttacttgattgacatttcacgtcataagttattttcttgcacgtaccattcctactcaattttgttgtaaaaactacccagtacgcacgtttttataagcacattatcgctgacggataagccaatcctgtccaagttagttgagataacaaaattgttttatctactgaaaaactactacacacccaaatggaaacagaagcatcacaatcacatgaaacctcagccttccattatgacagtgacctgtctgtctctgtccaaaagcttcatacatgagcaaaggaacatcaaactgaaaaagtaagagcttaattataggactcctccagtcccagccttagggactgaccgagataaactctatttctacatccactaatttcatcatctccccgtactgacgcagttgcaaattttgcttaatttcttttgaaggtttcagttggacagagctgcaaggaagaggaaaggacataattttgcctgcatagtatgcatgcctgacaatattatgatctattcctcctttgacaaggactaaggtaccccctagttactactaaaatcagatcattgctgctgcctcccactgtctcaagcatggtttgttaacctctggacatggaggctctgatcgatcagaagttggtgttcatcatcagaccttgatctcttcctcggcggatttcgggcggtctgatttcttgctggacattatactgttgaagttttctgatttacaaagaagaatctcaatctgagataagaaaaacagacagagataaattgttagttgtcaatatggattcaggtagaagttaagaagaatggtgagttcagacagaaagggaaaatgaactgttgacgccaagaaatcttcatctcaccttggctttacggacaagccgccccttcgattcatccttggtgccaatggttgatgtcaggatctctgaacagggaagttggaagaagagaataagtttacctcactattttgataagtcgtactgaatttttgtttcaataagaaagaaagcttgcgcatagatttgatttttgtagacaagtagtaattagcagaatagaaaagatgcttactcttttcagtggccaggccattgttcttgaggatctcagcaacagtcaccaccgtgccaattgctgcaatagaagatacctcagaaagattcaggtaaatatgaaatgacttagtaattaaaaataaggatgtgcgaaaaatgcatattacttcagattttattatagagtgtctgaatacatatatgcatcagatgatttgaaggaaacttaagaacaagtattaagtttctatggatgcattacccattcccagtgcagagagctcaacttcgtcatagttctgcatgtacctctgcatccagtatccatatgggtttagagatgtcagataaataattttctaaacaaaaagatgtgttatgtgtacaaattcaaagaactgattaaaccttagagatcatatataggtgctcaatatttttcccagttctcaacaataggacactgaaaattgaaacttttttaatgcaattcattcataattctcccagttctcaatattcttgttgaattaaagattttacattaggaacggggccagataaataacatagcaaaggcatggcaatttcggagcaagatagaacaccaaaacagtcaataaaactcggataaaataaaattggataccccctatttccatttctctcataaagaacatttccttgtttcccatatggccatataggagtatcattttgtcattgcattggtagaggcggcaaattcataagaaggttttttgttttgatttaaatttgttcgactgcttccacaaaatttcactcacagtttccaatcgattcttccctaacaaaaataaaaataaaatcgaagctgcaatcacaaaatatatatataccttggcgaggttgacgtagaagtagagtggcttcttgttggtggagacctggatccggttcttcttcgccgacgccccggcctccgcctcctcctcgtcgtgctctgcctccgccatctcctccccgaccatcgccacctccttctcctccggcccctcctcctcttctgccaccgcccccgccctcaccacctcctccaccacctgctcctcctcctccctcaccgcttgcatcgtgtcgctctcgctcgccgccttcctatctggattgagagagagagagagaggggaaggatcgatcggagaggagaggagagggagagaggctgcgagtggaggccacgtacgggcggtggtgtagaagtagggagttacgtggttgtccggaggcagcggtggttatttcgagcgcgctctcctccatcgatctcctccctccccgccgcgcgtctctccgcatcgtaggcgtcaacttctcgggccgggtttcattactcgtacgtatagggcgtgtttggttgtccggaccacacctggcttgcacctagccagtagatttgcgattgtttggttgcatgggcttgtctcatagcaagatccggtggatgaaaaaggcccgcggagccaggctgagcggaaacgctagaatcgaccttcgcttgcacccgcgcgtgcagaacccatggatggggtcaccaccatccctcctctcctcctcctcatttgttccaaaccagtggaaagctagggttccgccgactcgcgactggagggcgctgctcgtcgcgccgtcctcgccggcgggagggccggtcgtccgtcagcatcctctctttcgttggtcatcctccctctctttcgctcgccgccatcgctttcttccactggttcactctctccgtcaagccgtttggtctctgctacgcccctctctttcgtcgactctctccgttgagctctctggtaagggctaggttgggcatctccttccctttctcagccgatttgtttggattagaccgtgtccccttcataaatatgctagatctactaaaagctgatatctttcttagttgatttcgatggaatgaaatgtctagtggcttgcttttttgttctaagatggccaatgatgactaatgttgctgatttgtgatgcttatgaacagatttttcctacacatattcctattttcctgttgatttgtgttatgccattgtatctttgcctacaaatacaagttactggtaaggcaagatacaatagtgcgttcttttaaattgatactgacagatacacacttgattaatagtgcttattagtgatgcataagaacagatatgcctgcacttgaccttattcgataaagtcaggccaccaaacatgccctttctaagtttctgtctttctgtgatctttctcagtattttatagttcaaatgatcttatcagaactgaggccacctctacacttgaattgtgcagaatttataagagtacatgaacagatttttctacacttgttcttttttcttgctgttaggctgggaaagatggccaatgatgatatatgctgctgttgtgatgcatgtgaatagatttttgctctacacttgttctcattttctcgcggtttcttttttcctacatttcgtcttattttccttttccttataccttttcttttgctacatttgatagatactggtaagaacagataccaatgatagtagctaattcacattcttcatatatctgaggccattgttctgcatttatttacctgctggaaatgaggctcaatgatgtcaaatttctgcacatatttgctacattttcgagttattgatgtcaggcaaatactatcaagttccttgttcatcttttgatatcaacagatgtactcattttttttggtaaccacacttgattttgacatgatcaagtttttatatgaaaccgatacactctgcacttgctcctttggtaaagataatactactattaagtgttgatgctcttgcgacctgatctctgcaactcagatcctgtactgtttcaaaggtacaggttatcctgtttacttttactatgtttcaagaaaatgtgataatggaaaaacttgtgagatcaagtgtagatatactaaggttgataagtttgaagcaatctgtacaaaagcttgcaagcagaacatggttgatgagtttgaagcaatctgtacaaaagcttgcaagcagaacatagctgaaacagatggtttagttttgtatgcggttactaatttgtttatcaaattggttacttgtaaaaaacttgccatgagcacgtatatttgtatgtttgttttgaattgtcaaatgtaccagtgtcgtcaataaaattatgtacatgatttttgctagaataatcactcttgcgtgttcatccaggccatttcgttacatttgttaaaaaaaatgatcatcagtgctgctcattggttaggaatgagcttaggaatattagtaggtgggcacacacccagagtaacataatttaatctataacctctacgacgaattaaacttatcacacataaatagattagggacttggaaaaaagatcttgtttcacaaactttatggggtaatctcaccacccacaataataggtatttacacacaagatatctatccaaccaaacaacatcttctgtatgctaccattccatccgccccatgctgcaaccaaccaaacaacatctcatcatatccaggttcatctcatccaagcaaccaaacgtctgcatgtgtatcccctaaaccaggctaaaacttagcctggatgagggagatgagccagactagagggatacgagaaccaaacacacccatagttggccaaacggccctgacggcccggcctatggtaaggggttttggtccggtccaagcatggcacggtccggctggtgtcgggtccgtgcagaataagttcatttgaggtcccttaactttacaccgaatccaattttcgtccttgaactccgaaaccagacacaattggtccctgaactgtcaaaactagtgcaaatgaggccactcggcggtttggaaggtggttttggctgacgtggcgtttacgtggctgatttgactaggtcttcgtcctacgtggcattgacgtgataattctatcccggaaaaataataaaaactgtggacccacatgtcagttacacaaaaaataataatttaaaaatggtggggcacacatgtcatcctcactcctttcttcatccctctcccttctctctcttcttcctcatcctcactattctcttcttccctctctctctctctcttctcagggagcgcggagcggacgggcaggtgggcggcggagcaggcgagcgaggcgggctgtccgagctccggcggtggcggctcggcgtgcaccgtgacggggatccccaagatggtggacaacggtgccagcgacgagagtctcgatcgtgggagaggaggcgctgcggtggccagagccggggtggtgggcgccgcagcgggggccggggtggcgggggtggtcggtgtggcggcaggcacgagcgtcttgttgtaggagaccggtggcgtggtggtcggcgccgctgtggggtcctgcaccaaccgcatcctcgccctcagtactgccgccaccgcc

SEQ ID NO: 18605 - DNA, 9321 bp, Oryza sativa
tgcaccggttttgatagttgagggacccgttgtatctggttttctggttgaaggatgaaaatcagattctttgacaagttaagggacctcagatgaacttattccggtccgtgctagcctagcctgacctttgggtcatgtctgggcctttgcctcggcccgacgggccggcccgacacatgaaggcaaaacagatgagcgagccaaaatagacttattccaatcatataaagaacaacccaaagagatgagggatgcaaaataggcttattctagctgtataagtggcggcccaaagaaatgagggggcaaaatggactttttccaaggaagagcactgtgagcttttgagacttcgggccgacccggcatggcctgaatcttattggattgtgcctggaccgttgatgcaacaagtgggcgggctgtgccggcccgactgatctcttgcccaggcccgatcatgcctggccgggcagcccgtttggcatctatactcgtatgtagggttggtggtaatgggctcatcttttttgggtctactatacacaacttaagttatggctcctagaattgcaaggaccctgtgtagaagcacatgccagactttcttagagaggggctaacgatttagtacgacagcttcattttgctaatcgccctcttgattcatatacaaaattcctaggaatcgattggatccaactgcttttattttgttgttggaatccgtaaaggaatagtgccttcattgaaacctaggtagttaaattcagtgtagagaaatcaagatgcatattacctactcccttcgtcccaaaaaaaatcccattcctagcatatcaagatggagatagtgaagagtgagaatgactaaaatgctcttaatggttaaaaaaaataataaaagtgatatgtaggtaaatgctgagggtaggtagaatgatataagttgattttttgtgggacaaaatttaaactttagaaattgagtttttttttggatgaaagaggtaagtggaagtcacgtatcatcaagatagacgactagcttgacatctcgatggattgcatggaggaagcagagcaacaaagttgatatgatcccttagcactcaaggcgacggtaaaaacatggaaaaaaaagagataagaggagggtgggcagtttattgtctactccaaaaagagcaactgttagacaagcggccattttttaatgcgaaggtggaatgggatctaggcggccaagcatctgttaggagtttcattttcacaaacagccacaactctataaggacatccacaatgtgagccacctcttgaggacactcgtagggaaactcagctcgcaatggtggacacctctggatgggttcctcaaaatctaaagcaactggatgaaggtactcaaccctacaatgggtgttccaaaacaaaaacccacagtgggtgttttcctatcctaaccctctcttcttcccccattctctctccttttttttctccgcctctttctcctcctcttctttttcttcactccctccaccgggtttcactccctccgctcggtggcgtcgccgtcctcgatccccctccctctccctctctttaccgcgagcgccgacgccacctaccttctcgccctccccagccgccgccgctttatcctctctctctcgccctcttgttgccgccgctctctctctcatttttttgccgccgcctctcttactcgccatcgccgccggcggctggagggggcaaatccggcaccgtcatgggcggatctggcccccctgcggccagatcgggcaggagaccgtggcatgccggcggtggcgggcgcggtgtgggcaaaagaggccgaggcgcaggtggagtcgtcgccgggtcattgtcgtcgtctccatcatggaagccgagcccgtcgttggctggtggccaccggccgccgcggcgcgaggaagccgtctcctcctgtcgccggctggtggccgacggctaccgcggcggattctcgtcgttgtcgcctctctctcctttctctctctctctctctctatctctcatcgccatgccatcggtgaggggcaaaaaggggaacaccaggggaggaggcaggggacggggcaccgggtcgccgcaatacgtagcctcgagggagtatctccggaaaaagcgagctgaggagctagaggcgcgtgttccccgcgtgggggtcgcgcctctctccagggacacgccgcgcggacggacggcggacggcgtgagcgggggacgacccaggggcacccattgtggatggcctaaggttcgatcaggaggaggcataattatgactcgtgtcctgccaccatgggccgatggcctgtatcctcctctccctccaatataacataaaaacaaaaccctgcgtcgggaacatgtgatgcccccttgtacattcccaccagtctccacatgttaagtcattagattcatgcttgacaccaccatagttccatacctggaactggcgttctggacaacatggtcattccctgttaaaactgatcacatcattgagttcacaactctcggaaacacatttttgaataagatgttctcattgatcattccacatagcatgacatccatctcctcttatctagggatgcaagcggaccgacctgcaaacccgcttataggtgtaattagtgggtaacccgcatattaactcacagttacttactaattcgatctataaatgggtttatgtattgatccatttgcatttctagatatggtaagctaggccacgatgtgaaaactcatgagttaccagttaaatatataagtagattcacgggtcggcccacatgcatccctactcttatcccactatttggattcttaagatttttgcttgttgtactttacgtgctcgcgatggacgaattaaggccgcgttcgtcagaagtgatgtggatagcttttggagcgcaatctggtgtcgtctggtgtttgaaaatccaaaacccccaacaggtcaccttatcgcttggaattttcggattttgtaaaaaaaatttgaatttgatcaaagtttattcaaatacaatcaaaatttattataatttctcgaaatctcaaaatttcgtaaatttcagtgccaccgaaattttggccgaaattcgaaagcgcagcccgtccccctactggtgtgagggagcgggacacggacacgctaatccgatccggtgtcgtgcggtatctggagacgtacgtacggggtacggattggtgtattctgtactccgaatacatcagaaacgattcgaatctactagtacggacgcggtacggattcgtgtattccgtattcgaatctaggagtagtacagtaactagcaccaccactaccacgcgtataaatacaggccacgtacgcccgtgtctaaaccgcttgccgaaaaatcccgcgagacaaatcgaggcgacgcgcgcgttcgagagctcgttcccgcgacatcgatggcgtcgagcagcagcagcagcagcgacgatctcgccgcgagcaccatcgacctcgcgctcgaggagaagatcgccgccaacgcgctcggcggcggcaatggcggcgcggaagaggaagcggcggcgtgggagatcgacctgtcgaagctgagcatccgctccgtcgtggcgcaggggtaccacggcacgctgttccgggcggactacggcggccacgacgtcgccgtgaaggtgctcgactggagggaggacggctactcgacgccggagcagatcgcccacctgcgcgcgtcgctcgccgacctcgccgccgtctggcactcgttcgagcaccccaacgtggcgcgcttcttcggcgcgtccatgggcaccaccgacctcaacatcccggccgccgcctccgccgccggtggcggcgagcagcgcaacaccggcgagaagccgccggcggacagggcgtgctgcgtggtggtcgagttcctcggcggcgggacgctcaagaagtacctgatcgaacactaccggagcaagctcccctacggcgaggtcgtccgcctcgcgctgtccatggcgcgcggcctcagcttcctccacgccaacaatatcgtccaccgcgacgtcaagacggagaacatgctcttcctcggcggcggcggcggcggcgacctcaagatcgccgacttcggcgtggcccgcgtggaggcgcgcgacccgagggagatgaccggcgcgacgggcacggtggggtacatggcgccggaggtgctcgtcgggaagccgtacaaccgcaagtgcgacgtgtacagcttcggcatctgcctgtgggagacgtactgctgcgagatgcccttcacgttcgggctcagcgtcgcggaggcgtcggcggcggtggcgcagcgggggatgcggccgccgatcccgccgtgctgcccgcccgccatggcgcgcgtcatggcgaggtgctgggacgccgacccggcggcgcggccggagatggaggaggtggtgcggatgctggaggcgctcgacacgagcaatggcggcgggatggtggcgccggggaagatgaagaagaagaagaagacgacgaagaagaagaagaacgaggaggagaagatgccagggtgcttctgcttcttcggtcgctcgtagatttgtttttcacctgcattggcagccttttctttttcaagtcgtgtctactgactactactaataagttgtaagtaatgagcagttgtaataagttgtacttcttgtcttagtttatagtgttagctactagacgtctgtttcatgttattgttataagctattttaattttctttctaactaaattttaagtttaatcaagtatatataaatatataataatatttttaatacaccgtcttgatgcccagcttctccatagtaccaacttgtcgatatcagctctcttttaagcccatcgtcctttggatttgatggccaccgatgctcttgaaagagagttgacatcgacatgtgggtactgcacaacacccttccctaactcctctcacaacccacgcataacgcatcacacggtcgattgattgttcctcctaaaatctaggaagcgtcctgttgtttcatatctataatctatatcatacatatgtaatgatcatgtaatgtttgtactcgtataaagtctctataatccacgcgtaacctagccctacctatatccagtcggatgaggcgcgccaaacgccacatacgtgtgtcaggaacgaaaggaacataggaagcggagtcatggctatcgcgtcgtgcagatgccgcaagggaaaaaaatggagtaacgatgagaaaaattaccaattttttaagtagtgacgatataaagctaggtcgatcttggccgttccatggtataaaaattaattggattccacctatataaaattcaaataagccaaaacctttaatattgatggtggagtactttgcaattcaaatttgtgattaaagccttagatttaggggctgtttggaggggattaaaaatttttagttcttgtcacatcggatatttgaacactaattagaaatattaagtgtagactaattcgcgagacgaatctattgagcacaattaattcatgattagcctatgtgatgctacaacaaatatgtgcttattatggattaattaggcttaaaaatatgtcacacgaattagctcttatttatataattagttttgtaaatagtctatattttatactctaaattaatgtccaaacatctgatgtgtcaggaactaaagtttagtccctggatctaaacaccaccttagtgtccccataaaggatttggaataagttcactttgacccccttaactagtggtcgaatctgtttcgtatccctcaatacttgatatttcgacaccccaattattaaaaccggtgcaatttgactctctcggtggctttggagggtagtttcactgacggcatatgtggtggtgttgacctagcattagagatgacaatggggacccacgacctgacacccgacgggtttttactatattaggagctaatcatgttataattcttatacccatgggtctgctgacgggcgaaaacttttacccattaggtacgtgggtatggatccgttctttacccacccgtacccatcaatccgtgggtgaaaaaaacccatagattgagcctaaaactatgagaaatataagtcctgacgactactaaatcatagtataaaactccttttcacatcttaagcgttgttctagtctagttatatgaaattattatttgatttttttatgatgtaattatgtaatgtggttgtataattttttactcgtctttaaacactaatgttaatagcattgttgctagataaaatattgatggttacagttttaatatggctaattagaatacaaaagaaatgctacaagtcaattgtatgggtatgggtacccgttacccgcacaggtgtttgtatggggatgattttgtacccgcgacgggtgtgggtatttaagtaggaatatttagtcatcgcgggtgttgttatggggcaagggaacccgatgggtatgcacccgttgccatctctacctggcattcatttcacgtggcattaacgtgggatctacatgtaaagttcccattcatctgtcccatttcctttgcttcctctgctcccgcacgccaagagcatcgctgtccgtccctcgcgcgcccgctcacgctctctcgtccacgaccccccctggggcccgcgaccacacctctgccatggaggcggcggctgccaccgccaccaccttctcccatctgcgtgttccttaccggcggcctgctcttacccggaggtcggagatggacaagctaaacagggtgttcaaacacggtaggcatgcgacatgaagttgtggccaagctttacttgtctgccgcctgctgagtccgtggtctgccaccgtgccagtccaccgtcaccgtggggttcgacgtgctaagcgggctgctcgcctgccagccaaacaggccgctcaccacggtggacgtgctctggtgcgcgcggttcacggaagctgacatgccgcccacccgtacccctattccaaacccactagcaacattgctggccggccctccaacagccgcctcccacgccgctgccatcgccggccatggctgctattcctcttcctcgtcttcacaccacctccaccctcccttccctagtccggctcgccaccaccaccctcccccggtctggctcaccaccggtgtcctccctaggtccggtcatcgctcgagagggggaggggcgtcgaaggtgtttcgcaacgcggttgacgaggaggtgtgtcggaggtgtctcgcgacatggttggtggcggttggtggggaggggcgtcagcagagtctatctggagtaggttggccgagaggggcgccggcggcgttgcgcgcgaaggtggggcgtcagtttcgatggcggcgcacgctgaggttggcatgagagggaaggtgcagctatgacgggaaagggaaggagcggaacgacgacgcttagggttatgcgacgggtggcgttgcgtgcgagaggaagaggagaggagtcgtgcgtggcagcattgggtaggggtgggcgcggaatcaacgacgccgttcgaggtagggttccagctgttgggatacgcgtaggctacgatagcataaatcaaaattttctatcatgtaaaccaggaaccatgcaagtattagatcatagatcgttaccactcgacgcgctgtgcagcggaagaagacgctgagaagcgaaggaactctcgtgaagcagcgcgcgtcgatgtaggggaagtagtagatcgcaccggctcgaccttctcttcctcgtgcgttctcctcgtcgtactcccacgccaatcagcatcgcaaaccagtggcgcctctaccggtatccacacgtacagggacggaacgccacacgcagatgtgctagcacccgcgtgcgactagggttttgctcggggagggaagtgacggctagggtttctcacgtgatgcaatgcctccgccggtcacacccctcatgaatatataggatccatcactcgggcctccaaggcccgtaggactcctattcagatctctatccgaattaagctcatattggatctccatccaatcccctttattccggcccattaagcgtgcgaccctgtaggttcatatatactcggctgtaacccgaaaactccttttcggtccacgcgtcaacagcagtccctagcagaatgtattgacccaccgggcatacataaagatcatatcggctgaacctctagtgtatacttgtatgaacccctttgcctcacgatatcaattaagcttaaggctagatatgtgccatcttctaatagctcaatcattcactgaacctgttgatagattatataacttgtgattgactcctcaatcacctttggcatggccatgcacttccataatctacaacatcgaggggcctagagatatctctccataggaggggtaaatcccatcttgattatttatatcacactacatgtttcatagcatatctgaaaactacttttatagctacccatttacggagtagcgtttaatagtccttaagtaagctactacacatgttgagaaccatgataatctcaggtctaaggattcaacaccaacactaaatgagatcactgatgacacatgtccttaataatatggctcttgtagtgtctcatgttgggtctatccaacaacatgttcaccaacatgtgtccacattattaatttggtatctctataccatgatccatgagacatgatcatcaattagtacatgtgctgataatataaacaaacatatttgttccacatatgatatttgatcagggatcctttagaaatagtaacaaacaacataaagagtctcatgaaagaatcacatattcattaaacaataaggagttatctatttcaaggaacaatatcggataaatatgtaaacatagtatgtgatacaatcatctctatgattgcttctagggcatatcactaacaccaacaacaacgccacctggatcccccgcctcctgccagtcgccggctcgccgctgctctgtcccttgcccgcatgccgctgtcgccgcttggtgccgccactaccaagccggcctaggtgaagagaaatggggagagagagggagggggaaagaagggaaggagagatgatgatttgggcctaggg

SEQ ID NO: 18606 - DNA, 16660 bp, Oryza sativa
gggccagtccgtgccgattagtactttgcgcaagggaagatctgggcccacaaattgaagattcggtgggcctaactgcttcggcccacttatcatgggccgatttaattgatgagaacacgtcgagcgcccaacggcccaagacgcgacgcgacgcgacgccgtggcctcgccggcggcgtcagctcgtcggtgtcgccgccgcttgctgttggccggcaatggcgcggaggcgccccaagagcacgcgcgtacgggcttcctcaccgcgggtggtgcctggctcgtcccatccgtcgcacctcccccctggtgttcacagttctcaccgctgccacagttctcgccgtcgccggcaggcacaccaaaggccgtagcgcgggcacggcggccggccaccgtgcaggtgatcttcgctctccctagcttgaatcgaaaaatttggggagcataccactcacggaccgcccccaatcaccttctcactgtaggtcgcgatacagtttcccatccgattggggatggggtgctgtgtgtgtaatttagttgatttcatatgtgaatcgaccaaatgacatcaccactggagtgcggattttgtgccggattcctgcgtttcagtgccatatgggagcacgagcatgagcatgggactccggatgtgcatccgagaaattgcacacaagacacagatgcatatgcagtgttgattactgcttctgcttgcgtgttcaggtggttggtagatcagacaacactacttcgaatatggtttttcatcctttctagggctgcaatattgtagtactaattgtcttgcaaagcattgtgtatgtatgcaatcagcgattgtaccacctttcttgctttttgttttttcttaaaaatggttatgctttacatggacagacagtgagttgcttggctcctttgcctctcggggttgcggaggcatttatgaattgggcacaatattacttattcaggggaaggggggaacaaacgattcatacaaatcctcttttgacagtatgggatttctcgctcaaatctagaagaacaagaacaacaaggagaaaaatagaatatggatatttatgttcttttatctgcaacttcctggcatttttcatgtgtattttgaagcctgaacaagtgtgcttcacacttcacaaataggtgcttcctcttgatatgttcccgtttgatttgttatgtcaatatatgacggattctcttctaactatttccatgcatagatcaggtgagtacacaaagtgcgtagaactagctgctgttctctgcaatttgaccattggagtttcactctagtagtatgtatactaggtaagcttatgctaatggtgcaataatgaacattctgtatataaaaaacttacaaccttgtcatggtcccaaattatcttctgttccaagatcttatattgctcaattttccctatgatcttaactcaagtcagcaagaaatacattaagcatgagctggggtgctgctgtcatggagcttgtgactggagccaatgcatggagtgaaaactttacctgtgttactttagttgtttcatctgcattctctgatggataaggtcagttgggaattcttcaaacttcaagcgtttggttctaggagttctaacaacaacctagaaatggaggaaagaggtaaaactttgttcacaaactgaagggttctccttttgctgccaaaactattgggcatttgatgagaaggaatctagacactacgcattggagcaatatattgaatagtggactgtggaagtgggatataatggaaatatttacaagatgactaacgcaggagaaaaagaaagcatccaaagaaaattgaacccattgtagccaatcaagaacagagatcgtaagagattctttcatcccttggtgaggtattatctcttggtggacttattgtatgttcagataatgctgatcttggtaaattggtccttggttactccgatttgttggatattagatttatcttctacgggatcttgttctaattatcatcttattagaatccatccatgttagcagtattactttgcaagattaaagagctctttatatttttctgaatgtgatggtacatcatatgttgcttcttgatgttactaatttatttggaggcttcatggttgacctattggatcaattttgtcgtggtgttagtacaatggtatcaatattattctgttgttcgatccaattggctcaaaacaatgagctggtatgaacccacagttttagactgcaatatcagaaggtacatcagccatgattgagatggaatatgactccacagtattttattctttggccatcgtgtagttattggtggtacaatgatttacaatggtatctatgtgttgtttttgtgtgtgtgtgtgtttgttgtttattttcagaaggagcctttattgctgttttttttctctcttccttgctccttattcacctgtaagaattgggagcggcagattgaaggcaaagcgcaagtgctttgctttttcttggagtgtttctcaggtaattggaggttatattcatcattttaccagttgagcctgtaatccgtaaaaccaacactgttattgtgtttgtttgtttttgtttttgtttttgtttttttttttgcggggggctgttattgtgtgttaccatatgttttactgaacaaatgtttgcttctaacatcaaatggctacaattctgtcagcatctatgggttcaggttaattataagctgccatctatccctattggtgatctgtattatgtactgtctttcgccctctaaaagtgttttcttgaaacaatttgctgatgttgcgattgagactctatgcaactacaagttgttcctgtttttttctggatctggctgagtttgaatattgaattgcgtggaatgtgtttcattgaaatgtaattcagcaaaactttcaagagcattatgttattacttagaacacatatataaaatttttattcaccaattatttttcgtttacaaatacgccgtttcgcttattccccgaataagtgaatcgatggggctggtagtctctgtggtttgcactccatatgtctccgtgacatttttctcttccttttgcttttgtgaagacataataaaaaattttcttgctcttgcaggaatatgtgtgagttaagctttcagtgagggtgcacccaacattttaaggaattttttttataacttctaccattccacattcccagttttatccctgttcttcacaccagtctatgcaaatgagattcactaaaatgagctggggagctgctgcccgagggatccagacagccacagggtttgttacaagcgtcaatacatgggctgaattcttcaattgtctgagctcagccatttcatctgcatgctcttggatcaacattcatcagaaaccacagaacgattttgtaaaggaagaaatccagcatctgcaaagcgatttatggcagctacagacaactctgccaaaaatgcgcaaccttgttgagatacttgagtggcaaatctataaaaaaccagctgcagaactcctcccacatatcaaggatgcattgctagatgctgaagacatcattgatgaatttaattactatgagctcaaggcaaagatagaggggagaatagaggaatgcctaacatcgtctggatgccaggaattctatatgagtgtcattcgaggaagctttaacagagtgaaagaaatccaagagaagctagaccatctacatcgtcagtctatggacttgggcttgcattgtgcagcacaaagatttgacaaaattgttaggccagaaacaagttcttttcttaacagtcagatttttggacggcaagaagaagagaaaatggtgttggagttgttaggagtacaattacaagctaatgctggctacaaacgcaagcgaagcagtagagtggaggtcttgccaattgttggactgggaggtgtaggaaagaactactttggcccaacaaatttgcaagaatcaaatggtgaaagctcactttgatatgatcctttgggcatgtgtatcagatgactttaacgcaaagaggttaactaaagaggtaatccaatcttccaagaaagaaacatcatttgacaatttggattctcttcagtctattttaaaagatactgttgagttaaaaaggtttttacttgtactagatgacatttgggatgatgtcatggcagatggtgggcaagattggcaaaggttttgtgcaccgttgtcaaatgctcttcaaggaagcatgattttgatcaccacccggtcacagaaagttgctgataaggtgcggacaatggattgttttccattagaaggtctaactgaagatgttttctgggaatttttcattgtacaagcatttggaactgagagtttatccaaatacccagatctggaggacattggtagaagcataattctgaaattgaagggttctccgttggctgccaaaactattgggcgtcttttgaggactaatttgcatgcttcacactgaaataacatattgcagagtgaactatggaagttggagcaggacaggacagatattctacctgccctgcgtttgagttatatgtatttaccaccccatctaaagaggtgtttctcattttgtgctgtgtaccccaaagactacaggtttgaaaaggataccctagtcgacatatggctggcagaaggtttcgttgaacatgcaagtagctttccaactgtaactgttgtgcagcaatattttgaagagcttctaagccgatccttctttcagaaagtgacgcacggcaaatatgtgatacatgacttgatgcatgatatggcacagctagtttcgcaagatgaatgcttcatcataaggaatgcaaatgaccttcgaacaatcccttccaatgttcgccatctatcaattttcacaaaaagatatattggatgccatgatttaatgggactatgcaggtataagaaactgcgcacccttttgtgcagtaaagcttttatcaaaggtgagtttgcttctgtacttggcagctggtttaaggagcttcaacacatccgtgtgttgagttgttctcttcccatgatagaagatatacctgagggcatcagcaacttaaagcttgtcggctacatttacttctcaagccaacgtactttcagcatccttccttcgtcattttgttgtctatataacctgaaactctagatgcttcaacatgtgttttcagaagcctgccttgtgactttggaaacctgatcagcctaaggaaatttagagcgaaaaatttcagttatctcccaggagaggattcacgcatgcagtttctaagaggagagagaatcaaagtgttgaaatatgtaaatcaggtacagggaagtttgcttgtcaatttgcctggtctcaaaagtaaaaagaatattggccttactgtgttgaaaaaggagaataatctctactctctccatatatctcaatttgcagaggatgctagatatgaacaggaacaattggaagtctgtgaaaacctacatcctcatccggatcttcaacatttggaggtcactggttaccaaggagagaatttttgtcctagctggttcctgcctgacaacttaccaaacatgatatcgcttatatttgaggagtgccataatgctaagaagatatcattgcatagattaccatgcacaggattccagtatttgattaacctgtacatcatcgaatgcacaaatttatcaagcatcgaacaatttctgcaaccatgtcatataccggctatcaaaatgataagcataaagggatgccaggagttatcgttgatatcagctgaaagatttggaggttttcgtttcttagaagctttggtgatccgtgattgtccaagaatcagttgggaaaatgggctggcattgccgcccactctcacaagcctttcgttggtgaggtgtggggatatttctaagtggatacctgactgtctactgaacctatcctcccttgtccgcctgcagttggttgggctttcagggacaatgtttattcctgggagtatctggaggaataatcttccattgctagattacttggagatctgtaatttccaagagcttcgttttactggtgtaccagaagcaattgaagaaataaacaatgtgcttattgacaagtgcccaatgctgaaagaactaaagcagcctttctccagaggtgatgttaccttcttgtgggggattccgactagtaaatggtacttgtcttaactgattcctttcatcgaattaccgtgtgttatactaaagattggggtttgctaactttaagtcatgtaaaaagttgctaatttttcatcacctaaaattacagatttctaaccctaaaactggcagtgctatgtaaattgtaatgtataaatttagttacatttttctgcaattttgtgtatgcatatgatttaccttatctttgactctatctaagtttatcaatttaaagtttattttatgtctaagtaagaacaattcatagttcagcctttagcctataatgaagggattgcgtttaaatagaaacaagggacatgctgaaaatggttagattttcattcaagggatgaaaaaggttactacagttttcaaagattttagtcactcgaaagctagataaccccctaaaaattatattatggctttcatcatctgtgttaaatggttaaatgatttaaatacttaaaaatgatgaattaaatagcattgtgcttatggaatttatgggttatatccaccacagaattaagggagatacaaatagttcttatgaagttctcatgcattacccttgtttcacatccagataacagggcattccattcttgcacttcttttcctattcccatgttttgttggagagattctctgtccaaagtgataaatgaataacatgtttcaaaaattctatgacataatatgcagtgaatttgtcatgcaaaattaaatgatacaaagatatctacaatggttctacgggatctagagacaaatagtaagtcgatacaagaagagatgccaacagtacatcaaaataaatagttcatgaacaggtgaggcttatacaaggtgtattcactttctgttcgttacaaaccaatccatcttgttagaaatctaatcatcaatgcgggattccgtctttcaatcattccaaatcaacaagtagcggcattttccaccttgttaggaggggcattttcaaatacagatttgttcctttgtgcccaaatattacataatgccatggcgaaacaactttttttaggacacgcaaaaggcttgctatatttgtattaagaagagaagacatagttagccacgcttttacatacactctccgtctcatagaaaacaaatctatgatcctatgatcctaacaggagtcccaagcagaccaccagctgaggcagctttccttctgctgctatcgacaaatgcacctcatccacaatagttgctatcagctgcacctagtttttgatctcccggttgaacactctgctgttccgctctttcttgtgaagggtattgtacttgcagcgaagcggcgcaaaagttttccacatttgtctgtctccctcaaacttggcacgaccaatgaagaatcgcttgtaggctgatctggaagagtaagggcccgatgcatcccatctccaacaaaaatgagtcttgttcagcatggttcctaacccctcctccccgacacacaaaacgaagtctctattattgcatgattaattgagtatttgctaaattttttttaaaaaatggattaatatgattttttaaagcaactttcgtataaaaactttttgtaaaaaacacaccatttagcagtttaaaaagcgtgcgcgcggaaaacgagggagagggttgggaactactactaccgaacgctgtaggtattcaagcagaacctgtattcccaggcctcccctgatggcatgtatccaatgctatcctgcaacgcatctgatactgttctctttcggcaaatggatttgggtatcagatgatagattgtcggtgctcaaggttcaattccaaggtgaaactgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgcagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacaccctctctcaatccggacctaaccaggttcagattgcttttgaaattctccaggagtcttactgacagaggtttagtgaatccatctgcaacttgatcattagtggaaacaaaatcaatttctagaagtttctgacttacccgttctctgacaaagtgatagtcaacttctatgtgtttcgttctggcatgaaacactggattagctgacaaatacttagctccaagattatcacaccatattttagcagcttttggacttttaatctctaactctgcaagtaaagtctgcacccacattatttctgcagtggcattggcaatagctttgtattctgactctatgctagatctagacacagtggcttgttttctagcattccaggagaccagatttgaacccagaaatattgcaaatcctcctgttgatcttctgtcatctaaacagcctgcccagtctgcatcagagaagccactgactaaagtagatcctgacttatgaatttcaagtcctaaccgagtgcattgctttaagtacctaagaatccttttcacagcaatccaatgtacagttgtgggagcatgcaagaattggcaaactttattaacagagaaagctatgtcaggtctagtaagagtcaaatattgcaaagcaccaacaacactgcgatagtgacttgcatcttcaggccctaacaatgagccttcatgaagggagagtttctcacttactgaaagaggtgtattagcaggtttacaatctatcatgcccactttcttcaataaatcattggcatacttgtcttgattcagtacaatgccattctgaaccttgcttacctctattccgagaaaataatgcagctcaccaagatctttgagtgcaaattccccttttagatcctgaagtaaagctgcagtggccctctctgaagagctggctacaatgatatcatcaacatataccagaacaaacatagttatatcacctttattcagaaagaacagagacgtatcagcttttgatcctttaaaaccaaggtccatcaactttttacttagtctagagaaccaggctctaggtgcctgttttaacccatacagagctttatcaagtttacacacatgatgtggcttagtaggatcctcaaaacctggtggctgtagcatataaacttcttcttctaggtacccatgcagaaaggcattttgaacatctagctgtctaagactccaacctttagacactgctaaagacaatattattctgatagtggcagctttaacaacagggctaaaggtatcttcataatcaataccatacctctgtttaaatccttttgctactaaccttgccttatacctatctagggtaccatcagctttccttttaattttatacacccacttacagccaataatatttctccctctctgaggaggaacaagatgccaagttttattcttaactaaagcatcatactctgaatccattgctagtttccaatttttatcctttaaggcttctaaatcatttgtaggttcacctgaagcagtaaaccaagaatgcttatatttaatagtaccatcactatataccttttctttgcgaactccactttgcaacctggtgcgcggtcctgccggtgcctctgaacctgtgtcagtcacatctgcatgctgtaatgtattagtctcatctgtgacagcctgtgcatgttcctacgctggtgaggactgctcctgctcctgcaccacctgcgactcctgctcctgcaccgcctgcgacactgagtcttctgctgtgtcctctgctagcgatgatgctgccccccgtggcacagaaccaggtgtgggacccggatgatggcctgatgacatggccgcaggggagtggtggacgacacggtctggttctggaccagaactggcatccagaggaggcgtcgccggcgaatcttctgcatcagcgggatgtactgcaccatctctatgtggttcattagcacgattagataaagcagcagaaacatcagcagataatggattagtcactggatgcatgcattgttcattcccaacagaccgtatgggtcctagcagttcaggagtgagaatatcaatctcagaacgaagacgggcaccagcattggcatgaagttcagtgaagggaaaaatattctcatcaaagacaacatcgcgagaaatatagatgcgtcctgtagagacctcaagacacttgaaccctttatgcatagtgctaaacccaagaaaaacacaacgcttagagcgaaattgtaatttgtggttattgtaggggcgaagattaggccaacaggcacaaccaaaaattctcaaggaggagtaatcgggtttttgtttgaacagtttttcaaggggactaatattatggataactctgctaggcacacggttaataagataagttgccgcctgaaaggcttcatcccaaaactttaatggcatggatgcatgagataggagagataaaccgatctcaactatatgacgatgttttctctcagccgacccattctgttggtgagtatgaggacaggaaacatgatgaacaatgccaatcttagaaaaaaaagagttaagggattgatattcgcctccccaatcagtttgcatggctagaatttttctatcaaattgacgttctaccatgacttgaaactcttgaaacttgtcaaacacttgagacttatgctgtatgagataaatccaagtaaatttactaaaatcatcaataaaactaacataatatttttttctcccaacagactctggagcaggtccccaaacatcagaaaagacaagttctaaggggtgtttggaaacactggaagaaataggaaaaggtaattgatgactctttgcttgttgacaagcattacaaactgactcactagacaaatctgaacaggggaggctaaacttattgactacttgtttaaccgtggtaatggaaggatgaccaagacgatgatgccaccggtccaaagatagtttgatggcactgtaggcttgcttcaaggaggagtgtggtagaggatatagcctgcgccatgatcttcccttaaggagagttttcctggtgatttgatccttaagaaagaaataatcacgatgtaattcaagaaaggcagagttatcattaactaagcgatgtactgaaacaagatttttcttagcttgaggcacatataaaacatttctaaggtggatattacgactattgggattatgaacaatagcatgaccaatatgactaatatccatacctgcaccacttgctgtgtggatttgttcaccaccgttgtatttttccttcatagtgagcttgtccagctctcccgtgacatgatctgtagcaccagtgtcgatgtaccaatttgtgtcaactccataggagttaaccgctgcagctgcaacatgcttggcgtcaggaacgtaatcctcgtcgtacctataccaacaatctgctgccgtgtgcccccgtttgaaacacacttggcagattggtcttttatcaacgcctcctggtgtgcggcctcgaccacggacacctcctccgttgcggcgaccatggccgccgccgccgccgcgcgaacctccttggccaccattgctgttgccacgccccccgtggctgaagcctccacggttggcaacattgacggtgacctcctgtgcgccgcggtagatggcttggcgagcttcaaagttcaacacttgagagtacagatcactcacagagattggttcaacccgagcgcagacagccgacaccacctcgctgtagccctcgccaaggccggtgatgatatactgaatcagctcctcttcatcgatcgggcgacctccggcagtagccatctcatctcctaaggatttcatttttgcaaaatactcaggagttgacatgttacctttctttgtattggtgagagcaaaccgagtgttaatcgctcttgctcgtgtgtgggtggagtacatctgctcgatggcgctccacacttcagccgcggtgtcgcatgtagcgacctacatcagcacctctcttgtcagcgacgagagaaggtaccccagaacttgctggtcggtggcttcccagtcttcatgggctaggttcggctccttcttggtggcgccatcttttgtgacagcgatctctgccggcggccgcttggttgcgccggtgagatgcccctgaagccgcgctcctctgactgcggcgcttacttgcaccttccagagcgcatgatttgccttcccaagcttctctgagattgggtggccttggaacggatttgtggcagccatactggacgacgaggccatgagtattgatctcttagggaattgatcaacgctctgataccatgtgaattagtttgggtggaaacgatcgcactaatcctgtgcgtcgccttcgtgttaatatatatgtgatgggaacagcccccatcgtggcgatacagagttcggcgcagctgagaacaaccgaagccgagattgatgaaacgactgcatgtagtaacagaaaacagaaaacaaactctaacaaacatctgttatcgcatgtggaggaaaggctaacctgatccgcatggatagactaacctaatccaaactaacctcaacaactacatgcatgcaagctgtcaggtcgtgatcacatgatccgaacctttcatgctaactaacagaaacaacctttttcaagaaggattgaaggatttattattatcaccttgtggtctagcaagttccttgttggccgtagcttctctgagtctgaagtcaaggccaggatgaattccattatttaaaattctagcaagttacagcatatcaagaaccgaaacattccggactaaaattcatagaaaagatgaagctcttcctctaccatattggcatctctttcatgacaatttgagctctcaccctttgataatttcccctgaaaagcatgagaataatgcttattttcactctccgaatgacaaaaaaagaatacactctacttggtcatgcatatattcctctataacgattcataaaatgatgaagtttgatttgcttgccaacaaatcatctacaaggaaaaatatgcattgtttattactagaaaattattaccccctaaatctggtcaactgttcagtgttcactgtggaagtctcaactgatttcacatgacccagtggaactgcttgtgttcataagttcattatgaaagtcagatttattttagcacaatttctatgtggatttacagaaagttaatctgatgcggtctacatttatgattaggttgggtatgtgatttgctttgcacatccatggagatttcattttcgacttcttttttactaccaggtattgatgagaagctactgatgtcttgcagcttccttttttactacctgtttatttactttctttccgattttaggactgctgtatggtgttccttcatggtgtcaactgtcaagctggcctcccacaaactgtcaaaatcactttgtttcatgtggtagtttgtttcgtggatgtttgttttcagcgatttctgtgactctgtctggataatgcaaagttcgtatcaacacgtactcgttttcttttcttgagatgaatacacaaaagttgttgctcacgtggaagttatatttataaatctggcttcaaaagtattatcgcaaaaacacgatttcacgagagggagtaggaaaaagtccattttaacttcctcaactatagccgcagttcgattcatcaccacatatagaagcttccttaggtattaaaaccagtttatttttcctcctcaagcggtttcgacgatgattttgtcgtatgtggggttcattttacctcaagcgatatgttattacaataataaaaaaagagttgttggccccacatgtcaatgggactttttctcctctttcccccatcacatgtctcctctttttcatctttgcctgctccacgccggagcttgctatccccactggtagggtcgaactctactccttcatggtggcatcgggctctacgaaggcatggatcgatcctaactaacgtcaatgctatggatcgatggagtggactgttgacacgtggttggtgacgagccgggagaagaaggttgcttcatcgctgtaggtgccggtgaggtttttgcgttgagtattgcttcgtcgccgcaatactcaagcttgacaaggcgggcactaggagcttgagcttgtcacacgggctcacacctaatggggccaatggactggtggctgaggtggtctagatggccgtggtggatggaacccagtgaccggtgcagagaggtaatggtaaccacctgctccatatccctcctctctatatctgtatagctggtcctctctctctccctccgatctctccaactagatcgaatcacttccactcatcgagcgtgtgcatggatgtagggatcagctcggcactaccatcaatggccactgtcccaacaccgttgttgccctttcggtcaccaagcctgaggcctgagggagccaccatctgcacgtacccaccaccccccatcccctcggtgacgctcctcgcgacgtcgtcccgaccatcggaataccacgtaagcatgcaccacgtagctgccacgtaacacaaggatagggaggtcaattgggccggttttaatagttaggaaagtcttcatatatggttttatggttaaaaaacgtgaaccaaatgaccttttcctgagggagtaactcgttttgattgcatggctcacatggtgcttgcttgctttagatgtgaggtccacattgctacggcccactaggggtggtaatgggtcaaggctcatggatcctttcacaactcacctcaactctttaatatttatagaaaaaaaatagtactccctccgtcctaaaatatgataacattgtacgggataggacacatcatagtacccctatccagatttattgtattagtatgtgtcccatccagtataaaattgctatattttggaacggagggagttttaaatttcagctcaaccatttttacccaaccctcacattttgtttgtcaagatgttgggctcattaccacccttaattatagccaagatgagttttgcctcatagatgagtcactgaccagtggggccagttcatacccacaccgtttcaggcatccatcaccgggtttttaggactatttgccactctcccagataacttcgctattttgccatcggagagagaagatttcttgctcgtgtgccatttttgagcccgcaaagcgtaatgtcacttaatccgagggtaaaatgaccgttttgcccttcttcttcctctagctcggggtctctctcctccaaccttcctccctacgtgtgagctggtgacaccgccaccaccgccgccggaccaacctcctagcgctaggtggcgaacgacttgacgtcgtgggagagtggagaagagccgagaggaggaggcaggcaacgacgatgacgatggagcaagacaccgatgatgccacaaaagaaagagcggagcgaaggagggaagagtgcaaggcaaggagctcaccggagcccaataacctcggcgccttgggaaaggaaggggatgaaagagacgggaggagaaatgaagaagaagggcaagatggtcattttatccttagattgggtgacttggcgccttgcgggctcaaaaatagcacacgagtaagaaatcttctctctctaatggcaaaatagcgaagtcatccgagagagtggcatttgagaacacgaaaacccctccatcaccatcagaacggagaaatctcaaacggtggtttatctccggcgccgccgccgccgccgccgccatggctctcgctctcagagctctcccccgccgcctcattagccatcctttcttccactccaagcccctgtcctcctcgcctcccgaccaccgcgagctcctccgcatcgagcgcatcctgtccacccccacctcatcctccaccccacccccgcaacgccaagaaggcccacgacccgccgccacctccagcctccacgagac

SEQ ID NO: 18607 - DNA, 810 bp, Oryza sativa
aatttccttgtccattggattactgaagaaacggcaacatatatgatcgaccaaacacccgtctgacatgtataacagtgaaagtccagccacaatctcttgcatgcatttggagcatgccactgtttcagcacaaccgaatgattcagaacatacactagctggggcatatttgctactagtaagactatgctatcgaaattaaattatagtgtttgcaacaactctgcccaaggaagtggccaggaagaacacaacttgaaattaagctagcgattacaaatcgataaatccaagcagaattaaagaaaaaaggatgaaggagaagaacgctgtaattaacggtaatgcatgacttaagcagtccaaaacgatttgaggatactactcacatgtgtgcgtgacttgacgatgtaggagtagtattgtccaacagcacgagctattcaaaactcaaaagaggagtcaagcaagccgcaaagccaacagcctgcaagtacctgacattgacctgttgatgaaaagtctcagcttacacccaaccattttcacatttgccaacaacataaacaacgcaaagaaatgagcttgctaaaccttcctttggtgggttctgtacaagaaaaatgatggattaatgttacataatttgatttcgaaatattgctgaaactgaaagcgtccatttcattctttttctgcgcttactctgattcatgccaggtcaagatttaattaggttaattgcatgtatgaaatgtactagttagtactggccgttatatataaacacggtcaaaattaacctaa

SEQ ID NO: 18608 - DNA, 706 bp, Oryza sativa
taattgaagtcgaagattactaaacataaataaatatataagtgtaaagatataatggtagaaaatgacctttgttgaagcaatatcatttgagagccgtacacatgttgtgaaagacttaagaagttctggataagtcaaaaggcaatcaagagtttcctttgctacaaggtcgcccatcccaacaaaagaagcacatgctagttcaaaggcaccaacagtctttcttgaaagttccaggtgttcctctattgtttttggaatgtaatgatcatcacgccattttatctcttgagagaattcttgaactaacctcttgaactatattagaggtgtaaaaagtgtagtgttaattcagccgttatacgggcataattttgaagaaatatcattttaccaaaaaatatgattgagtcattagaatgtcataaataaagtggttaccataattttctcttaggataaaacaatcagtattgttcgttgagttagatatattctattaaaacatacaatcaaataaatatttatatgtagaatataactaacaatgaagttgtatatagtttataacacaaattgtatcataatcatgggataataactatatcattatattccaatctatctaatactcgcttcatccaaaaatataaggcgcctgattcacatggtcatcaacattgcacttttgaccattaatttg

SEQ ID NO: 18609 - DNA, 1038 bp, Oryza sativa
aagagttttaaaaaataattccatttcaaaagttgtatataataaacttcctccgcccctaccataggatggggcatataaatcaccatatggtaagacaatctatgtgcaatgaacccgtaggagggaccaactatggcaattttgtagccggccttctccggcgataaatcaccctcagggagggcgagaaggggcgcctgcaaaattaccatggtgcgcccctccagccttgtgccacgtcgcatagcacgtcctacataggatgggaggagtataatttcgcaaaactttaaaacgacgacttatttttaaatctttcaaaaataaattaaaaaattctggaaatgatatattgtgggctactagactcttggggttcaaaaacttacctaatgtaggaataagtttattttgcttccctcatcttttgcacttagttgaatcgcatccctcaaccgtaaaaccggatataatgcctccctgaacttcaaaaaccggtgcaaattgactccttcgttgcttttgaaagcattttctgatgacgtggcacattgacttggtttaagtatgttgacgtggcagcgtcataaaaaattaaaaatagaagttggtctgacatgtaggtgacaaaagtaaaagggacattgcttatttgaccctattttgaagtttaagtactaatttgaccttgttttttcaagtttgtttatttgaccccgtttttcaaaattgaagctaccgtttgaccctattttcaaacaccgttagggtttcatttagatcaaattaaaaaaaatgaatttacaagcctaaatgactaaaatgcctttattcactcattccttatcctctccatgctctctcaccacttccttcattagagcacaaatggctggagagacggcggctgcgttggctccacggcggcggcatgacggggaggaccgcccgcggcagcggcggctgcagaagggcgatgacggctggaggaccgtcggcggcggctgcgttggctaagggcggggggcagcttgg

SEQ ID NO: 18610 - DNA, 871 bp, Oryza sativa
  unsure (1)..(871): unsure at all n locations
cccccattctttgggcaactgccgcatgtgcaaccacagattggagcaacagctgctcttggaggcacacagccaccaacccaagcaaaccaagcagctggttcatttccaccacctccacctccattaccacttatgccacaatttgttcaaaatactggaggaatgtttggaatgggaccttttgggatggtgagtggctctgcgccacctccacccccattgcccaacattatgtcagcaggttttccaagactaagtgtgcctccacctctgcctctgcctacacaatctcagaaccagagccagccccagcagcagcagtctccacaggcaccacagcaatcgccgacctcgactggattttttcaaccaccaggtgctgggttcttcccaccagtgcaggttcagcaatctccatctgcccaacggcaatgatgattctacaacaattgttgggctataaaggaagcaccttgtgctaactttgtatattaaacaataatccctgaggattgatctgatagttggcgagtcctgcatcgtgaagcaggattaatgcttatgaattgggaggatttgtaggataggcttgcggcttatgtgatgtacaactgttccttttggtctgaggagtttgttcaactcttcttgattatgtgaagttagttagactttacttttgtttgcatagccagatcttattgttagtcctgaggcaaacaaatgtcggcattacatttgttacttaaagaggtgcccaagtgaaagaacttttttgggctcctcaatggtagaacttacctgtggctnnnnnnnnnnnnnnnnnnnnnnnnnnnnnnnnnnnnnnnnnnnnnnnnnnnnnnnnnnn

SEQ ID NO: 18611 - DNA, 660 bp, Oryza sativa
cccattagcctgtgaaacagatggggagaaaaaggaagccgaaaagagcccacaagtatcattcacatactgatttgaacgacggacaataaattgctgttaattctccaattgcttcttctcggtgaattgaaggatacagcagattaactgattaagctagcttacctaacggccagaacgtgagtcatccagctgattaagctacaagctactaagctagcagtgtagtggaactaatgataaaactagcgacacgatcttaattgtactaaagaaagctgggttaaaactatctacaagttgataaaactcatctgcaaaacttttgctaactaaaaatgtagagcagaatccagaaagaagcagaaggtagccgggccggatgcttctaattgtgcctgggattgaagttggtcccggggttgtgcttcatgctggcgtcgaactccaccttgggctcgccgttcgcctgatgaacgccattgactcggaaggtgttggtagccattgccgccgtcggcgccgctgccctgggctgctgttgctgcagcagcaatctcctgctactcctagcagcaacagcagctactgcattgttgttgccgtcacgcaacaagccggtgctggtctttggtgatgcagcagcagttacagcga

SEQ ID NO: 18612 - DNA, 614 bp, Oryza sativa
tggtagttgttttatccaagtgctcctcgacagcaacagtctcaaccttgtcaatcgaacagtcagtaatggaaatcttggatttaaaggacaaagtttgttgattctctccaagaacaagaacagcaggttcaccataactcaaaagtgctccaagcagaagtgcagttaacaggaagactggagatgaagacagcaagaagttgaatagagaagggcaaagcctgtgtagaaacagcaacaaaacgccagcagctagtactatagggtaatcacaagcaaattgatatccaattctgacagatgaatacattagtctcttgatatgcaacacaatgtcatttgcaccaaaagccatatatatcttcttgaattttaccctcagataaaacgttggcctggaaataggaaagagagaagcaattcatcactataacattatggtgaatattcaaacaagtaaagatttatacttgaacaatagcgggcgtacagctcttagcctccatggcagctgtaattgttgtactagtttgaacctcttcccaatcttaataaacttcagccgcgtatcttacgccagcccggcgaaaaaaaaaaagatttatacttga

SEQ ID NO: 18613 - DNA, 6324 bp, Oryza sativa
  unsure (1)..(6324): unsure at all n locations
agggcgaattcgagctcggtaccctattttgctatatatgagatgaggatgatctgtgccgtggtctttttgcgtcttagcttgaaataagggcccgtgcccaagtcccagtcctcgaaaagcgcgggtcgaggctaatgcctggggagatccgcatgtcgagactggccagaccgggaacgtggtgaccgagggttatgggtgacccgattgtgggtttttgccgattcccccccggagttcaccacgccccggggcacggctcggttctgggccccgtttggcgattttagctgaccgaaccgaacccccgagggcaaggttgagcacgagtgacattatttcaagtcaagattcttcaaaaggaaaaaacggcacagacacaacctttagaaaattgaaactgcttttattgaaatgctgaaataaaggaaaaagggatatatgtgcatgtgtggtagcccccggccaatcctgcacacccgaggggggtgcggggttggcccgagccaaaacctgacacccgaccccccccccctttcaggggtagaagcgacgaaggtgttcgatgttccacgggtttggcagctccgtgccgtcgcccgtggccagccgtaccgagcccggccgggggacaccgatcacccgatacggaccctcccacattggtgagagcttgctcaatccagcacgcgtttggacgcggcgtaggacgaggtcgtcgacgcagagtgatcgggcccggacgtggtgctgatggtagcgccgcaggctctgctggtagcgcgcagctcggagggccgcgcgccgccttcgttcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaacgggccgtgatgcccttaatgaatttaagagcagagtgcttatcgatcttgacaaccggataagcctcgggccacttagtgaacttgtcgatcgcaacatacagatactcaaacccgcccggggcccgtttgaacggtcccaggatatcaagcccccagacagcaaatggccatgacagtggtatgatctgcagggcctgggccggctgatggatttgcttggcgtgaaactaacacgctctgcatcgccggaccagatcgactgcgtcattgagagctgtcggccaataaaatccttgacgaaaggccttgccaaccagggtacgcgaggcggaatgggctccgcactcgccctcatggatatcagcaagaagctcaacgccttgttcctgaggaatgcacttcaggaggattccgttagccgcgcgccgatagagggtcccttctaccaacacgtagcgtttggaaatgcgttgtacgcgttcactcccttcgcggtcctcaggtagagtcttatctgcgaggtatgtttggatctcagagatccaagcaatcaatctaaaggagcttggagcgctcccttcgggtcccgaggcctggactccgacgggcctcgggggccggtcaggcgcatccgtctcccctaaggggtcgggtcgcgccgacggctgagtaagcctttcttcaaaggcgcccggtggggtctgggctcgcgaggacgcgagccttgagagttcatcggcaatcatattatcccgtctgggcacatgccgaagctctatcccgtcaaaatggcgctccatacgccgtacttggcgcacgtaggcgtccatctgcggatcagagcaccggtattccttacagacttggttaacaaccagctgagagtcacctaacaccagaaggcggcggatccccagcccggccgccactctgagtccggcaaggagtccctcgtactctgccatattattggtcgctcgaaagtcgagacggaccatgtatctgaggacgtctccgttcggagaggtcagcgtgacccctgcaccggcgccctggagagacaaagaaccgtcgaactgcatcacccagtgggcggtgtgtggcagctgagaggggttcgtgctggcctcgggtattgagacagtctctggagccggggtccactctgccacaaaatcggcaagggcctggctcttgatagcgtggcgtggttcaaagtgcagatcgaactcagaaagctcgattgcccattttaccactcgtcctgtaccctctcgattatgcaagatttgaccgagggggtaagacgtaaccacagtgacccgatgcgcctggaaataatggcgcagtttcctcgaggccatcagaatagcgtaaagcatcttctgggcctgtgggtatcgggtcttggcgtcccggagggcctcactaacaaagtagacaggccgctgcacctttcggcggggccgatcctcttcgctagggtccgtacccccggggcgttcttcgtccgagtggcccctcggggcgcactcgtcttctgtgccgatgacctcggggtcggaggacgacaggagcggctttcccacagtggcctcggggccgtcctgggggtcgggggctcctggcgtcatcggacaagcgggcaaagggccaactccggtcgtcaggggccttaggccaccgttcggctcgggggcctcttctccctgctctctcccgggtcgaatcggtacagggttagcctcggggtcagagggcgataggtgcggcctccccgcagtggcctcggggccttcctgagggtcgggggcgcccagcaccgtctgacgagcggggagagggtcgactccggtcgtcaggggccttaggccaccgttcggctcgggggcctctcctccctgcttgctcccgggccaagtcagcacagggtgggggtgcgcggaatgaggattgtcttcatcgcgctccacagccaacgctgcactaactacttggggggtcgccgctaagtaaagtagcaggggctcatttggctccagggcgactagaaccgggggagagctgagatatgcctttaactgagtaagggcatgttcagcttcctccgtccaaacgaacggccccgagcgcttgaggagcttaaacaagggaagcgccttctctcccagccttgatatgaaacgacttagggcggccatgcaaccagtgacgcactgcacatccctaagtttgctgggggggcggatccgctctatagctcgtatcttctcggggttggcctcaatgcctcgggcagagaccaaaaacccgagaagcttgcccgcaggtacaccaaacacgcacttatcggggttcagttttatgcgggcggagcggaggttctcaaaagtttccgctagatctgagagtaaggtctcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatggtaaccagagtatgcatctagaaaacacaaaaggtcgcaccccgcagtggagtcgacgatctgatctatgcgaggcagggggtaaggatccttaggacatgccttgttaaggtcggtgtagtcgatgcacatccgaagcttgccgttcgccttgggaacgaccaccggtttcgccaaccactccggatggatgacctcacggatgaacccggcctccaaaagtctagccacctcctcgcggatgaaggcttgacgttccggggcttgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggccatccgctgcctcggggcggtgggggcagaggggccaagcctctcgtcaccaccctcgggcttggacgcagcagcgaggcggtccgcgcgctgctccatgcaagcaagcgcgactttaaggtcgccacggacagagatggggccaccggggcccggcatcttcatctggaggtaggcgtagtggaccgccgccatgaacttcaccaacgcgggtctccctaggaccgcgttgtagggcagactgaggtccgccacatcgaagctcacccgctccgtgcggaagttggcgggtccaccgaaggtgaccggtaggtcgatgtgacctaatggccacgtgtgccccggcgtcacaccgatgatcggttgagacggctggagcaccatccccgaggccttgatagcatcaaaggccgcgggggaaaggatgttgagagccgctcctccatctatgaggacacgacccaacttcacgttgcagatggtgggggaaaccaccatcgcaacctgccctccccgggcaatgcacggtgggtggtcggtctggtcgaaagtgagagcaacctccgaccaccgcgcccgacgcatcgcctcatgggtaggggccatggccagaagctctcgcttcatagccttgaagctccggcgagagacgtgagcacatgctcctccatcgacggtggcaatggtggccccaggttcttggaaacctaggtcatcatcaccatcatcaatgtcaacagcgggggccttctgcttggcctcacttcgccgtttgccagaaggaaccgccggggacttgccctcacggcgttcctgcctcctgtcctcctcccatttcctcgttcgctcggccaggtttttgaccgcacgacagtccgcgagatcgtggagggaggtgttgtggacagagcaccacctgccggcgaggcgctccttgctgggtgtaccagcctcgttctttttgtcgctcgcaggcctcccctttcgagtggcccgcggagcgccctcgactgcgaggacatgaccctcgtcgccggaacggtccggcctcttcttcctcctcctgtcacgccgccctgtctgagcggcggatccgggggcggccgaagctgccactccggaaccggaggagttccaggtccaggcctcctccttacgagccactcggtccgcgagctgaaaaagctctgcggtagtctggggctctttgcaggcaatcttttcgagcatgcggttgtgccgcacaccccccctgaacgcgtagatcaccgcgtgtgcagggatgcatggtatagtattgcggacttggcaaaaccgctgaatgtacgagcgaagcgactcatcatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggtgggccggaaccttgggggccaacggacattccgaagactcgccacaaaggctctacagccaacaccaccggccgggggcacggagggctgatcttcacgtccgtgtcgaggtgacactctggacgaggaggcgccctccggtgcacggggagtacgccggctattacgccggcgctcgacgttgaggcgggcatacggctccccatgctgatccctccgagtcgacggtgtcgacgagggagtggcagccgaatgacgtgcagncgccgccgttcgccgggcccttcggcttgatgacacggagcccgtggtagcggcgcccgaggtctttgtggtggctgaccg

SEQ ID NO: 18614 - DNA, 10035 bp, Oryza sativa
aaaggtgccagaccacgtgggcgattgtgtctgcctcaagcctctagtcatgatactcccggtcccatatcaccgacagtagctcacgatggttaatcgtgttatgataattaattgataattaaaacttatcaagggtgggttgtgagcacatggttttaaaggttgtgctcatggcaattaaggaccggttcgcgagctactgttgtgagaaattaaccgtgccaaccacaagccagcgtgggcaacggctttaccttttgtatagcatggttcattgcggggcaccagactgtgaagcggcgagaagtccgtgggggtcgctggggagtccatgcctctggttattgagggggtgattatgatccaggaacggtgcgctgtggtggattgtgttgtgcaaggggtactgtcacagttcctttctgaggtactgtggtggtattgaggcgcatggtgacatgtcgtggagctgtgtcttgtgggtacagtggtacacctctggccagagtaaaactattcgaataaccgtgcccgcggtcatgggtgagttgagcaatgtttttcgtgattagtctcacacctctcacaataattattgatgctataactggtaataatttgtttagctcctggtttggagttagatctgtacagccgggtatggttgttcagggtggttgggcctgtgcagcatgggtgtgctgtgcagtgttgattaaaattgatgattaattactctactgttttactactcttaaatgtttgctaaatgctgcttttgtaaatgagcctatattatgacatcctttggtatccttgtgcacttgcatatttactgtgtagcttgcggagtatgtcatatgctcaccttgcaataatcaatcaacctcagttgaagaaaaaggatccagaaggagaagacgtttggcttataccccagttgagctgcctgtgggagtggagctgaagccatcgctagaccgttaattccgctgctattttcttttcttttgtaagtatgtaatgatgttattatgatggatttgtatattaaattgtcagtttgtgtaccttggctgatttctggacgagggttttatgcacaaataagttcggaaattactagtgaatttccgggcgtgacacagacccacatttataacatctcaatagtcaaaactgacatataagtcgtcatcaatggcaggtgtttgcttctacctctatctataactgtcgaaatattgaaccattgtagattgtgtcattacaaacggttctagctgagccattacacataacaggtcatagatgaagttttttttttaagtagtagtgatttaatgtagggaaagtataccaataaggtgtagatttagaggtcattaggccatgtcacataatgtaatttagtacaagtgccaataattttttatacatgtatgaaatgctcagaactatatcggtttaacatataacgatgctaccatatccttaattgtattcgcaaaagtgtatgagtctgttttcttatacatgtaatcggctgttcgtgcaagatcaacaattgtctcagccactatttttggttgttctgttggtagtgtaaggtattcttttactatatccttccatgaatcttcaatcaactcctttatcttcacacatgcatcatgcattgttgttccatgctgaaacatgtaacattgcacagtagaaacatggtgctcccctttttgctcacgctgtacaagggatagtaagacaaagtcaaaccactattaagaaaagatatgatggaattttcctttagtttggccaattataaactacatataaatttgttaatcatgtgtttgtttgtatgaagtttatgtttgtacttcaagttctattctaataaaagaatggaggtgtaaatgatgcaagaataaacatctatgtaaatgcacatgtgtaaaaccatataacgacctttgttgaaactatatcgttggataatcttgccaatgttgtgaaacacttgagaagctccggatatgtcaaaagccaatcaagagtttctttagttatgatatcacccattaccacaaaggaagcacatgctatctcaaaagctccaacagtcgctcttgaaacctccaaatgttcatcgactgtttttgggatataatgttcatcacgccatttaatctcctgtgagtatccttgaactaacctctttaactacaatgaacataatgaaatatgatttcagatattgaatttccataaaattaactgttgagaaatatcattttactaaagaattagctgaataacaatattaaaatacaatagtttgttgtacttatgcaaagcatgtatactttatacgtacaatggtttgttttatatagtttaatttggagcggtattttttgtattaaccattgtacatataaatgatttgcataacaatgtgatttctacatactatataaaacaaaccatataaaagggtgttaattagttttaaggaaattcgaatttaattggattgctcaacgtttgtttacatggatcatactacacatcatgatatacagcctaatcataggatgaaaaaaatattaccttcatcccaaaatataactacctaggagtgtaggggtgagataaaggatcggggcaaaatgtcaaaaatgcccctcattaatacataggggtttatgggattaaggatagtatgggtggtacatagtctcgggagctagtgaggtgatggggccattaggggtagcatggggagtaatggggtaatttaaacaatttaaacataaagactgatatattttgggacggaggtactatcgctacgtagcaatatcaagatttaatttggtctaatataaaattggattatgtaaagtaaacttagagtgaagagggcaaattttattattcttgaactctagtgtagctaacataaattataatatgtcatctttagctggataaagtatataaatcacacatgtttaacaaactaacaagtttaatggcataaatacttgccagctctttgagataaaatacacgataactgttacttgttccaagttcctcttcaatcaagtcaaatgtcttcaataaatacaagtaaaaacacttcatatattctggaagtctcactattgcactttcattacacctgtattttacattagagcatcaggtattttacataaaccaaaatacaaccatatcagaaatttagaactacaagtcaataatatttcccgaaattggtgctacatggcccagattaataatttaacatacataatgattgaataatcattaaaccacattgtaagaatggagttgcattttatacaatttaatttgtaaaatttttattctagttggttcaagtcagtaaatttgtatgtacaaatgcatgcaatatataccatctctgggggggttcggggtaaaagtgaagaaaccccaaagacaatggtaaatttcaggaggaggatgaatatgagataaaaaagcaacattaacattagactaaaactaaagattacttgtatatcgcttctgcaagcatcatactctcctctgttgtaccatgggtgtcaaatatatcatctattatagtgatataggccatcatctttataagtataatccgtgacagagaataattgaattcagggcatactcctgtcatccaaaaatgcatttccacaattctatctcgaatgaaacttagatttgattgaatattaagctccttccaccatctgtaataatgcatataaagataaatctactaattaaaaataataattaagaagtacaacttagctttttcagtacatatcaagtttaaagtgacttacaatgtgatcttttttagctcctcacaataaagaaattgaagtaggttgaaattcaactttgcaaattcaagtatggtctcatttcgtccagagatcttttcatagattgggatatagtttcttgtttctaatattcgaaccctcctaaaaaggggtgtttcaagggcagaagatacttcttcttttaacggagatttcaaatgttccaatttagcttcaaggtgggatttcgtgaaggcaatggctccgtcaagtactttgtccccacgagtccttacatgtgctgcattatataagcctaagagacttcttacttcatcagcagcaaaacttccttccttgtctttgaaacatagaaatatatctgcaaagtttgataaaataaagtattaatttgtcactgtcttttaacaatctattttttattttaccaataaaagacttaccagacgacacgtcatagccattcttccttagaagataaaatcgaagggaaactaggtttagatctttatcgtcaaaatcggaattgtaaatggaatacagtagatcatctagctcggtcttgtagtagctatccaaaccaagccgttgcagtgtgagcacaaggtctagtatctcagatacttcctttgagccctttaccatgcacctaacttcttctttcagcacctcagccctttctttcatgcatgcatgctttaaaatgagtagggtagtgtgtattagtcaattcttccatgcaatcgatcagaaagctacgcctattacttaaaaaaaaaggaaaacaactatgtttatagctatatctatacatatgcctatagttattaggcattgttgtgatgcaaggaatatctcaacatgcctaattactataatatgatgttaaattattgtgagatatcgtactcttatttaatatttaattggagtagcaaaattatctgggatccatcgagcggaacataattataatggctaatattaaataagagtccacacatgcacaacttattattattattattattattgttgttgttgttgttgttgttgttgttgttgttgttgttgttggtccctccaaggaaattcacattataattggagaaataatgaataatatatcaaatgaaattaaaataaaagtaagcacccgttactacttgttaattattaattcctaattttgaaaataaattaacaggagtccaatacagatagaactttgtatttattattttcgaaattctgaaatatttaattaaaaaactatcactgagactccaaggctagtacagctttgcatttgttgattttgaatttggacattatttttgttaatgataaataaagttaagactccaaacttggtagaacattacatgaaaaactaaaactgaaactgttgaacaacatatgagtgcaagtcagggatggcatgccaattattattaatttcaagtttttatattgttaaacaacatgaaaaactaaaactgaaactgtaaatcaggtatagttttcttattaattccatatttatgatttttctgttcatttaaacactaaaataaataatccatgaaaaatacaactgtgtattaatttattaattttgagtttcaagattactaaattaagaagataaaaaactataaaaatattaattggtatgcataatgttgtatattaaaattttgggagtatctattgttcgttaaataccatatacaatgtttgtatatcatagtatatataaatagcacgcgtgaatgcacgggttactgaaattcttcagcgctatatttgcaattaattgttttaaaacaaaatatttgcgattaattgctacctgagatttatttggtggctggtaatcgacgaagaaatcaccccacagggtggggtggaatgtagaagcagccttttgcatcctctcgttgtcttctttctcggagcaaacagctgcaggtttgattaccattctatccatcttgatatattaattagttgtctctccttaagtgttcttcacaatttctcttcttgctgactgaaactgtgctgctctgaacggctacttatagagggtgaggcatcgataggccagcaacaaacgttgtaattaaaatgctggcattgatcgtgtccaagtgaagaatctttccatgcagcagcctgccttatgaccgaattggaagatgtgatagttacagttgaacttacatgaagtaattttgatataaaaatttttgaccatatgtaaatattcttttgagatgacgatgcaggcaagaagaggccaacaacgttctagctttggcattgaacaggccaagtgatgctgatgtatatatatatactctgactgtactggctgctatcgatagcgttccaaacaatgcagtaatttgatatacagtcgatcctgacccttatgtcaattcattctattttttctagaaggaaatgtgcacaagtgatgtagcaccaagagttagagtagtacgtaacagtagtttgactcggcaggctttaaaatatttcagatcattgtattcctattccaaacgaagataattcaggaaagagaacgaatggggagaacaataaaactaccaccgatgaagagattccttgcagcacactatagagctcgcatgctgtcggtcgatcttggtgacaaaagaaagagcttttttaccgtccatccaaatttcttcttaccttttggtacctgcaatcagaaccatccatatagatagatccaacggctgtcaatacttggtactgctaggtacagaaatctcctctgtggtacctccccttcatccgcatgcattgaaagagttgaagggcaaaattgggttttcacatggctaggctggctcatccttcttgcgttggttgtgagtttgattctcgcatgccacttatttttttctgccgtcttgccacattatttttccctactgcctgtgctcccgttatcatcctcgagagcgcgatataaggagttcttcgtgctctctctctccatggtgatgtgattccggacttcaatcttcctctcatccaaaatcaaacaaaaggctaaagcctagaggtgatgatcaggtgatgcaagattttttttttttagggggggggggtggtgggggaagggagggcatcggctccaccgcaaccacagtcagggtcatgggcgtcagcgcatcccccgttggatcgctagccgcctttaacaataaatacaaactgtcgcgcatgaaggcatgtaagtatagtgggcctttgatgggatcacgatttgcacgtgaggacatttggcaggtcacaagtccatttccttctttttcctatcgtacccttacataatcgacgattagattttgtttggtacctcatagtaccagtacctagagacatcatttgctggaccgtaaaagcccacctcatcaatccatcaaccctatgtagtttcacttgctcatcccgtccatcgcatttactcgctagatcaacactcgcctcgtgctagctagatcgtcttctcttctgtggtccaccccatgtgatatatatcccggtctccgcatgctatgaaaatttgatctatatagttgtgctgtatttgggaaatttttgtcctgttcctttttcttatgtaagcctattatttgtttaagcaaagttggtaatggatggatttggtttaaggaacaacaccatgtatgggtgtactattcatctaaagcatgtatgggtgtttggtgacttcattgaaattcaatgtagatagactagtgttcatgatgtcacacaaatgaattagtctttctatatagatcaatatttgcctattaggaaagaggatagcaagttcgtaattaacttttaaattaatgagatgtgtgatctgcacatagctaaccaatatattgtactaatacgcttaaatatgagcaaatttcataaaactacatatactttacacaatctatcacaaaactatatatttaagaacttatttcacaaaactacagattcaatgtcttcgtttatcacaaaactacaagtactttgcacaatatatcataaaacacagatttaagaacttgtttcacaaaacaacaaatttaatatctttatttatcacaaaactacaggtttagtgtcttcattatcacaaaactacatgttttagcattgttaaaacctgtagttttatgataatggagacactaaatttgtagttttgtgataaatgaagacactaaatgtatagttctgtgataaacaaatacactaaatcgatagttttgtaaaacaagttcttaaatctataattttgtgatagattgtacaaagtacatgtagttttgtgataaacggacatactaaatttgtagttttgtgaaataaatttttaaatctgtagttttgtgataaattgtgcaaaataactatagttttgggaaatttactccttaaatattaactagaaaatgacgtgaagatagctataactagcaagtttaatattatagccaactgctagctctaaaaattggcacatcatctatttttatataaatatatattgcatcattaataattggcaaacctctcatacacataatattttaaagcccatgttatagctgtctacaaatctgcaaagctaacttattgtacttgctcacacccaattaaaggcaggcaactcttgtctgaaaaatgcccaaattaatctctgcaagtaccgattgtagccatgcttttttctctatatatgaaaagaaaagattgtaccaaaaccatctatatatgcagtggcattggcaagtccttgtagatactcgatcattatcattgatacagtggtgggttattgtctcgtttaccaggactccaagaaacaagctacagattcccacccagaaaaaactgctgcaaattctctcacgacaaagcaagtttcagatgtctgagtgacgcagaaaatttgccacaagcagggaaattcttcgtgcattcatggcattttcgtagctactccatgcagcctaagtacatgttgtagttagttagctgcctgcgtaccagccgacgaaattaacttggtcgatgttgtagtagtctcagtgcatatgctcggaaaatcgcaaccttgctatatactccctccgtttcacaatgtaacactatgccggcccatgctagctgtgacgggcctaaactatcatctctgacggattcggcccctcgtcaaagattagtggttagtgatgactctcttcacctttgacgggtgaagggccgtcagtggtgaccagcccctatgacgggccacgtatagaacccgtcacaggtaactattatctcaaacggcacattaatttgtgagccgtcagtgatgtctaaaatccagaaaaaaaaagaaaaatagactggaacccgtcataggtgtgaaaaaaccctagcaagaaaattggcgcacgctgcattggtggtgcttgctgtcatcaaactgacagcatcacaaaaacatcaaactgaccacatcacaaaacttcaacctgaccaacagttcattgtcctccatcaccgcatcaccatctcatatagcaatcattcacaaaagaggatggcaagaatttatcatacaacaatatcatatcattcacaaaaggggcacactagccgatagttcgtcgtcctccatgacgaaccagctatgggagacgcatgtggaggcgccgcgctcgcagccgccggggaggcggcggaggatctcgaagaggcactccactgctgctgcaccactaaacaaaaatcaagaaacaagaaaccaccattagagcccacattctcaaaccaaacacctcaaatcaacaacaacaacaacaacaacaagaacaagaagatttaattaaaaaaaaaactcaccgaggtggccggtgggtggggatggaggaggcggtatctgtgcatccccggcctcttggaggtcggatccggcggctagcgcggttggtggcgttggtgagggaggcatcggtggcgttggcggccgggaggtggggggaggcaccggcggaggtggaggcataggtggcggccggctagc

SEQ ID NO: 18615 - DNA, 1451 bp, Oryza sativa
aaaactaattaatatttgttacaattgtgaaactccttacttgataatataatatttataatgtaaatgcgtgtggtgatttaaatgctatatggctcaacgtaaagtgatgctatcatatccttgattgtatgtgaaaaggtgaatgaatctgcttgcttgtatatataatccccagttcgtgcaaaatcaataactgttcttgccacgatttttggctgaaggtttgttggtgcaaggtattctttcatcatatccttccacgaatcttctatcaactcctttatcccaatgcatgcttcatgtattgttgtaccatgctgcagcatgtaacactgaattgtggaagcatagtggtcccctgcttgttcacgctgaaacattccatagcatcatgttttagttatttataattgaagttgaagattaatatttataaaacataaatgaatatataggtgtaaagatagagagatattaaattacctttgttgaagcaatatcatttgagagccgtacacatgttgtgtaagacttaataagttttggataagtcaaaagataatcgagagtatcctctgttataaaatcacccatcccaactaaagaagcacatgctagttgaaaggcaccaacagtcattctggaaagttccaggtgttcctctattgtttttggaatgtaatgatcatcacgccattttatctcttcagagtatcctttaattaatatcttgaactacattaaagatgtaaaagtgtgaattcagtctgtatattggcataattttgaagaaatatctttttacccaaaaaaaagatgattaagtcattagaagatcgtaaaataaagtggttaccatagttccctctaagggcatccacaatgtggtgcaaaagtagtccataagcattataatatttcattcagccacctattacctttgtgcaactagtccgtatagaaaaaataacaaaaggtacccatatgcaaatagattacccatatggcggaataaataatattatctatctctactcctctctctttttctaatgataccttgtgtctatatatattgtgggattgctatagttaaagttcatttatatgtgtcccatctatatggatcattttgtcatatacatagttgatgccctagctaaggataaaataatcagttctctcctctaaaatacatatattctattaagcatatatataatcatatcaagatttatatgtaggatatgaccaacaatgaagtttctatacgatttgtaacaaaagttatattgtaatcaaggataaataactatatcattaaatttcagtctatttaataatccccccaactcccctccccctccttgttcccaaaatataaagcgactaagagttttacatggtcaccaaatattgtactttgacgggtaccgagctcgaattcg

SEQ ID NO: 18616 - DNA, 19877 bp, Oryza sativa
atagttaaagttcatttatatgtgtcccatctatatggatcattttgtcatatacatagttgatgccctagctaaggataaaataatcagttctctcctctaaaatacatatattctattaagcatatatataatcatatcaagatttatatgtaggatatgaccaacaatgaagtttctatacgatttgtaacaaaagttatattgtaatcaaggataaataactatatcattaaatttcagtctatttaataatccccccaactcccctccccctccttgttcccaaaatataaagcgactaagagttttacatggtcaccaaatattgtactttgaccattaatttatttcatgatatatcatcaacaactatgaaagtaacattatatgaaagcatatccaaatactacgaatctaatacaaggatatggtaactacatatttaattgtcatatatataagttttgccacaaattgttttgagataggagacttaccagctctttgaaataaagcactcgataacttttgtttggacctagtgcctcttcaaatgaatcaaatgtctttaaataatataagtagaaatccttcatgtattttggaagtagaactgttgcagattcattgcacctatattttacaatctagtgtcatttaatattttcacaaaaaacaaccaaaagtgtaatcatgtagggagccaaattgcaaatatttattagcgtatagtgatttttgattaaatggttgaagattggcaagtttgtctagtatacacatttattttattggcgttaatatttttttatgtataacagttcttatgtcatttcttggtagatcatatatccaagatataagattaattacgtggctagcttgattgtctgttctaccttcctaaactcctaaggttaaataaaatggaagcattatatattcttggcaaaggttggtgtatggcatgacataggttcaaagtattactcatgatcatggactcatggtgtgttcagtagcagtgtcccaaatataagctagtgttgttgcatacatgtaggatattgccaaatcattactttgtctagataatccatgctaaatttatcttttgatgtttgcattatgatgattgctctggattatattttttttgacctcacattgtctttccactactttatgtccatagtatgtgttctttgatttaaatttttaggatgaattactttaaatgaaatgaatgaattattatcaattctgccatgttttatatctatgtttttatttttttatttaacctcagaataattttgataattgcaatatatgtaagcatggtatttgtggattttatatcattgcctgtatcgaagaatattatgatttaacttatgtatcaacttcatattgcataaaacatgcatggcagcaaatgaccaactgttaatattacaatgaggttttaagtaaccgttacaattaatgcccagataggttaaatgtttgcatttctttttctaagagaaaattgttttccttgatctttggtaattatatataggagaaaatttaatatgcttactctttttctcaattaatgaggcatacatgggattaatatattaatacaacatggtgaatagattacaagtatcagaacatgtacggatatacatgtgcattgcatatatataatttcatagagttatttggctcctttatactatgattttgttataatttactttttatgtgtttagtctattgtgaaattgattccacatacaactagaaatttcacacttagtataaactagctactacaaaataaagatgcaattaatattaccacatattataatgaaggcttacatatatatcgctttggcaagcatcatgctctcctcggttgtagcatatgtatcaaatatatcatctagaatggtgataaatgctgtcatctttgtaagtataattcgtaaaagagaataatggggctccgagcatgctcctgtcatccaaaaatgcatttccactattctatcccgaatgaagcttaagttggattcaacgttaagctctttccaccatctgtattgtacataaatgtaagtactaacttatttatcataatttcacgaaattgtagaatcattatgcactttaaagtaattaacttaccgtgtgatagtttttaactcctcacaataaataagttgaaggagattgacattcaactttgcaaattctaatatggcttcatttcgtgtagtcgcgctttcataaataggaatatagttttgtgtttctattattctaaccctccggaatagtggtgtatcaagagcaagagacacttcatcggctaccggagatttcaaatgtttcaattctgatcttaggcggttagtagtgaaaacaactgcttcatcaagtactttttcaccatgagtcctcatatatgccgcattatataagcttaaaagacttcttgtgtcatcagcaacaaaactcccctctttgtctttaaaatgttgaaatatgtctgcaatgcaaaggttgatcatgttaacttaaaaatacgaacattaattgcatgtccccagctatatatgtataggagaatatgcaacacaatatagttattaggctgcatgcatgagtatacatgaaatacattatactgaaatatacttcatttaaatttctccaatctaatctatatagctagcttgtttaaaatatttcagttaccagttgccagggatgttattagtatataatatattcagttcatagatgcaaactatatattttttaaaaaaactaatagggtatcaaatccttcttgtggttttggaacagggaaagtaaaaaaaaaaggaatgttcctatgtgctaagggtttaattataggccagtagaaaatgcatgtccttgcatctatctgcaaaattattggtttgtttatttgaaaatcctaattaattcttatcatcaataaggccttaaaattaccagatgacacatcatagccgttcttccgtagaaggtaaaatcgaagagaaactaggtgtaaatctttatcgttgtagtcggtgttgtaaacagtgcagagaagctcatctatctcggccttgtagtaactatccaatccaagtcgttgcagcgtgatcacaagatccaatatctctggtacttcatttgagccctttactacctttctaacttcttcttttagcacttcagccctttctttcatgtaagcatgctgcaaattaaggaatacacgtctgtcaacgatgcaacagagaattctccgtgtataaatataaatatcagtaatgttaccgacagatggcacagatacacaattaatctccaatatatacactcatccgctaataatttactatggtaatataattagtaaaaacgcagtgtaaatgtaatactaatgctgaagtgtttcaaaatattattctatcttatttcttatgcccaatataaaaatatccatgaacactggagaaattagtttattattagagtttataacgttcagctatcacatagtgtaaaatgtctcacttattaatttcctatctacacagagccagagaatatatataattaaacaagtataattaccttaggtgcagtaggtggctggtaactgatgaagaaatcgccccagaggctggggtggaagccggtaggagcctttcgctcatcgtcttcattggagaaattagctgcaggtgtcgatgacatcttctgatctcttaacaaaaagctctttcctattaattgttgccaacctaattttattattgttctgcaactatctggtgagtgtctactatttgctgcatctcgcatggtatttatagacagttgcacaggcaggctagctgagcaagcatcagcatgatttcatgttgccaagtcagaatgatgtactcatgcttgcgtgatccacatgtgtattttttttccctgactgcttagagatacatacacacacatatgtcatgactcaagcagatacctacgagtacacaccccttaaataagctcgagagatggtagcaaacagttaggtggtgttaatttggatccagggacttaactttagtctctatatttagacactaatttagagtattaaatatagattacttacaaaactaattacatagatgaaagctaatttgcgaaacaaattttttaagcctaattaatccataattagagaatgtttactgtagcatcacataggctaatcatggattaattaggctcaatagatttgtctcgcgaattagttcaagattatagatgggttttattaatagtctatgtttaatatttataattagtgtccaaacatccgatgtgatagggacttaaaagttttaatcccatctaaacagggtcttaatctattagactaccgttacctagctaaccaacattttattaaaagcatacatttacatgtggtaactacagaaaccaagatttaaatctgatagatgaagtcatgcgctcataagaccacgactccaccaccgcactaaatatgattcatgtatgtgtttaattattctataggcaaatactgaaagtaggaggggtttcttttttaaaaaaaaatatctagaagtatgaatttccttgagaagtaccattgctcttttatcaaataagaaccaagtctggcttagtatgaaactgcttctttagcttagcttttcggcgacaactgaaacaagacgagtcattagcacaaaattagttttgtattaagtatgaaaaactaaaaaaaaattatttgatcttttaagacaatttttataaagaaaagtacgtatttaaaaaatgtatcgtttattagttgaataaacatatatactcacgataaacaaggtatgtctcgatcggttggtaggaggggccatgtgtatacagtgtacaacgtaccccttccacgtacgattgattccattaattcaagtggtcttgtttttaatttctgctgattgatttgataccagtgtcctaactaataaataggctgtcccttattttctttttatttcttcttcaaatacataagtaattacaagggaaaattctcacgtacgtgaaacatgtagtagtagctcacagtcacaaggacaaacataccatgagattgattgatgattggtacgtgtatactattctcccagaaaacattcaaatatggccagctatttatcactggttcagcttgcatcatcggtcacactcaggcatatatagcattaattaacattaatatagcatggccgatgcatgcatggagcatagccacattcttttagtgtgcataaatggactttgaactgccagcttgacacaaatatgagaatgtaatggaactcttttaatctctctagcggatctccactcgtttgttcaaacactatccaaacagtcataaaaaatatctcaaaaaattgacagcatatattcatgtaacaaacatatattgcactctgcaaaatctcaagtctaaactcgtctcatacattcgatttttttatcatgttttaaaaaggcaaatcaagcgtatgaatggtagcggtattatattcacacctaaaattatcatatcctttttttcaaatgaatattaagtttgaagtcgattttttttaagtagtagttgtgtcactctatactgtcatttgtttctaaaaaattgcatcgaatttaagagaaaaggtcccatatgtaaggctcaagtgggccaagacactcacactgcaagagctagagaagcaacgtgtggcttggattatgtcccacctcacctagctgatgcaatttatatgttggtagtcacatgtagcatgtgccctacgatgctatataagggcatgtacaatggagatcataagcacctgtggcctcaggctgtcacataggataaggccaataaaaaccacgatgtctacaatggataccactgctaaatatattttgtgtttcagcccctatctatttatgtgttagtctctatgatatttgttattataaaattaactattttagaccttctaataacaaaaagaaaaatgtacagatacccctaatctctatacggacccactgtcagcctctccaatcctctttctcatttattttctctatcttatcctcttcctctccagcgttcctttggagtctcgtcgcctccgcttcctctcaaagccgtcgctccccctctcgtgtgccaccgcatcattgactcctccacatctcaacgcagcatccacctccggcctctcccccgcgtcttctctgcaagcggcgatgacggagccacatggcggcggggacagatttggctgcgagctcgtcggctctcgccctcccttctctacgagtggcggcggcctcttcccacgagggcagcggatctggcctccggcttcttccctctccccccctctcttctcgcggcggccgagggaccaccagcggcagggaggaggagttctcaacggtgagtactcggcggcggcggggaggagttcacgatagcggatccggacgcgggctcgacgctgccgtactcctccccccacaatggtgcggacgagctcgccgacggcgtggcgagcttggcggtggcgggctcgccggatctgggcgcaggctcgccatatctggcgacgggggccacaacgggggcggttcctctcctcctcccttcttcgcgagcgtcggtggcggggagcaacggtggagaaggatctggcgaccggacgaggcgatgcacggggcttcggctccaccaacgcgtgtcctcgggtcatggcttcgccgttcccgaacccaggcgcagcgcttcgagcggttcttctgcaagcgcggaaacggcccgcggagccacggtccccactgccaccggtgcgcgcgtccgacgtggagccgtgagaccacaagctggagccacgcgttgtacatgtcctaaagcagggttcaatctttcgtcgtcggcattattttaaattatttgaattttcaaaaaaaattgatcaaatttgaacaaaattcagaaaaatgaaaaaaataaaaaattaggccaaaataatgtcatattgagggggtccgatagagccaacatttctggaattttgaacccttataagatagtgatatgaccatcaagtatatgcatacatcccagcatgagaaatataaaacatggccaaagaattcatcaagtgaatggaggatctacaagatattaaaatccaatgagttttggaatccagttcggcctccggagacagcactgacttcaaatggacctagcgccttcatgccaactccgatttgtgtgatcttggacttcgtggaaagcttatctcgccacctttcaaacgcatctggtaccatgtccaaattcatctcgagtcaacgggaatcgccaaaacaagacagtgttgttgctaaaaccgaacttgggccttgagccttgtaatagactaggccccctccacctccacgaattttaacttaaccctagatttattttcctctataaatagctttgtacatcctcaaaaatatttgggttttgtttagttgaattttgccaagtgccattcaccttgtctctagtcctcgttcgattagtcgacgactttagattcagagcccctaatagttggtgtgttgatttgccgggtcgattagatctaccacttcaatcgcaactatttctttgtgcttaatcacctattcgcaatatttagattgcatcttatcttgttcttgcagtgttctctcgtttgtattgcagggatcatcaaccgcgcgtcacggttggtacgatatcgtttgtggtgtagcgattgcacggcgtcctggacttgttctgattggtagccacgtcgcaaacatcgtactcgattatagcgagagttatcccctcaccagaagatcggcccacgagagagagcgtcatcagatagtaacaagagatcttacatatggttgacctctcttttagccattagtggccaattaattaagatgaatattttacacatgtaaatgtgatgtgaggaccaacttggtcctgttggtctagtcagactgatcgctcttttttagttagaaagaaaaatggaattcctgatgacaaaatggttgacctctcttttagccattagtggccaattaattaagatgaatattttaaacatgtcaatgtgatgtgaggaccaacttggtcctgttggtctagtcagactgatcgctcttttttagttagaaagaaaaatggaattcctgatgacaaaatgtggcaatagcatgtcgaaatcctaggagcctattcttttttttgtttcttacaaaacagtgttgtacctatctatattaattcgtctgtgtgtgaacagcaatagcacgttggaaacctgagcttatacgtatttcgtcttcctacttggtacctaaaagtgttgtctctatcatctactacctccgtttcacaatgtaagtcattctagcattttccacatttatatggatgttaatgaatctaaatagatatatatgtctagattcattaacatcaatatgaatgtgggaaatgctagaatgacttacattgtgaaacggagggagtattcatctctacttaaagctaccgcacgccgttgaaaaacgattttcacatgccctttacctcagggggcgttaatgaaaaacgtcacgcgttggtttctctagggaacagaggtcaaggactgtctgcgacagctttccgctttggaagcatctccccctcccaactggtagtgctttctctcttgcttttaattttactctacttccttgtcgatccccacggacggcgccaatgttgaaacaaatcaaacgggaatccaacaagtgtttaaggtagtcctctttctatattcaacatctcccaatagtgagccgatatacatttatataccccatagaagtacaggaaattatgaaggcagccttctcagcctctactctcctgctagggaccaacaggtgggtcccacagtaattaggtaaagttctaggggacagaggatgggactgctcccattatgcccgtttcgacatctcccaatactgagccggtatacatttatataccccatagaggtataggaaattacaaaggcagccttctcagcctctactcttctgctagggaccaacaggtgggtcccatagtaattaggtaaagttccaggggacagaggatgggactgctcccattatacccgtgtccccagggatcctgcgactcccgggtgcgtggctcaagggcaaggcgggagactggggctcctcgaccctttgctctggcaccgccgcttgtgtcaggggtagttgggcaccttgaatgcgccatcaatgccgttggtgtcacgcgccctggatgccatcatgttgttggaggcctagggaatgggactgactttctccccctgaggcttactcctggagcccctcgagggctccgcaaaggggaccttcgctagtctcccccggtggctggcgggctccgaggggcttcccaggagcaagactgtaagactccttaatcagccacgagaatggggacgacgggggatcctcggtcccatgcctccgagggcgaagccacttccccaacagcaggaacataattataatggctaatattaaataagagtccacacagtcataactcctactccgatttagtgattactatagatgaacttattttggaataaacatgaggagctaaaaataaactagttacgggaagaagggagtaataaatgctaaaattatcttgtaaattttaggtataaaggtgcggttataaccaaatccatcgaccaacacggcccatgcggttgcaaacaagcccatgggctagcatggttagctgagatcgtttgctcacaatggaggttgtttgcggaatcatgcttactggagataaattctttagtcaaatgtaaggctagatataagggttttttttttcttttgcgaagaaatataagggtcatatagacttgaattcttattccaaccacagatcaagcgttgctccagtgctgttggacacatggagttcccttggtgataattaaggttcaatatatctatcacttctgatctagaccatgtcaggagtcaatacatgaaaagcttaacaacggtgacataatattttttttgtacccatcaactacgtacatgatgatgatcataacatctgaacatttcatcagaatatttgaacaattttgccatgagatctactccaattaactaaaatatatataaatagttgggggacagaacaagatcatatggacttagtatattgcacataatattgtgacaacaagctaaggaaaacatttcttagtttaaccatggaaactttctaatgaggctgaaagtaatgattatttggtgatcaacagccaccaacacattattgaaagctagtgaatatatattacaatttgaaactctatattggataatataatatttataatgtaaatacatgttttgatttaaatgttatacggctccatatagagcgatgctatcatatccttgattgtatgtgaaatagtgaatgaatcaacttgcttgtacatataatcacccgttcgcgcaaaatcaataaccgttcttgccacgatttttggttgcaggtctgttggtgtaaggtattctttcatcatatccttccatgagtcttctatcaactcctttatcccaacgcatgcttcatgcgctgttgcaccatgttggagcatataactctgaattgtagaagcatggtggtggtcccctgcttgttcacgctgaaagattccatagcatcatgtttcagttatttataattgaagtcgaagattactaaacataaataaatatataagtgtaaagatataatggtagaaaatgacctttgttgaagcaatatcatttgagagccgtacacatgttgtgaaagacttaagaagttctggataagtcaaaaggcaatcaagagtttcctttgctacaaggtcgcccatcccaacaaaagaagcacatgctagttcaaaggcaccaacagtctttcttgaaagttccaggtgttcctctattgtttttggaatgtaatgatcatcacgccattttatctcttgagagaattcttgaactaacctcttgaactatattagaggtgtaaaaagtgtagtgttaattcagccgttatacgggcataattttgaagaaatatcattttaccaaaaaatatgattgagtcattagaatgtcataaataaagtggttaccataatttcctcttaggataaaacaatcagtattgttcgttgagttagatatattctattaaaacatacaatcaaataaatatttatatgtagaatataactaacaatgaagttgttatatagtttataacaaaatttgtatcataatcatggataaataactatatcattatattccaatctatctaatactcgctccatccaaaaatataaggcgcctgattcacatggtcatcaacattgcacttttgaccattaatttgtttcataatatatcatcaacaactatgaaaatatatgaaggcatattcaaatacagatctaacataagaatatggtaactacatattgtcatttattttacaacccattagatatatcgatgtattaaaaataaaacaattctacatctttagccataaatagttttggggtagaatacttaccaactctttgagataacacactcgataacttttgtttggacatagtgcttcttcaaatgaatcaaatgtctttaaataatataagtagaaatccttcatgtattttggaagtagcactgttgcagtttcattgcacctgtatgttacaatatagtgccatttaattttattcacaattcaaattaaccaaaagtgcaatcatgtatggaaccgcaactcaaaatattatattagctatagtggtttttttaataaacgaaagaagactagtaaatttgtctagtatatacatatttattggcattaacaaattttgacatacatcagttcttatgttatttccatggcagataatatatccaagataaaagataatgttcgtagcttgattgtcttctctaccttcctaaactcctaaggtaaaataaaatggcaagcattatattcttgactaagattggtgtatggcacgatgtagcttcaaagtactactcatggtcagtcatatggtagtcactgaagcagtgtcccaaatataaccgttgtttgcactgtccgaaatatatatggcaaaattgtcatttcgtgtccaaacaatctatccaaaatttaatattttgatgtgtgcactatgatgattactctagaatttttttcatctaacattttttctccactgctctcagtctatggtatgtgatgttcgatttaattttttaggataaattactgtaaatgaaatgaatgaattattttcaattttgccctgttttatatctatgtttttactcttgtttgtttatcatcatagaataatcttgataattgcaatatacgtaaacatgatatttgcgtgtcattgcctttatcgaatcgattttagaaatattaaattacctcaaacattggattcggatatgattcaagtaaagcattaacttcatgttgcataaaacatgcatagcagcaaatgccaactattattattgcttttaagcaattattatagtaaatgcccaaatagatttactgtttctggtgcttatttttagagaaaactgttttccttgatctttggtaattatttaggagaaaattcaatccacctactcttttactcaattaatgagacacacatgagattaatattttaagatgttatggtgaatacattactagtatttaaactaaaaatgtgtgcatcgcaatatatagtattcatattcataaaggtccttcgctccattctactatgaattttttaatagttgactcctgatgttcatcctacagtgaaatagattctacatacaactggaaatgtttacacttagtaagaactagctatacaactggaaatgtttacacttagtaagaactagctacaatataaagctacaattcatattagcacatattgtaatgaaggcttacatatatatcgctttggcaagcatcatgctctcctcggttgtagcatatgtgtcaaatatatcatctagtatggtgataaatgctatcatctttgtaagtataattcgtgaaagagaataatggggctccgagcatgctcctatcatccaaaaatgcatttccactattctatcccgaatgaagcttaagtttgattcaacattaagctctttccaccatctgtattatacacaaatgctagaaattacttatttataataatttgagggaattggataatcattatacactttaaagtaattaactcaccctgtgatagattttagctcctcacaataaataagttgaaggagattgaaattcaactttgcaaattctaatatggattcgtttcgtgtagtagcactttcataaataggaatatagtttcgtatttctaatattctaaccctccggaacaggggtgtattaagagcaagagacacttcatcagctgccggagatttcaaatgttccaattcggatctaaggcggttagttgtaaaaacaattgcttcatcaagtactttttcaccatgagtcctcagaaatgccgcattatataagctcaaaagacttcttacatcatcagcaacaaaactcccctctttgtctttaaaatgttgaaacatatctgcaaaggtgatcatgttaacttcttaaaattatggatattaagtgcatgtccccaactatatatgtatatgagaatatgtaacagaacataattaggctacatgcatgagtatatatgaaatacattatactaaaatgtataaatgaaattttatgacaggtacttcaattaaatttctccaatctagactgtttgttgtttttctaatatgatttgtttaaaatatttcagttaaccgcagcactaatttctactagatgctaggggtgttattagtatatatttagtttatagatgcgaactatatatttttcaaactaatctataaggttcgtattgattccttcttcgagatctttgaatagggcagttggataattggaatagagtagaaaaaaaggaaagttcctatatgctatgggcttaattatataggacagttagaaatacatgtccttgcatctatcatcaaatactttgttagttgtttctttggaagaaactaattaattaattcttatcatcaataagaccttaattaccagatgacacatcatagccgttctttcgtagaagataaaatcgaagagaaactaggtgtaaatctttatcgttgtagtcggtgttgtaaacaatgcagagaaggtcgtttatctcagtctcgtagtaactatccaatccaagccgttgcagcgtgatcacaagatccaatatctctggtacttcactcgagccctttactaccttcctaacttcttctttcacaacttgaacccgttctttcatgtaagcatgctgtaaattaaggaagacacatgtttcaaccattcaaaagcataccatgtatacatataataaataatcagttacctatagaaggcacaaatacacaattaatctccaatatgcactcatgcatccactaatagttttcgatggtaattaataatatagttagtacaaaacatggtataaatgtaatactaatgtgaacatatatatttctcaagataaagtctacattattcgttatgtccaacaaaaaaaattccacgaaaactaagggaccgttagttatttagttatagtttatttataaagttgaactaccacatagtgtagaaatgtcacttactaatttcctatcaactgagaatcagatagtatatatatatatactactccttccatattttaatgtatgatgccgttgactttttaatcaacgtttgactattcatcttattcaaaaaatttatgtaattatcatttattttattgtggcttaatttattatcaaatattctttaagtataacataaatatttttatatttgcacaaaaaatttgaataagatgaatggtcaaacgttgtttgaaaagtcaaaggtgtcatacattaaaatacggagagagtatataataagaaagtaattgccttaggcgcagtaggtggctggtaactgaggaagaaattgccccagaggggtggaagcttgtaggagcccttcgctgtggctgctcatcgccttcattggagaaagctgcaggtggcgacgacatctcttagcaaattaaaattctctcttctattgttgccaatgtaacctaattatatttctctgcgactagctggtgagtggctacgtctgctgcctcgcgtggtatttatagacggttttgcacaggctgagcaagcatgcatcagcatgacttcatgttggcacacgtcaaaatgatgtaagcatatgcttgcatgatccacgtgtgtgtcatccttccatgattgcctagagtatgtcatgatgcaagcagataccagcgagagtacagacccctaaaactcggtgagatggtggccaacggataggccaggtgttcggttcataaccacactttatcacaccacacatttaaccgtcacaatttgttagccatgtgtttggttcactctgacaattataccttgccacattttcttttaatcacatgtcccacacatcatatactcaattttcttgctaacttttccacactttattgctagcaatttgtccaccacacttttgtggatgcctcgacttgacctaattaatctttgttaggggtaaagaatggctgacaaccaaacacacccttaatcttttatagtgtgttctcaactacacattttcaacttctagtccctcatttaattcttcgcacgcgtgtttcccaaactgctaaatggtgagggttttttttaaaaaaaaaaacctatacaaaagttgttttgaaaatatcatattaattattttttaaagttttttttagcgaatacttaattagctagttagctctgagccaccccttttttacgtgcacaggagaaaagttcctaaccctctcctccgaacacacatctaatagatgaattccctaaaaaaaacatctaatagatgaaatcatgcatgcgtatgtaaggaagttgggagggtttcttattttccaagtaaatgtctagaagtgcaaattttcttgggaagtaccattaattgttcttttgtcaaataagaacgaccgagcctggcttagtatatatgaaaaactgcttctttggcttagcttatcagcggcaaccgaagcaaaacgagccagttgcttatagctagttgagtcttaattaagtattgaaaactgaaaaaaataaatttatttgactttttaagataactttcatatagaaagtattttaaaataaaataatatcgtagtagataggaaaatatgcttgtcataaacaaggtagtagtcattgcaatttgcgaagcagtttagacagccttaactcgatcagttagtaactaacactaccacgtacgattgattccacgcattagtgggtcgtctgtttaatttctgcttaattgatttgatacaatatgtcctaactaaataggattatttcctcattttctttttatttcttcttcaaatacaagggcacattctcacgtgaaacacgtaaaagctcacagccacaaggggaaacatatgacactgagtggtatttcctccgccccataatatagcaaatttatttttgtctatattaattcataaatgtgtcatatccctcaaaatctcttatattataggtcagaagaaagaaataataggtaaataccactatcctcccagggagaacttgcaaattggccagctatttctcattggttcagcttgcatcattgatcacactcaagcatatatataaagctggccgaagcatgcaagaagcatagccaaattcttttaattagcgtgtactttgaaatgacagctcacactcaaagggaacgttaataccatctcgttttaatctttcagctgaaaagaacaccaccttagggcccctttgaatcgtaggaataaaaaaacagaggaataggaaaaacacaggattctgacaggaatacaattgtaaaacagaggattgcaaaacacaggaaaaacacaggaatggccgtttgattggaccacaggaaaaacgcaggaatcagatgagagagatagactcagaggaaatgttccaagaggttagacctcttgctaactttcctccaaaatgtgcataggattacccattccataggaattttaaaggattggataggattcaatcctttgtctcaaaggccttcatagcatttttttttccataggattgaaatcctccaaaattcctacatttttcctacaaatcaaaggggcccttaatctctccagcaaaactcctctcgtctgttcaaacactgttcaaacagttacgaaaaaaatcccaaaaaattgacaatattcatataccacacttcattaaaagtctaaactcaagacatcgatttttattaaaaaaaagagataaatcaaacgtctgaacggtagtggtactattcacgcctaaaattctctcttttttctgaatgtatatcaagtccgaaattgattttctttcaagtaatagatgtcactctgttgtcaattgtttctagaaatttgcattaaattgaagagaaaatgccccatgtaaggctcaagggtcgacaaattagataggtgtggtccagcacactcatactgtaagagctagagaagcaaataatgtgtggctcgcatcatatcccacctcacctaggggtaatgggcccgtgctctttgtacaacccatcttagctcttaaatatttttagcttaaaaatctattaaatcttatcctaatcttttttgacacaactcttatatatgtttataggctaaaatgttgggcaccttacaacccctaaatacattatgttggtggtacataattaaacagcatgtgtcctatgttgtatatacagccgtaataggatgtgttccatatatatgttcgacctgtctttgagcaaatagtggtcaagattatgcatattttacaaattaaattcaaatgtaatgtgaggcccaacttggtcctgtacgttggtctagtataggactgattgctctttttttttccaaaaggaaaaaagggaactcgtgatgaaataatatgtgtgggtctaagtacatagcacgtcgaaatctataatgttatatttttttgtttcataggttacttacaagtgctgtccctatatatttatacgtctgtgtttgaacagcaatgacatgttcgagacctaagctttatacgcatttttgtctcaagagatgcctaaaagtgttgtccctatcatctattcatctctacttataagttactccctccatcccaaaatgtttgatgccattgaattttttaaaaatatttgaccgttcgtcttatttaaaaaatttaagtaatttattgttaaatatacttttatgtatacatatagttttacatatttcataaaagtttttgaataagacgaacggtcaaacatgtttaaaaaagtcaacggcgttaaacatttagggaaggagggagtataacgataccaccgttctcatgcatatgggccacaatttcgaaggttccccgagttagacctagccaagtactgataagctgcccgctacagtaggtgggatattgatttaatcacctccctctaccataaaaccgggtataacatctcctccatatttaaaaaccggtgcaaatcaattcctttagttgtttggaaggtggtttcagctgacgtggcatattgaccgcaattgactagctaagtcagtgggcgggacccatgtatcatcctaatcttatcttcttcctaacctctcctaccctctctctcaccaggatgcaccgacgacgacacgtcccacggaggcagcaaaccggcggcacccactatcaacgccgcactccgatcccaacctttagttctccgggacaggcaacttctccagttaggactatggctttccggtcggggtcgccatgagaagtggcttgggaggatggaggagcataggagagtggagtagcaggtcatcgtaccactggcctcccgccactgcatagtctcccatgggagaagggagaagtggggttgacaagtgggccccaccaattttttattttttactttggggcaattgcgcatctgaccctgttttgagacctaacttccaatttgaccctcttttttcaactttgctcatttgaccctcctatttaaaattgaagatacaatctaaccatcttctattcagggcatgtaacggtgtcaattggaacaaaaaaaataccccttctgcccttgtttatttgactctattttatcaaaaatattacaaaattttggattcgaaccaccatcctcttcaccacggcggcgtcgtcatcgttgccgacccggcggtggcgcttgcacggatgaagat

SEQ ID NO: 18617 - DNA, 17534 bp, Oryza sativa
  unsure (1)..(17534): unsure at all n locations
ttctattttaaattttttatgacgctgccacgtcaacatacttaaaccaagtcaatgtgccacgtcatcagaaaatgctttcaaaagcagcgaaggagtcaatttgcaccggtttttaaagttcagggaggcattatatccggttttacggttgagggatgcgattcaactaagtgcaaaagatgagggaagcaaaataaacttattcctacattaggtaagtttttgaaccccaagagtctagtagcccacaatatatcatttccagaattttttaatttatttttgaaagatttaaaaataagtcgtcgttttaaagttttgcgaaattatactcctcccatcctatgtaggacgtgctatgcgacgtggcacaaggctggaggggcgcaccatggtaattttgcaggcgccccttctcgccctccctgagggtgatttatcgccggagaaggccggctacaaaattgccatagttggtccctcctacgggttccattgcacatagattgtcttaccatatggtgatttatatgccccatcctatggtagggcgggaggagtatatttatatacaactttgaaatggaatttattttttaaaactcttaaaaataaatataaaaataacaaaaaattcatcatttccaatgcttgctttttaaaagagtaaattttgtagaacttcggatttatggtccaaattatagataaccactgaaattttgacatatatcacataatcacatatgttcctttttggtattgtagtttcacaagacctcaccttaattagattttaattatgctgacatgtgggacccgcttagctctacttggtgtaatcgtatagatggggcatatagccggcccaatggttggaataatcgcgtccacacgtactctgtagaaatcgcgagtcgcggcgagaagcacacacgcagccggcgcaattgtcgcacgtacgatcgcctgaaatcagtacaagtatatctatgcaggcaaagttccataaaccaatttatatgtatatataataatctcatttttacaacacactgttaaatgtaattgaatttacatcaaattaattagcctgtcgtcatgtcactgattgagtcatatacaaatcgatagcatcaagattggctactcgatccgtatttgttaagaatcagccccattgactcaatcaagtatgatgccgtttacagcagcaccaggaggggatggcctgatgccggccagcgacgagtcagacgagaagcagggggaggcgacagcagtttaggctggtcagggttgtcaatttgcgtaatttcgcaccctaccggcattcaaataatatccgtcgaaatttttggttttttttaatttggtcaaagtttattaaaattcaatcaaattttattaaattttcaaataatttcggataacagaatgaaaattttcaaaaaattcggtgcaccaaaatttctgaaattttagcccaaaacgaaattgaccacctcattcggccccagcctcacacaaagagaggagaagatagagcagcagtgagagagagagaggagagaacgagatagaaattgactgagtttaagagaaaacttggcagtgatagcatttttcaattttacaaaatttcagtgacacctagctgatattgtgaatagtaatggtatttttttaattcagcatatttgtaatagcatgatcaaattaatccaagataaaagtccgtatactattttaaaaacgatttttttcatggtgccacacttttctttcgctagcggttgatagtgggtcccacctgcgaaggcatatcccgtggggactggggagggggcacggcccactggcgtagatctattatcaccgatgggctacgtaagttaactgccagcacaaatatctgcattttaacggttggcgtctaccatcgcaaatagttatattcactggcctttggtttctgatggcactactaaccacctgcaaaagtccattttggccgactggaaaaacccattttatagagtgatattataattcttatattgaagaccatgctagctataacttactaattattaatttcgaatttttacgttaacttaataagatactaaattgagtgtacaaaatagacgctgctttgaatttattatgaatactccacgaacgagcgaattcactcgttccaaaagacccagtaggagtattttcttgtgatttagtttaaataaacaattgctgctgaaaaaagaaacaatcatccttagatttcatatcaatattttataactgcaatactacataggatcaggatctgaatggtccagcaaggctttgaacacaagtttactgtgacatggatcatgatcctgacaacctaggcagtagtaacaaaagttcagataaaaccctggaatatggcatagcccagagtcaggacatgcactacatactaggtcagagtaaaacatgcaagcaccacttttcaagggaaacaccaatcctgaaaacgtggcatcttgactcaaaaccaaagctacatgtgctcataaaataaatcacatccaggactcttccgttttgattcagactaattaacaagagcttgtgtcagaaaacacccagctaggagacatgcatgtgagcatctgtgattcagatttccaaagcattctgaaatctgggaacaagctgttagctgaccccatatatatatatgcagacaaaagccctcagtttgcattgccttgggcttcaattgacagacctcaactctcttgttttggaacttcatttcatcagcactagtaactgcaatgaagagttccatggtattggcttctgtcatcctcctgatcatggcagcaacagctcatggtaatgtttcaggacaagtaatatctaatactcgttttcatatttgagttcagctacattttgtttctacctctcattgttgtgtatcatgaatgtaaaggtactgattcttgttacatacaatccatttcatcttgtataggacttaggctggacatggggttgcatgcagctctgaacaatgaggtcagtacaatctgtgagcctgaacacagctccactaattaacatgctgaatcgcagcacggaaatgtagtgatcaactgaacttgaacacctaaattgacaggggatgctgaactccaaatggcagtcaactgctaaccgtccgatcgacacgcgtcgcgcatccaacgacaggcgtggcccaggtagaagtagaacgaggccaccgaagatgagcaatccccatgacatggatccaaggttcagtgaggactactccgggcccggtggtcattcaccgaatcaccaccgaacaactccctgcggtccatgctagattgcaagtagcagatagatcatagatgatgaaaacttgtccagttttctctgaagatgctacctccatcaatcttcagaaagatgaactggaccatgtgagctctgtggctcactagtttttcagcacattagttagttctgaagagtagtttttcttgtatgatttgattatgtccaattgaattcagcttcagtctgaagagaactgttaaggaacaggattagtactgttctaggattgtcattcaggcaactgtaccggacggctacatgtcattcgacagtccaatcaaactgtcagttagagtaaactcaggcttaaaattatctttgttttcttgttctcaaggcattcaggttagacagggttgcaggaaacgctgcgcctttttgaaggagagtgtacagtttgtgctgcaaattctgctccctaacaaaactctgacgactactgatgagcagagagatgattgcttatctcttcgaatgtcggatgcttcctggataaagacaggggagacagctgcaattaaaataagaggagagatttctttctcaagcaaggcgttagtggcaaaattatattcatatcacagttgcaggagcttacaaagttactagcaccagaagcaaaatctcaaactgtactcctgagctaaaatttgatttctttggcactatttacacattgaattgtttcctgtagacaacaacaacatatagcaaagcccagacgactgaaaacagttatcatttgattcagtatgatgtaatccatattcaggtgagcatttcgccccgggtgatgcttaaaaaaaaaagaaaaaggtatgatgtgatgcctattattgacaaaattctctaggttatggagatagattcatgaaggaccagcaggatacttctcaatcaagtcgaataattcatctcctataccgaaaccaagcatcctggccatgtcagccgtcttgagtccaggtttaggatgttcctgctgctttagccatgagtaaacaatgaacaccttcttcatcacaaacagctccagcgcctccgggttgaagaccacaccaagcctcatgctcatctgcagatttttgcaaatatgaattcatcttaaactccaaaacgacatggaagtatatgtaggaccaaattatttggggatgcaaaattcaggttatatcttgttacctggtgaggggccagcattgcggcatatctggcaagttcaccagctctccaatcaagcacaacagggaaccaagggtaacaagcatcaagcctcacaaaccatagccttatatcagggaactctgacagctccctcacatcatatggatcctccctctcatagtttatagtaaacccgaccgttcgatccaagagatttcttgtttgagctgaatgatacacataagattcttgttaactataacatggaattgactgttgaaacaatacaatgtcatgactttcattgttgcgcacctggtgtcagggaattcaagtcaccaagtacttcatgaacaggcgaaaggtcgagcgtccggatgatatcggtgttgatgacaatctcaaagcgaccttctgtaggtggtggtggaggctcaacttgtggggcatctacagcaagccgtcgaagattgtcatttgcaagcaaaagaaatggatttaccaaatcaaggaacaggtgcatattatacacacagaacgactgataggcaacaaataaagttttaattgtaacaaattttactaggtaacatgaggtcaacccagcatgaagaaataaaatcacttccacccttgctttgtttcaagcataataacaacttttacccttcagggaacctctagcaaccaataaacagggtttcacataaatgaaccaccctgtggttaattaggcatttccaagccacatccctcccatgcaattgaagtttgagaacatctttgactgaatcaaacgattgagtgaaaagctcaaatgttttagtcataacaagattagtattcttgcaatttgcacatcaactgcgatggttatcaactgtgatggttgatgtaacttcactaagagtcaatcatctcagtcagatactcatatgtagcagattgacggtgcactgtaatagttagcaatggaagaaaaaaaaacaagtcagtagtattgtcttactacagaaaattatatagttttcaaactcaaacacaaaactgaataaaatacggaattttggttttcaaccgctctccatggagaaatttatttccaaattggcagtagtttttactcctagtcgctcaccgtcttggtcggtggagagggagaggtcgaagttcccggaggggttgaacgcgacacggagacgaaacccctcctccgccgccctcctcgcctgcgccgcgacgggccaccgcaacccagagtaccgacccaacgagccgctgccggggaaacgcctcagcgtcagacgttgcgagctggccactgggagttggagtgcggtggcggccatggcggcgacggcgacgcgatggacgcgcggccgccggcggcgaggaagagaggtgaggtcaccgcggcgggagacgcaacgccggcgaacggtcgtggcttctccccgccaaattttattatcctttaattatctcgctttttcttcttctttttttattattattacaagtaatttatatttattttttttatggaacagcacatttgtgggcccatatgggccttttagcttctcccggcccggcccatgaaatgtgcggcccaatttgtacagctcagctcctggtgttgactgtcgagacaaagcagggcacagatcacatgcagtttgacatcatctaactccattttcttctacttcaaaattcaaggttgatgaaatatattaacccatgtgtttcacatacacatgttcgtttcaattttttttttaaactagtgcgtgcatgtgagatgaatcctcacaaaatcaaaagtagtatggcctttcagaacatgcatgccgtcgttttggagctccaactcttgttggtatctgctgtgcgtcaaacgataagacatggaactttcttagctcaaaaaagataatctttgctcgattatatagagacaaaattaacatgcacaaggaggtcgtgacccatcacaccaagtttcatcccagcttgaaaatgatattagttgcataatgccctttattaatgacatgttataatatcacttgatgtgtaaccgagcaaaatttggatgctttcatgcttaggatgttgttgagccgttttccatacatatatatgatatatagtcactccgttttcgaataattggtaataacactattcaagtttaaattttgaccacttgtttttttatgaaaatttataggtattcaaatatactccctccgttatatcatcgagtgtgtgtagcgttataaatataatcataaaacttttattcatcataatatataaccatttaatagtaattagcaaatcattttagtcaaattgttagttattataagcatgcatatgtaacctattaaattttcgtgctttatcatgtgttcagtgtgataaaatcaattaaataggtatagttatatcctggtatatgttgtgtacaatacaaatacaaatatgaaacccttcacaagttcgatcacatgcttctttctttccgtcgttacacttattataattgcgttgacaatatgtaatgattttttaagaccatttaccggctctgccttccattggaaatcacaaactatttgcaacagcgattacaagtggccaaagaaaaacactacgtacgtactgattcaatttcttttccccatttgcggtatacgtaagttgttcattaattcagccggtattatacgaggtgacataaatgtaatcaaaatcataatgcaaacacaagtacccatcaactcatataattaaccaatctgtgtgttactctaaataatcatcgtcgttagctagctgaattaagctgtaccgtactatatatatacttaactccacatgcatatatgtctgcaagacggcaacgctgtatcattgtcctagatcgatgcccttatccactgttttggccagtttcaaaaaaaaaagaaaaaaaaaacactgtgtggcccctccacgtttgcaacgtttctttaactagggctcaacagtataatatgagatgctcatcatcattgacatgctgtctaattaattattaagaagttcacataaagatggagtttaacctaagtcacctttgtaagaggtttttttttgggggaaggaggtgacgattgaagaccttcatctttgcatcaactccaaagtttcttagaatatatgagcatgattcatgtatgctcttgcttatgacacgttttctaacctaaaattattaaccttcgagagcgaatccaggataagattaaagggactcatctcctttttcctccttcagccctctaactttttcacctctcctcttcttcatcctcccctctctccttctacatatcaatggtgatctagtggaatacggaactcaagttctcccagcatctacgcacgttggatccgtcccagaatccagtatgccttgatctcagtggtggagccctgtagccaaatcttatatatatagaatttcgaagttttcgggttttccgtttatacaacaatatatatgagtcgtttatgaacttatttacaaaacctgtgggggatgacttgacatagtctatatatactacatagaacttacagtaattaacaagttcagatataaaatgttcacaacctcatcaggagaagaaattaaagtctcacacgtgcatgcatgcatccgtgcattcccgttcttcttcattcactcggtaaggacgactctgtgcaacttgatatatatagatcacatatatatgatgagcatgtttcacgtagtctctgtggcttacgcgctgtctagccctaattaatctaacttaatcccctttttaactccatctaacctcccacttgcactaatccatcattcccttgacctaataactaccccacatatactgctatagtgctatatatacatatatatagaacccaactcaattttaaagcaagctaaaagaagccgatagacgacgacgacaacgcgccgaatgggtacggccgccgaacaaaatgcagagcctgaagaacaagncaagtttcgtggagtgccgcggggaaacgccggcgtggggttcaacgaggggcggtggctgaccagggtgagggagagcatggcgaagcggccgtggaaggagctcggggcgccgccggtaaaggtgttcaacgtgccgagggtgctgaggtcgacgaggcccgaggcgtacgcgccgcaccatttcgccctgggcccctaccactgccgccgccccgagctgcgcgacatggagcgctacaagctcgccgccgccaagcgcgccgagaagctcttcgccgccggcaagaggttcgacgacctcgtccgccgattctccgacatccacgacaagatcctcgccccctaccacaggtatatatgtactgtgtattgcctagcttccagctgaaactatatacacttgggtttgtaaaacggacactaaccatgcattagtctataattaatcaaatgtttagtgccataaacttgaaattttgatttattgttttaaagaaatttctattaaaagtgttttcataaaacgtactcgctctattataagccatgatcaaactcgacatgattttcaaaattaatctttggtttataatttctcgtatactgtaaagtttgtagcaacaaattataaccgtatgaaacatattcaaatctcaatccaatgatattattttcagcaaataaaaattcatattatttatactaattgttggtaaaatatttttaaagttaatgttgaaatatgtgtgcgccttttatattatttgatggacggagtatcactgtattagagagaaaaataaaacgcttgtaccacaacattttctttttagaaatcacgctcatggatgacaaattgtagaattgattactaattgttagcaaaatgtccctcaataaacataaacaaagacatagaccctgtttggatccggagggctatctattaaatagccctccagaatcttgctatttaaaagtattaaacgtagattactgacaaaacccattccataacccctagtctattttgcgagacgaatctaaagaagtatattaatccatgatttgctagagtgatactcactggtggagaaaggggctttactcccggttcgtaacccccaaactgggactaccaatccgggactaaagatagtgatctttagtcccgagtgaaaaaaccgggagtaaaaattcatctttagtccaggttggtgttaccaaccgggactaaagatagagcctttttagtcccggatggtaacaccaaccgggactaaagacagagctagcctagctagatccgattgctctattattattttattttcttcattttgtttttaatatattgatttcactccatccccatcccaaaatcccaaataaattatccccaaatcctcaaatccccaaatcggccatattcaaatagatcacaaaatcttaaaacaaaattacatcacaacttctacaaaattcatcacaaatatatcacatattcacagacatcacacacaaatcaaatacacagatctgaatcacaaattcttagaaaaaaaagaaaaaaaaacacaggctgctgcagccgctgccgcgccgcccgccgcgaggccccgcggtccgccgccgcaccgtcatgaggccgcgccacagcgccgtccgccgccgcccgggcctctgcccgccggtgcgccgcggcgaggccgccggccgccggatctatcagtgggatgatggggagggaaggagaggagttagaggagagaagttagagaagaggaagaggaagggatgctgggggagggaaggagaggagttagaggagaggaggagaaggaagaggaagagatgggatgaagagataaggtcagtggaggaagaggtgaagagataaggctgctcgtctcctcctcctcgatctcgcagatggcagatgcctcgtactctccgccacgatcttttgttccggttggtaccaaccgggactaaaaatagatctttagtcccggctggtaacaccaaccgggactaaagattaaaaagcagctctaaacttttgaaccgggactaaagataatctttaatcccggtttttattgtaaccgggaccattgtgggttttggccgaccgagcaaagatggtttctccaccagtgactacagtaatcagccgctaattatggattaatatacatcattagattcgtctcacaaaatagcctagtggttatggaatcggttttgtcggtaatctacgtttaataattctaaatagcaagattccggagggctatttaatagcccggaggattcaaacaaggccatagtggtgacatgacactctcgttgaaagccaacactaacaatcagacggaaaatagaagattaaaacttgagaaggagattcgtttagacgacgctcctgtcaaaaccgtttgatctcctctgcgttaattccaatttaagaggtcaagaggatgtgttagtcgtctaaggcgagtctgagattatataagtattatgcccaaaatttatatctcatgtacgggtcttattatatatttattttcatttttatccttgcatctatcctaaaaggcaatagccaataggaatgcagctgagaaaaaacgacaagcaaaaacctttgacatcgagcttgtttttgaccagttggcttgatgtagctttcaagaaacaacaacgaactgggctatctacgtggcatggtgtaatctagcacgtagatatatatggctatataaaaccatttctacataacatcattatcttacgtatacataagaggattaagttaggtagagagaattgacgcgttaacatctcaatgagcaactaattgctagaataaatcaccaagcttgcaagagagcgaataagttagaaagtcaccaagctagccaagtgagaatgagtatcctcttagaaacgcccaggggttttccggctagctccataaggtggtggactagtcgatctgggttcgaagctccatcccttctaattatttaatattagttcctccctaatattcgcgtattttagagcgagtatcctctcgttgtagtggtgtagttgtgggtctacaaggtttaaattctagttagttgtgtgttcatattgttagtccaacctcattgttaatttgtttgctgagtacattactagcaaaaatgttcatgctttgctatggattaaaatatattataatatatgttataaaaatattctatcacatatggcatagtatcacttgtttgtttattttaatataaaatattcacttttaaaataaatattggattacttcataatatcataaattaattttgaaaaatgcaaaagtagtggctaatattgtttttatagtatagatagcaaaagatttttgaatttttatattttctttaccattttcttttctgatcagccttggcttctaagccacttagagctagcggaaatatatagcccaaccataaaattatttttaattgactcgcttattttctatgccttatcaactgaggcgaccattaatgcccaaaggtaagtaaataaacatactccttcatttcatattataaatcattttttttctaatcaaacttattaaaaattcgattaagtttataaaaaatgtagcaaacaccaaattagtttgattaaaactaacatttaatatatttttatagtttgtttgttttgtattaaaaatattgctatatttttctataaacttgattaaagctaaaagagttaactagaaaaaaaatcaaaacaactcataatatgcaacggtggtagcactaaaaaaaaattgaaactgtgtttgtggttagtttccccaattatgggtttgcctttgtaattcaagcagtttcttgtgctaaattaactcaatcaaattaacacataaatcgatgcatgtacgtaggttactggagctgaacgagcagacgctggcatggatgatggccatcgacacgtgcttcctcctcgacttcctcgagagctaccaccgcgacgaggccaccgacatggtctcgtcggcggccaactggatcaacgccgtcgtgcgcgacgccatcatgctcgagaaccagatcccgctcttcctcttcgccgccgccctcgagctccgccacggcaccgaccaggcccaggccgccttcgccgccgccgacgcccttcggggtgttctcggccgcttcatcaccgaggtgtcccccatcaagaccaccgccagcgccgccctcgccgtcgccggcgacgacctcgccaggcacgcccacctgctcgagctgctctaccacttcctcgtccccaccgacgccgtcgccgaggccgtcggtaacgagccgccgccgctcgtccccgaggacttctccgccgtcgacgtgttcgaccaaatgcagaaggagatccccgactacgacaaggtgaagcaggcgtgcgtgcaggtgtccagcctcgacatggcgccgatccggttcatcaagaagaacctcatctcccggccgatgggcctcgcggcgagcctcccggggaagctgatgcgcaaggtgccgctgctctcggcggtggcgccgctggtcgggaagctgtggtcgtcttcgtcgtcggcggcggacatggaggcgcggctcaagggggtgaacctgggcaccatcatcaactccccgctggcgcaggagctgatgatcccgtcggtggcgcagctcgcggcgtgcggcgtgcgcttcgccccggcgcccgagggcatcgccgggatcgagttcgacgccccggctgcgacgctgaagctcccggtgatcaccgtcgacggcaacacggagacggtcctccgcaacctggtcgcgtacgaggcggtggccgtgcgcgggccgctggtgctggcgcgctacacggagctgatgaacggcatcatcgacacggccaaggacgtgaagatcctgaggcagagcggggtggtggtgaaccggatgaagagcgacggcgaggcggcggagatgtggaacgggatgtgcagggcgacgcggctgagcagggtgccgaggctggacggggtgatccgggcggtgaacgagcaccggagcaggagggcggcggttcggctgaggaggatgatgaagcgctacgtgttccggtcgtggcgggtgctcacgctgctcgccgccgtcgtgctgctgctcatgacggcgctgcagaccttctgctcggtgtaccagtgcaaccgctggttcggcaacatgctgcagatgccgcagcctggaggtaaagggccctagccctacggccttgttttgttttcgggagctttctagcagctgcagcttctctctgtattgaaaatatgcttgaacggttgaaaaaaaaatcataaatgttataaatagtaacaaattcagtatctaaaatttcatggacttgttgatgtacatgaatggtataagctgatacctgtaaaattcgcgaagttttgtgtgtgcttttacccatatggtttagtgtatctctactccctcccaccgcaatgctctgcttggcacgatagagccgccgacgaggtgttatgggctggtttgttccatgtcatacgggccgtaattttccgggccttgccccgaaatccctcgagcattagcttacacgggctgaaaacaaggcgtttcatcggcccaccaacctggatgaaacaacaaaaaataagtctattcaccttcctcctcttttgctcctaactgaaccgcctccctcaaccgtaaaaccgggtacagcacatccccatctttaaaaaccggcacaaataaacttattcagtgatttgggaagcggtttctgcttacgtgacaagttgatcgcggttggctcgatgagtcaggaggttggacccacatgtcatcgactatcatctatccccccccatctccctctcttctactactctcttttttttctcctccttgctcctcaacgagtgcagccgagtggcactatggtggctacgggtcttggagatgaagccactggatcggtagcgagcagtggccggaagagcagcgttcgggtgaggacggatcaactcggcgtgtgggcgacattcgggattaaggaggtagcagtggtggaggtgctacagcgaggggaactcagcatgttggggttcacggctatcagagaagcacggacatctagcgatgagtgggcttggcaagaggtggtggggtagaggagatcgagtggtggatggcatcggtggggaaaaagagaaaggtgctggagcaagaaggtagagacgttgttggacctagggggagggggtagccggggcgccagaggcatggagcaggttaacctcttgattgtttgaaatgttcttcatcctcgtcatgttcttcgatccaccggtccaagggacggtcatgacgtgtggcgcaaatcatggtagcaggtgaggcgtgcggcaatacgtagatgacaacgagcatgaccttggcgtcattgatcctggtgaggaatgtggcctcactacctcaatgccggaacgccgccgccgctgccttccgatctcctgcttcctcccacgccactatagcctccccgagcttctgctctaaccgtgactctgaggacatggatggagcctcgtctctaaggccgttcccagtgcatcacacaaatttgaggaacctcgaggtgccatgtaggctagagctacaggtccaacctttgggttcttcacagtgcaagtggctctaggagtagctttaattttgtattttagcccctaacactttatgtttcagttctcatttttccaattantgtgtaggtctaaatttacaaataaacaccctcaaatctagaaaaaatattaaaaccccctttcccctctctctcccttatcttttcgctcatctcgcattctcgttgcaactctccggccgatgcgcctcccctcctccatctccagccgccgcgcctccccctccttcggccaccgcgcctcccccaactcctccagcgccactctccctctccccaccggctgccccctatctccctccccatctccgcgacttagagccaacagtagctcgacgctggcaactccgcgcccctcctcgccggatctggccttgggcgatggcgggtcgacgacggcgggggcggcggtggcggctcgacggctagggcggcaatggctcgacgacgggggcggagacggatgacgatggcggcgacgggtcgatggtaggggcggcagcaagaggaaggtttgcttcgcattttgggacatggtctctacaacgtagtgtcgaccctctctcgccgcgtcacagggtttcttcctgacaagttatgacgaggtttgggtggccaaacgatgctccgcgtacttcataggggctcgctccacgcctagatggctcggaatctctgcgctggtgaggtaaggccgaacgccacctcaccgcactatgaatggcctaaggatacagatggaaccgaaaattcccttgcctctaagaatgcactgccattgcgatctccctgatcttccatctttccatgccatcttctcctccctgagcgttcgctcccgttatgacccacaagcctctcggattatgaagccatcaccaataccatggggggttgtcttcgccatcgcctacctcgacctccatctcacggaccttgcgagggttccaaggcagcatcatctttaggatcatcactgacaacccgacaggccgatacctccctgcggacactggctcctactgccgcttggacttcttggacctctccatcaccctctctatcttcacaaaccagttgtcctcgagttcactgtcctatgcctcgggaaccctctctgccctccctgcttgtctcgttgctactatgcttctcacggtgagacaatgcttaggtcaccctcgaacccagcctcgggcatggggatgactcaggatggaggatttgtgccgctgccctcggggaagagatggaaaatagaggcgaggtggagagagagagaggagggaggttaggagagtcgatgacatgagggtcccacatgcgaaatcagcgagtcaatcatgatcaacatgcgatgtcagtaaaagccattttctcaaccaatgaaggaaccaatttgcaccggttttcgaagacaggagaggcattacatccagttttacggttgagggaggcgaatcaatcaagaaataagagttgagggaggccaaacagacatattccaaacaaaaaagtctatgcaggccgggctatactgctataaatgggctcgtctgtttattggacagattgggcccaaacctgaacctacactagtggcatatggactgatattcaacaaaagccgggccccaccacggtttgtcggaacgtaatcgccagccgcccttccgttccttggcctccacgcccgtcctttctgaaatgttgactttcttctctctctgccgctctgcgttccttcaacgcaagcaaccacgcatcaggtcaaccgacagcatctactggtactagcagcctagcagtacaaagcttcgaaattcttgggccaatccagctgtgctctgcatcccgttgacccgttgaccgctgaatcaaaaaccgaccacatttcagcgtgcagcctccctctccactccatggaatatactaaagaattgataaactcctaccacaagaaagaaaccagcgactcgtttagttagttagattgattagccggtcaagttcgctaattacttgcatgactcgtacttgacgtcccccaatctgaacgcaacagatacgcgcagaaaatctttca

SEQ ID NO: 18618 - DNA, 5287 bp, Oryza sativa
  unsure (1)..(5287): unsure at all n locations
aacgtaatcgccagccgcccttccgttccttggcctccacgcccgtcctttctgaaatgttgactttcttctctctctgccgctctgcgttccttcaacgcaagcaaccacgcatcaggtcaaccgacagcatctactggtactagcagcctagcagtacaaagcttcgaaattcttgggccaatccagctgtgctctgcatcccgttgacccgttgaccgctgaatcaaaaaccgaccacatttcagcgtgcagcctccctctccactccatggaatatactaaagaattgataaactcctaccacaagaaagaaaccagcgactcgtttagttagttagattgattagccggtcaagttcgctaattacttgcatgactcgtacttgacgtcccccaatctgaacgcaacagatacgcgcagaaaatctttcactatagcgactttattctgtacgaaatttcactaatcatttctgcagatctgaattaacgtacgggaggcttttggttaaatttccatccacggatcgaattaataaagaacaaagaaattgttgacacaatgttctactaatgctagtagtaataatgaacaacatgttgagatttgacgaagagatgagatgcactctactatgaacagtacaaaaatctccggcgagaaacaggggcatacaaggattcaaaattgccattggttgagatcgtaggaggcgtgacggattcgcggtttgtgctcatggcgacgaggcggcggcggcggcggacatggcggagaggcggctggggcgcgggcggaaggcggcgcggcggcgctggtggtgggaggacgggcggatgagcgccgccacggcgcggcggacgtggtcgccgtcctccaccgccgcgatgcgcaccagcgagttcgccatcgccgacctcctcgcgtnctcgcgcagcccgccgcacgccgccgncacggagggacgcgacggcgacgccgcgccccggtgcagcgcgcaccggaaggagcccgggtgcgtggtgggcgagcacgcgcactccctcctcgtgctgcgcgcgccgaggccgccgccgccgcgcgacgacgacacgacggcgaccgtggcgtgggggagcgcgacgcggaaggcggacgggaggaggccgccgccattcggctggcgcgtgggcggcggcggcgagcgtgcaccggcgccggatgagagcctgacgcggcggcagacggagggggacgccggcgtcggcgtggtcgacctcgccatcggtccaagcacggcgtggcgtggtggcgcttcggttgcggcgcggccaaacctagcgtcgccgccgcggcgtgaatttataggcgggaagcgggtccatcactccaagcccaagcaagtggtctcttcttcttcttcggtgtggctgcctttgtgggccctgggccgaggcccacatgcattgttcacacttcagagagcttctagaagcattgaagacacaagactacctcaaaggaggagaataatgagagcctcaagtcctgtgatcttgcaatcaaaagatcttgtaagatcattgacaatctgcttacaaatgattatacactactagtagtatttacttgacaaattcattgctttgattttgaaggattgatgtctacaagatttttcaccgtgcgtcttggattctgatctcatggtagctactgacataaaattagtccgaactagctggtagcccgcgcaattgcgcggctagcacccaaacaaaatcatatattttttaagtatgattttacttaaaatttattaaataactatctcattttcttaagactttaaaagaccaaatcttatcatcctcgtgtttctaattatatagtttttaaaagtaacaccagttgctacctcttatgtcatctccttctttgtttgcttgctcgatctaccactatttctattcatttttcttggaacctttaaaaattggattttatagtttttagagtttattgtcacgttgggtttcgtttttataatatctagatgtcctgtcaaacgttgccattatactcctctacggcccatccactgtttcttctctttattgtcattaagattttaaaaatcgaacataatttatcgtttttgttcattttttactttctagaagtcccgccaaaccgtcatcggctttgccattgtactcctctacggctcgcccactgccttccttcgttattgtcattgtgattttaaaatcgaacatgattatcattggtttttttttactttttggaagttccaaacctttaaaaattcgacgtggaggttcattttttttataatttttagaagttccatcaaacgatgccactatgcccttttacagcccgtccggcggctactctttattatcattatgattctaaaaatcaaacataactattgttggaattcattttttattttctagaagtcccgtcaaccgtcggtggctctgcagctatactcttatacaccctgccccctgcttctcctttttattgtcattgagattttaaaaatcgaatatgattatcaatggttttttttttttactttctagaagtcccggcaaccgccctacttgtttgctttatggcctgcctgacgtccttccttttaatcgtcgttaggattctatttggtattttattaataatttttatatatcgtatcaactgtcaccactctactcctttataggcatattacttaatttatctcgtcatgtcgtcatgtgctttagattgttttttctttcaataatctttatttttatcacaaattttagttatttataaattttattcctaattgaaatcttattttcctttttctaatttcagaatttatttttaaaaaaaatttagttactaccatattgtgttcttttaatgtttttattttttcattttcaatttcaattgtttcaaaattgtattcatacttgaactttcttttaatttttctaattttggatattattttattttttttcagaattttaattaatctcgtattgggttcttacttggattcttcttttaatattccttatttttaattccgaattttagctatttttaaattgtatttatacttggactctcctttccttttctaattttagattttattttatttttatttcgaattttgattaatctcgtattgggttcttatatgaaaacttctttcaatattgcttatttctaattccgaattttagctatttttaaattatttttctacttggactctcctttccttttctaattttggattttattttatttttatttcgaattttgattaatctcgtattgggctcttatatggaaacttctttcaatattgcttatttttaatttcgaatttcagctatttttaaattagacttctacttggactctcttttttcttttttttctttttctctgattaatgtgggaatttctagcccccacagcgatcatggtgtcttttttcaaagctgttttaataatataatagattccatgtgaatttaacagtggcgtaattgttctgtttctttactccatggttctaaattccatttcagaattcagttatgaggtgacaactgtcgagatttgacatgctgaactagtccaagccaatatggaactggtttcagaatgggccactcgaattgagacatttcaacaaactgaatctttttttgtttctcacttcaaaatcccaatggcacttagctcacatcatttcatacgctgttagccttatgttagcccacctgctggaaaactctgctcaaacctcaagcttcagcaggacatcaaaacaacaaaagcaacaaaaagtaactgctatatgtacagaatttcagatgcagaaaaacagtgaggctgttgatttttgcagaggaggagggtattcttattcttcagggttcagaatagcagcagcacaatgcacaagcatcttttctctgtatacattgcacttcaatcccattgtgctctgtgactctgtcctcaactccacactgcaaaaagggctttggtgcactggcacatccatgcaagaattattaggcttcttgtttattttttatttggacagacagctgaattctgtttgtgaggagcctcataaaaaaaataccacttcaatttggaaagctttatgaggagattaattaattaactaaaattgctatggatgacaaaggagataactgaatcagcagtggcatgaaaaaaattgctggtcagagccaagctgcagctgctgcagggtttgtatagtgttcttgtattgtacagggttgagggttccaactccctttactagcactagttattattacatgatggaacatgtcatcatctcatctctgctctcttatacttaattaattaactctcttcattaattaatcactcgattaagctataaactctctgggtgaagcagcagcatccatccaagaaaattaagaagaaatgaaacttaattttccagggttaatcattaattgacccttcttgttcttgtcttggatggatcagcagctctagctagatggatacttggatagctgacgccgccggcgatggcgatggcgacggcgagcttcaccttggcttgaggcggtccaaggcgaggtaggcgatgacgcggtagccgacgaggaggagcgccatgacggggacgtcgacccagtggttgttgagcccgacggccttgatggccgggaagtcggcgacgaggcagcgcgcgccgccgccgccgcagtcgtagtgggcggcgccgtcgccgaactggatgccgatgaggaggcggtagcagtagaagctgtagttgagccaccggagccagccgacgaagggcgggatgtgctggacgtagtagccgccggcgatgaggaagaccatggtgatgacggaggcgagggtggtgccctgctttgacgtccatgagcacggcgccaatggcgagcccgaggctctgggcgacgaggacgctgtagaggaccacgaggagggagaggaggaaggggccagggcgcgggtcgaggccgcccatccagtagaggatgacgacgaaggcggtggggagggcgagctccatgggtaggtcggcggcggtgcgcccggcgaagtaggagaagaggcggtacatccccgacgacctctccttcaccagcatggggcgctcgagcgggaaggtgaacacggcgttgtagagcgggaagaagcccc

SEQ ID NO: 18619 - DNA, 1920 bp, Oryza sativa
caccaccgcctccttcccgggggcagatgtccagcttcaccgccggcgcaatgtgccgctcgtacgccgccgccagcttccccctcacctccttcagttccgcctcactccccccgccgttcgccgccgccgccgccgcgccaccaccaacatccccatcaccaccaccgccgctgatctgcggcgcgatacctgcacgagcaagaagagagagaaaaaaaaaaaccgcacgtgagaccgtgagctcgacaagtgtcccgccattgttcacaaaagatttggaggtgcaatacaatcatgagcgcgcgcggcgctgtcgggcgcggggaacgcaaatgcgccgcgccatgattgggcagctgctcgatcgatccatcgatcgagactcgagagtgcgccaagctaagtgtgtccccatccatgtccctctgatctccacccaactaagctattgcggctgccgatcgatgccggccggcatgccgctatcgctcgctcgccattgcgcacgcaatgtaatcaaacactaccgcgacacgaacgcgtgatggcgatcgatgatcaagtgtgagggctgttcagattaatgctattttaaaatatacattttttttaagttatcaaagatatgcatacatttattttttttaactttggtaaatatataagaaatccagctaaaatttcagcaatattattaacttactaaaattttggtactagtttattttgactataatctaaacagtctataagtattaagtattgctatcgtcaggggacccatggaacggcatgcgcgcaccgtatcaaggacacaatctctcaaacacgttggctcgtgcttctcttctcagtgctcaccaagctcaccctcctctctctatctctgcttatgcttttctttttctttacttattaaaaaatttatgagcccatggtatgtgtaagtataaattgtttgattattgctttatgttcacctttttgcaaggtggttaactgaacaactgtggggagaattatatattatgaacaagtgttgaaggatctgattcctctagcttttttatatgggacgaattgtacgggagaataatcctgtgaggccctgtttggaatgtggggaatttttcgttttctacaggaattgaaatgtttgcttgtgaaatttccgcaaaatccgtttatttgagggttaattagactctgtattttcttcagtggttggactctgtttgcagaaaggtaccctcacagaaacaacacatggtataattccaattccaaagtataaccaatgaaaaaaaatgctaataaaatggaatatgccatactgtgaattgagtccagttaaccacacatgtatgtgacacaaattcttatagggcgacctttcaagatcactgcattacttttcaagctcaggacttttagctgataatagtggtgactaagggctacgagcctatgatcaagtgtatggtacatgttctaaatgtcatggagatgccaagaactgatggttgcaatgcttgaaacgattttaaaaaaaaaggaattgatgttgttgccgccatgttgggaggcaaaggggagaatcctaatgacaaactactgaagggtgaaaatctacacggatgctcgtccatcgtttacttttcagcttataagtcgctggaaaaaaataaatattaaaaacttatttttagagttggttttgggaattttcatcatagtttatttttcaacttccgcttttatatcgctaagaacatttataaaagttttacctctaaattattctttgatcacttataaaccgttacgggcttataatcagctataggcgaaacgttgaaacacaaatgtgtatcatgatttttcgacgatataaataaaccttctaaaaatctatga

SEQ ID NO: 18620 - DNA, 638 bp, Oryza sativa
accaccccgcggccggcttgccgatcttcaccttgtacaccacctcctcgaactgcaccaattatcacaaaaaaaaaagcatggtcacgtctcatcaccaacctccctcatgcacatatgtcaacatgctcatgcacgtagctctacaagtacgtacgtacgtacatacatacatacccctccgtcccaaaaaaagatcaacctagattcgtaactaggaattcattttttttgacagagtagtatatatgtatatatacacaaatgtgtacttgtctactcaccttgaggacaagagggtaagagttggcggcggagtggtggccggaggcgacggaggggtgacttgaggtagtggggtggacgatggcggcgccggaggtgttggtggaagaggacgacgcggcggtggcggtgggagaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttc

SEQ ID NO: 18621 - DNA, 1410 bp, Oryza sativa
acatcgttaacttgttcatctaaaatagagcaaaacttggtttcgtttttttaaaaaaggagggaaaacaaaaccctaaaaatagggtctaaaaacaagggccaaataagtattgtacatcaaataaatgaatacgaaatttccaccattgaattaatacttccaccaaattcattgaacattgactatggaagcttttgataaaaaaaaaacgtgacctaatatcaaacaattaaaattaaaatggatgaagcttttaatcaagatcgtttacatgcatatcttgatatttgaatgcatatgttacatttgaaaaaataatttgtgtgcatttcttttctgctgtttattactggaaagaatcagtgccataaaatgctctatctgaaaaagaaacgcaggtagtatcattacctttatcatcacttaggccttgtttagttgggaaaaatttttaggtttggttgtcatatcacatatacggacacacatttgaagtattgacaaaacaaattacagattccgccaggaaactgcgagacgaatttattaagcctaattaagccgacattagcaaatatttactgtagcaccacattgtcaaatcatggcgcaattaggcttaaaatattcgtctcgtaatttgcacacaaactgtgtaattagtttttcttttccacatttaatactccatacacatgtccaaacatttgatgtggtgggtgaaaagtttttgttttgggaagtaaacagccccctatattattgagaacccggggaaaacatgcattagggcattcccaacccaatgactaggatggtgtccatagcattaaataagttgtcacctaggaaaaaaaatgatgtggcaagtgaataaatgaggaaagagaaggaaaccatgtcttacacgagacatggtttctacacaacatctaagacatcatgtgagataaagtagcattaaattgaagtatggaatagtggtgtttgcattggaagagtagtgtctagtactagtttctatggaaaccatatccagtgttatgggttgggactgcccttataaaaaaagcaattaaggcgaaacattgttgatctgttcgtcacggatgagcaaaacgatgagctcggcaagctggaaggcatcgtcgttctccgcggagagcggcgacgtcacattgctcttgccgaacccgtcctggcattccttcaccgcgctcgccgatttctccagcgatgagatcgcctcctggaacatgcctgccttcaccgtcgcgccgacggcgggctgagattacagtatgccgccgtacaccgactggcatgactagaggcaccgcgtcgcagcggcgtcgccgctgccgttccggagcttgccgtctatctcagacttggtgctcgtcgcgt

SEQ ID NO: 18622 - DNA, 1439 bp, Oryza sativa
cgagctcggtaccctgatactctctccatcccaaaaaaaaaacttaacttctagagtttaaattttatcccacaaaaaaccaacttctaccatcctacctatcttcaacacataaaacgagaagttttatctcttaaataatctttacctacctatcaccagtactaccttttctattgatgagggtcattttagtcattttacttctcactaaatttgccttgggatgctaggaatcctctttttatgggatggagggagtatatcgtagtttcctttctgctgggattattatgtgtcaatctgttgggttctttctttttaagataatggaagctttattgatctcactcaaaagtttttgctgggattagtatgtgtcagtctgttgggttctttctttttaagataatggaagctttattgatttcactcaaaagttttgataacactcccagcctctgcactacgatagtgcacacagccaacacactcaaaagaagagaaaaaaacagcttgcaagatcaagaccctacaaggctacaacccaaataataggtcgtcacctatataccgaggtataaaactcattgacacttgctttaaatatagacaagtcgaagtgacaaaaccctacaaattgggcttctcgagaataacccatgatcagagccaatgtagagccaatgtgtaattaagaaaataacctgcaaaggagaagaaacagttttcctataaaaaccacatcatttcttgagagccaaattacctagcaagttgttaccgtccctattaggtctaaactctttcttttgtggggttagaggtctggtcgttttggtgtggactgcgccgcatgggaagcaacaacatattagcgctgtagcgtgtccgttaccggagatgaatgctcttggttagtttatgagctttgtataacaccctgtttattcctgtttggctttctcccgagagctgggtaatggaagttacattttatcaaaaaaaaaaagagtaaatttcactttgggcctgattttttggccaaagttttaccatgaaccaagtctaactctactttttcagttagcaccaggtatgattaccttcttatatagtttggaccgggtaccaatacttttgggccagcacgttggcttgagctggtgaactcagttcagggcagagagttatcgagggagactagcgcacgggaaaggaggaagatagtgtcgtggaggtggacttgctcaatgcctcgatctccaccctcgcaaccggtggctcacggccgtgtctccggagcggcatggcgcggcggcggcgtgctcttttctggctccgaattggcatggcggcgcgctcttcagctcaagtgtagtgctggcggaatgaatcaatgtttgtttctgaatgagtgtgcaagtaagatggagctg

SEQ ID NO: 18623 - DNA, 2275 bp, Oryza sativa
  unsure (1)..(2275): unsure at all n locations
ctctgtgttctttagaaagacaaggaaataatccagacatgacaaaataaaaggcagagtagggatatatctacaaaggtgtttatgtagcacgcactacttgacaaatgcgaggcataccacctgcatgtctaattgtaacagaccagatttttgtaatggagaagttaccctcttctaaattctgtgcatagtaatgaaagtctgaaaccaataattactgatcaaagcaaaattggtcataccttgtttggttcactaaatgaattttcatccagcaagttgctggatgtgagaacagtcacagttgattttgccgtatctacaccagcttgaagtccacttgaagatattgtgaggttcacagcatttggcccgaagtttactatctgtggaagatcatttgaagatcaggatgttctaagatccaaacatattactccagcagtaatacatataaagacagatgcatgttatgcaagtatgcattggctgaatcaattttgtatcgttgtaactaaatcattccaaacaataaggcgcatgtctaatgaattgaaccaaatgcatataagtttagaagaaactggaatggatggtttaccttcactctcagaaaggtattctcagcgtcttgccaggtgattgcagaggcagccaataaatcagagtagctggaactgatcataattggatgaatcatagcaccgcttgattcacggaaatatgtctgcatccaataactaggagttccatactgttgccaggagttgaagacaatcgcatctgggttccagctggttatcacatttatacattagcaatagtcagagaggaaacagatgctagaatccttgaacaaagaaagtataagaccatgtatacaacacgcgatcgttgtcattcacgaagagtggtgcataacatgccatctgaacgacatccctgcaaagaagcatgcataatgagagccaattcaataacttgcaataaggaattactgttgctcaatgtaaatttttacaaattatacatttactcaaaatattttccttgtgnagaagtacaaagatgaggtagtagttgtcaaacaaaaatcaacaatttatccaggaatcccattgaacgatctcttatattcatgcatggtctggatacaagtagacaactctgcgcatgattttatatttactctgaacccaagataaagaattaagagagtatccccagagggatcacctatttttctctaaaccaattaggaaagcagcttctgccaatgatgcaagaaggcttccattgccagcatcctcaccattaacagcatactcacttccaaatacctgcagtgaaacaattgcatagtcagtggttcctgctcacttatattctgtctatccaacatcaaagggtaatgagatgaataaattgccgggccggccaagaaaggccaaccaaatttacttaagattgaagaatatatacaaatatacaaagttataacttcaacaagaagctgtcgaagtaatggaagttgtcaccggagcaacctcccaaaagcaaaagattacactaagggactactctcctatatttctgaaaaccccagcttccttccaaatcgccacttcctctttgattgaaccaaacaggaaaccggctgagcgccgctggttctgaaacacacgcgcatttctttccttccaaaccatccaacaaacatgggaaaaggaagaacagcgtcttacgttttgctattcgatagttaggcttcttctcatgggaaaaggaagagaagaagaagaacatgcttgttgtcataattactaactatgcttgttgtcaatcaataccacagcagattgctctaaagcgatctggagttcaagttatgaagtactagtagattgctctagtttgggatattattcaagttatcatatattctgatcttatagattcagtctcagtcatggaagaagatggaagaaactaatacctagaaacacttttttttcgaaataactaaaagcatatttcattcaagaaaatgtcgaggataatggcgcatgagagaagctgcctttgtaagactgatctaatctaagaacttaatttcctatggagcgaatctcctagtacccaaggtcctgagttcaaatctcctatggagcgaatttcagattgggttgtttgtggggctaagttccaaattacaatggccgcatatatccggttggatgtagaggccgggtaaaaaatacccttctctaaa

SEQ ID NO: 18624 - DNA, 412 bp, Oryza sativa
ggtctaacatacaagtttcttgtgaacacgcattgcaggtcgtgccagttgccagcgagttgccgaatgcagcagaacagatgcaagtcttacattttccttactcaatttgttcgtttgatcttgctctggtttagccgtttaattagcacaagtttatcaggctaacatgttgggacgctgtttctgtccttaatgacatcccaggatttcatagtgatcaaaagctaattattccactgtatcagagcccattaggccaaggatggttttaattaaagcttagtttgaacaactcgctttatttataatatatccctttattgcttctaagaaatcatcgagttgtttgtttggatattagtaatgatatgggaattattaagttgaccagataaaaatgtagaatgca

SEQ ID NO: 18625 - DNA, 1020 bp, Oryza sativa
ggttcccgtggactcgatagggttcggaaactaattctccaaccccgcgtaacattcgtgacgcctccgacccctctttcctccgcatcgttgcacattctcgatccaacggctcgatcgtgtgaacccaacttggggagggggttcggagaattattcttcaacctggtgtgacctcccgctaagccgtcgcagcgcctgccgtgcctcggataccccattctaccggccgaacgcctccggcaagccattgtgttgcgctcgggcagcaaacaccacgagacttatggcgctcactatgtatctcgagataaaattcgatacctctagatactaagtatctcgagatacatctagatatcagtgtaaaattttctagttaaaatctaattcctatgtatactaagtatctcgagataagaaaaaggtgtaaaatttaggtgctaagatatcttctcaaggatcgtaaaatttcacttgttttagagatgtcggtacatgatgattacaagcatgcatgatgcatatcatattttactataaagttaatgctcaataactgctaaatcatttttttttgaaaaccgaagccagcttaagctggagttatattaaggaggagagaaagtatttacaatatcaccaagaaggtgaaagaaattagagggggcgaggaaaaaaacctaaatagagctacacattgaacaaaaacctaagtgaatattctcgcgatgtcttttgctccacacatgctccatagcttgatttcgtcttgtattttggcaagtagctgcagcattgtttttttttgacttcgaaacaccctcctgttatgttcacaccatatttcccatgccaccaacaagtggattgacttgagtgctttagccttgctttttccaacttgagatgttcttttaatccaccattccaaccgagcttcattttcatcatgtgggtggtctatgtcgtggcagtataggctacttagaaccctctcccagatctgacgcacgaaag

SEQ ID NO: 18626 - DNA, 676 bp, Oryza sativa
aattaatgtttatgtggtcacgtacttgcatctttttcttcccctcttgtcctttgcagcgttcaataatttcattgccacccaaattcatccatgtaaaaaattttattcacataactaggcacaattaataattcaagctagaaagagacgaacttggtccgatttgtgctagtacaaatacgaaaatacggtcgtattttctcgatcccggtcatgtctagcccgggaagcaacaaccgagcggttgcccgttccgcctttccaccgctcgatcgaagatgacaagatccgtcaggaattcaggctacagatgtcacgttgtgatgtagcttgccggcaagcccatacttgtcttgttcatacttcatagcatcgcaggcctatttaaggatgcaagcagcatcacagctaaattccctcctgagctccgctaacactatcgaagcttcacaaattctgttcacgcacttgtagctgttgcctctcgtctccaagtgttggaggcaaaggcgtacttcgatccgcaggtcgaaaagttctttctctagcccccctaatcatgttcctgttgtcgtgcagtttacatgtttgatgaaatgcctgagagaaggccactactttgcttaccttctgttcttgattcattgcatgggtaccgagctcgaattcgccc

SEQ ID NO: 18627 - DNA, 740 bp, Oryza sativa
atggtgggccggaaccttgggggccaacggacattccgaagactcgccacaaaggctctacagccaacaccaccggccgggggcacggagggctgatcttcacgtccgtgtcgaggtgacactctggacgaggaggcgccctccgttgcacggggagtacgccggctattacgccggcgctcgacgttgaggcgggcatccggctccccatgctgatcctcccgagtcgacggtgtcgacgagggagtggcagccgaatgacgtgcagccgccgccgctcgccgcgccctccgccttgatgacacggagccggtggtagcggcgccggaggtcttggtggtggctgaccgtccaccagcacccaggcgctgctgtgccgtcatgaccaagttggccacgtcttccagccatcgttgggctggagactccgggtcatggacgacaggcgggtgtcgtaggagcgcgccagcagcctgaagcgcaccctgaggcgtgctgccgtcgccgtagacgaggaggcgacgctccccatctcgccgttctcctgcatcacctgcgactggtgatgccacggatttgtcgaccctctgaagcgcctccccctgcttagggctttggcgcggaggaggtggaggagtacgagctcgacggcgtggattcggctccccgtcgtcgccgctcacactcggagagaggtcgtgcgcttttccttgctcggccattaggctgaacaagaaaaa

SEQ ID NO: 18628 - DNA, 253 bp, Oryza sativa
caacaatttatatatttaggatttttagggtgtgacacccttgctgctggggagtgggtatatatacccctaaccaccaaaactaaccgttggaaccgaaatccccaactttgtgctctgtcggtcagaccgccgttgtgaggccggtcagaccggactactttgtaatggctagaaaactagccgttacagggcaatcattgagcccactcaacctggccggtctgaccgcagtgtagtggccggtcagacc

SEQ ID NO: 18629 - DNA, 509 bp, Oryza sativa
taatcttggactaattcacgagatgaatcttttgagcctaattaatccatgattagcctatgtgatgctacagtaaacattctctaattatggattaattaggcttaaaaaatttgtctcgcgaattagctttcatttatataattagttttgtaagtagtctatatttaatactctaaattagtgtctaaatatagggactaaagttaagtccctggatccaaacaccacctaagttatatggatttgcaaagaaagaaagaccatacagtgaagtacatgattacgtagtatgcactcccttcgatgaggaatataagtcattttagtttttgacatggcctttgataactttgatcattaatttctttgatagtttatatcaatatattataaaattaacttcatatgaaatacgaatatagcgtcaccacatgtactatatatctacatgttttggcgtaattttaataaaaactaaaatccatgattagtctagaaaaaactac

SEQ ID NO: 18630 - DNA, 504 bp, Oryza sativa
catcttgtgaagaatggagaatagaattcatgcactgaccccaaagattttagccactacaccatgccaggttcaatggacaccctgttcaaatcatgtctgctatttgatattattcaaacttatttaaaaaggtcatcataaaaattatcaatttattcacattgctatctgacaagaaaaaaaagtaaattaacttatctgtaatcagtaatcccgtagagatggcagatcgagttattgttccttaatctacatttgcttactatgagtccataggagttgttgatcgacatttttcttctacatatgcagggccatggttttcgcaaggaactcatgtacatgcttttggacttaaaaccacggtttctacggtttcctggtatttcgaatgttttccaactggcaatcaatttcggttgccctgtaatttaatcgctcgcattacatttggcagggggttgctttgtcgaaggcaattggttaaaaaatgcattcagg

SEQ ID NO: 18631 - DNA, 839 bp, Oryza sativa
  unsure (1)..(839): unsure at all n locations
aataatgcttcaatcaaacaatcaggtggaacccagacgccattgtatttaactcctggcaacaatacggaactcctagttactggatgcagactcttttccgtgaatctagcggtgctatgtttcatccaattacaatcacttccagctactctggttctctggcagcatctgcaattacttggcaggattctgaaaatagcttcttaagagtaaaggcaagaaattttgttataaacctactctacatctgtaggagaattgcgtacctcatggattgatcttgaaatctcctgtgcagattataaactttgggtctgatccagtgagcctcacgatctctgcaactgggcttcaggcccgtgttaacgcactgggatcaactgccactgttatcacatccagcaatgtgatggatgagaactcttttagtaacccgaataaggtaagcaaacatttctgatttcttactggatgtaatgcacatatcaatgtctagtagagtttgtggttttggtcatctgaagccaaagctttgctcatgataaccaatgcaggttgttcctgtcaaaagccagctttccaatgcagcagagcagatgcaagtcacgcttgctcctcactctttctcctcattcgatcttgcgcttgcccagtccaaactcgtggcagagatgtgaagcaggaacacaaggttagcgacagaaacacaagaaatacacgagatgtgatatgcgaataccagaatgcagtccatatatgtgcatgtatcttgaagcactactgtatagtgtaannnnnnnnnnnnnnnnnnnnnnnnnnnnnnnnnnnnnnnnnnn

SEQ ID NO: 18632 - DNA, 897 bp, Oryza sativa
tattagatatagcactacacgggtcgggtcacacaacacctagtatccatcgtttacggctaggactactggggtcaccaatcccattttctcccctagcttttgtttctgagtgtcaatgttggcctagtagagtgatttcgccattggtgtcctttccgatctcaatgctcaaaccatgctaccatgcattaacacagttgtagataagggtcccttgagaatacgcctcctcaacgatcaatggttaatggcggttaggctagaatagttaatagtgatatcatcattttagaaaatgatgtgaaactgggcttaacaacggtgacataatattttttttgtacccatcaactacgtacatgatgatcagaacatctaaccatttattcatcagaatatttgaacaattttgccatgagatctattccaattacctaaaatatatatatagttggaaacataacaagatcatatgagcaattagtatatatcttattactggaggggagaacattgcacataatattgtgacaacaagataaggaaaaacaattctttaaccatggaaactttctaatgaagcttaactaacgatggtttcatgatcagcagccaccatcacattattgaaaactaattaatatttgttacaattgtgaaactccttacttgataatataatatttataatgtaaatgcgtgtggtgatttaaatgctatatggctcaacgtaaagtgatgctatcatatccttgattgtatgtgaaaaggtgaatgaatctgcttgcttgtatatataatccccagttcgtgcaaaatcaataactgttcttgccacgatttttggcttaaggtttggtggtgcaaggtattctttcatcatatccttccacg

SEQ ID NO: 18633 - DNA, 544 bp, Oryza sativa
aaaacacacgctgagccccctacctggcgcgccagatgacggagctcgtggctcttcaccgggagaccgcgcaggcccccctttgccggttcggccgggggcttagggtgaaatctcaagctctcgctctccctctgtatctggaaagatcgtctgcccgcaaaacacacgagacacggcgatgtatacaggttcgggccgctgccaagcgtaataccctactcctgtgtttttgtggatttgtgtatgagtgagctaccaagtgtcagccaacttctcccccgttctcagctctaaatctggaaaagaatccaaaagaaaaaagaagaaccccctctctatgggcaaggtcctccttttatacttcaaggggataccacatgcaccctcccctttccaaactggacttttcttctctttatggacggagattggtatggttgctgtccgaatgacactccgatgggacagcccacacctacctccactcccggcggagacaggcgcaacgtgggatcggggctgcccgttgctgacgcgacca

SEQ ID NO: 18634 - DNA, 1281 bp, Oryza sativa
tgtaaattttaatcataattatttgggacatctgtagaagcttttgctatatcgatatcactgtttaccctgatcatcacatcaccatatttatgcactgtacaagataccaaatagtatgaatcaaggtgataatatgtttggaaaccgattagccatgtgtttccttgattgaatatattcgtatccaaccagagcaaaagcttcttttttctaacaaaatctcagaattccatcccccgcatttgttttgacaagatatacaggctatccttctccttctcttcctcgatcatgaatctttgatcttcttttccctaattattacgtgttagctttgctccttgttaatgatgacataaatttcttgcagatgtattgtagcttgaacaggtgccctttggatttggatgacatcgtggatcagcctcactatcatctcaagatggtgtgcatatttggattttgtggcaacacaggccaggtggagctagcaaaatacattctcagaaatgcgttaatattggagcaaatgatcatcgaccgaaaagggagatatcggttggatggatgttttgggcgcgaggaggcagatgagaagcttgttccagaagatatggatggtgtactcacaattctgtaacttatactccgtacagtagcaaacaacagtcacaagttaaagtgttgttccttcaaggcactagtaactaggattaagtttttttttaacagagtttacagagattattcggtactgcaagagttgtggttcactgttcaatacgattatattagtatgtatcccttccgattaaaaatgtttgacatttaggaccatatttagttgcatttttaaaaatctagacatcaataatttgtcaaatgcttagttttcaaaatgatatacgtagatttgtctcataatattataaacttattggattatataaacttattctggtgtaaaatagattgccaaaatttttaaagtgtggctgaagtttgtgctaaacattaaactacttgagaaagtatgcactattcatatgttacaatgagttttaatctccaacccatggaccattttttttaagcttcaattcaaaggatgccaaggggttgggagttttaatctccgtcccccaagggactattttttctttccccaagatcgagttttttttaatgtagttttgtgcaaacacatgtggatagttttgaactactagtatattacatagtaggaaataattgattactatggaagtattcttcaca

SEQ ID NO: 18635 - DNA, 647 bp, Oryza sativa
gctcttaacacacggattgagaaccaggtatctcgtactagtaatacccagtcactatgagagcttttgtttctgtttaagcaaatgttttatatttgtattgttgcaaacttttatggtagtgtgacgaattatttggtgttctgctcccaggttgtaattgcagacgcttcacagggcagtcaatcccgtctgcctacttccattaccaacttctcattgtcccaaaaggagaaaactcttaatgaactcatacaggatcgttggctgtcatacactcccacaggaaagattggtcttggcatacgatcatttcttgatctccgaagttggttacgtagtaatgatatcccatcatgtgaggtctgcaatgaagcttgcataaaggtgcagatatgtgattacgaattacgattctacatttgcatttatcttgttacccatggtcatatactccactaatgtcattccctgtatttctattacttatttaaaacaggcatcatcttgtcctaatgagggatgcaatgtaaggattcacgtgtactgtttgaagaagaaattttctcagagaaaggtagttacctatttttaattccactttacacatatgaacaggagtggctttctaaattgtttgtgtatgt

SEQ ID NO: 18636 - DNA, 788 bp, Oryza sativa
agtgggagtggtcgcttgcttgccggatatatatgctgcccgcgtagcgtagaacgcgtgaaaagagaacaaacagccaaacacgcgggaaacggtcatctgacggtattctttttattttttttcttttataaagataaatctcacgatatcctgttcatactctggtactattaaataatttcactatctttttttctattgatagttagtactctttttttatgtatgccaccgttgctttttcgtataacgtttgactatattaaaagttttagtgtaaatatgtaaaattagaagttaagatttctttggtgacaaaacaaatcataacaaatatttacataatttttttaataataagaatggtcaaacgtcatgtcaaaaatcaacgacatcagacattaaaaaaagagagagaatagtactccctacgtcctaaaatatgagtatttttaggttgtttagaaaatcttataaaggttaagtaaaaagatttcctttccattaaagtagtggtaaaatattaaattatttagattctcctcccaagcatttgattggttgaaaatgcatgaatttttatgcattggtacatagtgacgtaagcgggatgtaaaagttgccacatcagatttgtacttacgtgaagaagggaggacagaagaaaaaagaaaagcggactagatttgtagccaactacacgactggcttcaataaactatgtgacggagatggatggattatgtattattgatgtaatatatattacaattatgtagtatatg

SEQ ID NO: 18637 - DNA, 951 bp, Oryza sativa
gaattggtagaagaagaagaagaagaagaagaagaagaagaagtggttgaaggtggagaactgaagtcgcggtggtgaccgtcaccggcgccgcccccgccgctgccagcgggtgtctggtggtggtggtggcggccatgatcatcgccatgcaactcctgaggcggcatggcgatcgatcgatggatgaaaatctctctgtctctcgggtgtttttcacacacaagccactataccaacaccacagctagctaggctgtgggattggatgctatactactacagctgcagtagtggcagctagtagctagctagcttgatcgagctgagttgacacacaaccttgtgatgatggtgatgatgacgatgttgaaggagaagggatgaaggagagggctttgccttctcctactacttcaactaggctatctcactcccaagtgaagtgctgtctggtttttggcttggtgattgcaggtatatttatcatagctgaagaggagagagagagagagagagagagaatgtgaatgtgtttgtgtgtggagtgggggtgaattggcaaaggcaaagaaagaaagggagggggtaagatggacctaccaaatggggcaggggagcaacacttgttgctgtcactttttttattggctagctaggatggcaattggcaaaccctataaatttattgttagttactacccagtaatatatgtgtgtagttttttttagtgattttgtatatagttgattaacaatttgtgtggcgtattatctaaaaaaagaacaatttgtgtggtgtgcaaggtaacacaccactagatgcatatgctgatgatatccattagaagttacaaatggtggtggtagttattgttgaaacctgaaagggagtttatatcacccatatggtggttttgtagctctagcatggtgtggactgtggatcat

SEQ ID NO: 18638 - DNA, 4235 bp, Oryza sativa
  unsure (1)..(4235): unsure at all n locations
attagtattattgagtatttttcaaacttaaaaaatagatttatttatttttttaaaaaacttttatatagaaaatttttacacgaaacataccatttaattagcagtttgggaaacgtgctcatactaaggccgggtttagttcccaactttttcttcaaactttcaacttttttatcacgtcaaaactttcctacacatataaactttcaacttttttcttcaaacttacaattttaacgtagaactaaacacaccctaaacgagggagagaccaaacgaatagtgtcagagaagtggggacatgggttcccaccaccaactattagggacaccgggggtttctgaaccaggccacgtggcaccaagccacgccagtcataggtgggactgagaactcggtctcttattttaacaagccgaatctagagttcgggatgcgagctcagggcacgcccgagctcagccccgttggctgctcggggcccctgttacaccttaaatatgacagtacctggagtgtcggtactcctcgtcacagagatgctcttgcatttagtctgagggatacgaatccatccactacgcgtggggaatgataagcaacaaaacaacgcatgtcgattgtggaactaaccatcattatgcctaaaaagatgggcatgggatgtcaggggacgtggttgactgttatgtcgcttggccagacccaccacaacatgacacacccagttatctaaggccgataggtgggcccaatagacgtcatctacatcctagtcacctaccccgagctacgcgtcgacgcgaagggcaagtggctagagaggagccgcctcgtgtgaagatagctccgctaggccctcctagggtcctgtagtgagccctacttgcccgcatgccgtaaaactttacctacctaatgcccttctgtgggacccttttgcaacagacatcaaactataagggagaaccaaggccatgcaaggaagaaaaaaaactctagtagctctagctaagagagtttcacaccttataaaagattgaggcagagatctaaggaagaacacaacatgagtagggtgctatggctatgagcggcccgatcctacataaactgtttgtcttttgctctttcacgtgttcatgacttagttcccacggacctgctccttggcccatatccacaaaaggggtgtttctgtactccctgctagaggagtccgggctccgacaaatagctattctgaacgaagcctcctttggacacagtgactttttagattcccaaatgaattgaattgattcttctaaaaatcgtgaaattcttacataaatctagcaaaatccgtatatatcaaaggaggttttacatatatatctttatgtttattttttttagataatagaaatggattacatctccggcctgtacccgtaggtacacagccaaaaagtccagaagtgaacagaaataagttttaaaaaggcgagatgggacaaacccccaacttttggcactaatatgatctactaaaataatgtttctaaagtcacatagattctatcacgaaattctgtagatactatgccatctaaactggaataaaagttccttggctaccaattccaaacgtgtagcaccattgcgcatagtatcctgttgttcctgtgaaagcatcatacaccaagagtggagccaattggaacacatgaagataacctgcatgatgttaggcattttattatggttaaaaactatatcattacagcaacgccagattgaccaacatatagcactagctccaaataaaatcatttttttggggtctaggcactcccttaggcagttaccaaaaatatcttttgcattgtggggaagggggatattgaaggcaaagaagatacatcgccaaacaaaacgtgcaacatgacagtcaaagaaaaaaaagtgttggatggtctcttgtatattacaaaaataatattgcttgtttcccctccattttctctttacgaggttatctttcgttatgattacttttttttaagaaacacataaatactttgattttttgtggtacctttacctctcataagatcctcttgtggatctttacattggaattgatgatcgcattatacatggatttgaccaaaaattggccatttttatgtagcgaccaaataaagcaatttttttttgtcatttaacagggttatgttagctagtcgaaaaatcaaatcattccactcaactaactttggtcctacaattgatcgtcggaatgaaaaattcaacggtgttgtgctcataacctctgccaatatctttatgtttaatgtagcgctatatttatagtatatatacaattgtaagtttaaagtattaaaactatgataacatatgaaaatggcataaactacatgtgtacgtatgcaataatatgaatgatccaagtttttttttaaaagaacatttctagtgatggcaacttatcggttttgatgaagccgttggggacaagtttgtggaaaactaagcggttttagctggtttttcatatagtagaattgaccaaaagttttcagtttttggcaaagcgacaggactggttttcaccttgaaaagggtaatgtaaaccatactacagttaacttcatataacttgtcagattattatatatcaaaatgttcaccctgctccatctacaaatgctcgcactgcatcactacaaataaagtgaagaaatttcaatgcatgcacacacagttgacacaatgtgagcaactcatgttagccatcattaattgatggaagtgtgtcacttgccactttttcctctttattttttaaagtcaagtacaatatgcagatatgttggattatatttggaatacatcacctctgataatttttggatcaggtatctcgaggcaacactagacgaacccttctcacctccaccataacttaaggacatggatcctctgcagtactgcatttgtattagcagtggctgacaggtggacccgatcccatatgtcagcggctactactgcaggtgcagtactgcagacaatctccactgttaactgaagccccttgaattagggtcattttatggtaccttacgctagtagcctctatgcagtggtgacgggaacgtatttatagtttctcggcaatggtgattaggctatgccattacacaaagcatgtttggtaaatacgtacaaagaggatgtataacatatgtagaacataaatgttgcattttgggacctgaaaacataaattacacattggacctgcaagcctagttacactagatgagacgcaatacaaacatatacatgagttcatgtcactatattatcatataggtaatcgcactttgtcttgtagaggtgaaacggtagctctgctgctatatgtattagccttttcagctttaattatgttatgacccattgacgacgagagtactgaatttaatctcagtgggctggttgtggaggctgacacaaagagatctagatcatccctcgttttccaaatgctagctagctaggaaaataagagctcatttgtgtgatgtgtctacagaaacttgtgtttcctctttctggttttactattaggatgttacatgcctatgctttagctataactatatatcctaacctataacgctatctgctatcaaagaccacagttttagtggtgcgataagtatttatcctaatggcctcgcaactgaaaccggtacatttgtgcagacggtctataacccgttttctcagacgtttatgcaaacttcctgcaactaagggcctataaaaatcgaggattatttgtgcagtcgaattccacgacagccaccatactaaaaatattatggaacttgacatcagcgaatgaccatactaaaaatatattcaaaaaaactgttaactaggaaatactgtaagaatcccatgcatagaactttggtttacttcatatcgggcttagtatatatgaattttctagaaattttcaaagtttggattttctaaataatccttgtaagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgagctcgaattcgccctatag

SEQ ID NO: 18639 - DNA, 641 bp, Oryza sativa
cgccgattcttcctcgacgccgtcgccgtcgttgatcttccgccgccgttttggtcaccggagagttcgccgcgtcattctctacgtgctggtgccctccgttcgcgtcgtcgcgccgtcgttcgccggcgagcttgtgcgcccgagccgctgccggtggtgacgtcaccgctgacgtcatcgttgccgtccgtcgtggtccggccgtggaccggttgatctcggccgttcgttttggttaggatcgatctcggccgttcgtttccgtgagccgtcgccgtgcacccggtccaccgcaaaccctagccgctgacgcaataaacccctttttccttttcaaaaataattcattattgcgtcataattcaattaaaacccatataagtgttttaatccgatttaatctctaaaaattcataactaattcatcttagctcggatttagttggttcaagtctctaaatttttttaaaattgagatctacatgttaaaaatatccacatgtactgttcatgcttgtttatgtgctgttttggtgtttttgctcttttctgtttagattctgacgtttccggagagttcgttttcgctggagaagaatttgaagagttccaagggcagcaaggcaagtcacacagat

SEQ ID NO: 18640 - DNA, 603 bp, Oryza sativa
cctcagatacatggtccgtctcgactttcgagcgaccaataatatggcagagtacgagggactccttgccggactcagagtggcggccgggctggggatccgccgcctcctggtgttaggtgactctcagctggttgttaaccaagtctgtaaggaataccggtgctctgatccgcagatggacgcctacgtgcgccaagtacggcgtatggagcgccattttgacgggatagagcttcggcatgtgcccagacgggataatatgattgccgatgaactctcaaggctcgcgtcctcgcgagcccagaccccaccgggcgcctttgaagaaaggcttactcagccgtcggcgcgacccgaccccttaggggagacggatgcgcctgaccggcccccgaggcccgtcggagtccaggcctcgggacccgaagggagcgctccaagctcctttagattgattgcttggatctctgagatccaaacatacctcgcagataagactctacctgaggaccgcgaagggagtgaacgcgtacaacgcatttccaaacgctacgtgttggtagaagggaccctctatcggcgcgcggctaacggaatcct

SEQ ID NO: 18641 - DNA, 2062 bp, Oryza sativa
  unsure (1)..(2062): unsure at all n locations
nnnnnnnnnnnnnnnnnnnnnnnnnnnnnnnnnnnnnnnnnnnnnnnnnnnnnnnnttcagcatttcaataaaagcagtttcaattttctaaaggttgtgtctgtgccgttttttccttttgaagaatcttgacttgaaataatgtcactcgtgctcaaccttgccctcgggggttcggttcggtcagctaaaatcgccaaacggggcccagaaccgagccgtgccccggggcgtggtgaactccgggggggaatcggcaaaaacccacaatcgggtcacccataaccctcggtcaccacgttcccggtctggccagtctcgacatgcggatctccccaggcattagcctcgacccgcgcttttcgaggactgggacttgggcacgggcccttatttcaagctaagacgcaaaaagaccacggcacagatcatcctcatctcatatatagcaaaataaagctaacacaaaaattttttcatcatttctcattgcagattaagttaaattgtacaaaaaagaggcatgaaggccttagaagaaagaacaagaaaaaagttaagattggcgggggcctgggggctcattcaaatgcgcccgggtcgccggcctcgtcgccaccgtcgtcctcgccgctggcgtcgccctcctcgtcggagctgggggcgaacgcgagccgaggggccgagccctcgaagccgttgacgatgtggtcagcagcatccccgacgcgcgcgcgcgcgtcgtcctcggtcccgggagggaactcctccagcgccatccagggagagaaattggggtcccgggcctggtaactcgctagcacgagttcaaccgccccccgggcgaggtccctcgaggatgacttgatggtcttctcgagctcctcggggagtcgttcgaggacccaggccatcctgttgaggtgcggagcgaggccttccagattggtggggggcaccgtcgtctggcctctccagaggcctgcttgccgaccggcgcgcttcatgcgggagaccgcatcccaaagcatgtcgggcccaatctcgcccgccaagcgaagggcctcggcctccccggtggaggagtccagcgctcgctgcatttccgcgacggtgtgttcggcagctgcgaggcgggcggctaagtcgttttcgcccgcggcccccccgccgataggcgccctagcgtccagctccttttcccgcgcctcgaggtcagcagcccgctgctccagtgcggctctctcggcgcggacgcattcgagattgcggcgcgcctgctcctcctgtgccgcctcgcgaagggacaggctgtccgccagccgtttggtcgtggcctcagcctcctcgagagctcgctcccgctcagcgagtgcgtcctcgcggaggcggagcgcgcactcctcctcggcgcaggcggcctcatgtgccgccagcgtcgcctctcggagaccagcggcggcctcgcggtccgtcaagcccctctccacggcgccggcgtgttcttccagcgccatggcacgggcctcaagggcctcctcgcgccgccgaaacgccgcttcagtctccgttacccgccgctctcgggcagcggcggagtcaaggaccccttgggcggcgtcgagctttttcttcagctccgcctcccagcttgcgtgctgaaggcggagagtgtcttgcgcctcgatcatcgcggtggtagagatgagggcggccgcccgctcctcctccacctcacgggcgatctccgccagcgccgctttccgggcttcaagctccgagacatgacggcggtgagccttacggcccacctccaccatggcgtccaccgagcgccgcccctcctcaacacgcgcccatgcggcctcgagctccgctcgttctgcacgcagggcctccacttgggtgttgaacccatccagcactgcggtgtttgcagcggccagggcctgcagaaggggctcggcgctcagcggggcgacacaagatgaggagaagagccgccttggagaaaaggcgacgcggcttggccccccggaggatgcgctgggctcggggatg

SEQ ID NO: 18642 - DNA, 8582 bp, Oryza sativa
ccctcctcccgggcagcttcttcggcttggcgagcccgggcggtctcctcccgagcagcttcctccgcttggcgaacccgggcggtctcccgggcggcctcttcagcttcccgaaggcgggctgcggcttcacgccggtcagactctcgcctccgctcctctgcggccgctggatcttcggcctcggactggccggatttggggtggcgggaggaatgcgacgggacatcgctgaagcagaagaaaaaaccaaaagacgaacaaaatgagtaagaaaaaacttctctttgggagaaaggtggttgcaatgagagtgagacgaacctgcgagggggtcggttgaatgaccaccttggaggagaaatcaggttcccccggcatggttccgtctcccccgtcttgcggagccgtttcttcttgcgctccccctcgggctgcgacgtcagcgcagccccctccgggcgccgactgctggcacgcgccgccccgccccctcggggaggagatgggggaggtgttcctcccagcttcctcttcccctgggcgtcggcagggcggctgctccccgagcccccggcgcggggcccagaagcacgaccccctcctggggcagattgttcccctcggcggcgctcgcccgcgccgtcgtggcccttaggggctctctcctctgaagccccgacccccatcataatggttagaatggaggcgcggtcgggatcgctgcagagggggaggatctcctgaggaatgcgagacgcctccgcggagctaagattcagcaccctttggaccacgatcttgaagtcctcgggagcccaatcccatctggctccctggtgggtccgcatgtagtctttaggcccagtgtactcccaggcgctccgggcgcgccgttggagcggcgcaatccggcgacggaggtaatcgccgtacaccatggccccggtgagcccctgggatcgcaggcccgccaggcggtcgaggacggcgtcgtagtcctcccccagatctaccggtgcccgccagctggagacctgcgccgggggctggcttggaagtcggaggcgcgcttcgttggcgaggggggtgtagaaccagtcgctcttccagtcgtcccacttcttgcgaaggacgcaggggatgtagcggttcaacaccggcccccgcggctggaagtagcagccgccaaccaccgacggcggtgacaccgactgcacggtgaagaaccaccggaacagctgaagagaggggcgcaccccgatgaacatctcgcacagatgcgcgaagatggccaatgtcatcaccgcattgggggtgaggtgcgccatctggaggtcatagaactccaggacatccatgaagaaatgagaaaatggcgggaccagcccagccatcgcgaaggggaggaagaagatggaccgccccgggtagtctggtgccgggcgcccctcgcccagcatcactatctcccgaccggtggcggactccggcatgaagcggcgcggcagtccggcgtgcctctcattcacgatgcgggaaggcggtagtacactgccgtcgagcagagcagagccccgtgccatggcggcggaggaagagatgattgagaacgagcgcgtgtggcgaaagtagggcgtagcagagaaagagttagagctcaggtggcgaaggcaagagaaacaatggcgaaaggaaggaagcaaatccttttctcgatgcttttatacccttgccatcgctgggcctgactcctcgtttctcgcgcccactacctcgctccctcgtatctcgctatctcgctccctcgtttcccgtgcccacgcttccactaatcccattcgcccgcttacggcgcattgagtggatatgcggttgtggcaatcgaaatggattgtatcgtgcgcgcgttaattacgctcgccgaccgaagcggcgttaccatatctccgggcgagacaaatctgctcacccagattcgcgcgctgctcaagtggtgtggcagtcttgaatagaccgcccattatggacaaccaaagttaccaataccaatgtgcatggattgagaccgttgggtattttgcccaactacggagaccggtcccacctgtcacagggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgattacccccgagggggggtcgggttgcgcttgccccggccccgagggccgaggcaccccgacccccttaaggaagtctgcgccacatatatgggataagtgagcacagctgtgctcacctaacagcatttattgcagtctggtcaagcgtgtcacgctgcatacagcgcagtacggcgcgttcctttatccggtctgtgaccagtcacagaccggtcagatcacgggttaggtggcgactggcggtctgacgcacgccttaccccatcccgtcaaggtgtgagcttctaaacactcgtccccagctggagctagcgtgttacatcccagagatggcacgttaaccccgatcgatatataccaggcttcatcctaaccattacaggcaaggtgttacacaaggaagggcaaacatgcatgttgttaaactgacgcgtggtgaacaagaatgaccggtctggcactggtcgcgtcagcaacgggcagccacgatcccacgttgcgcctgtctccgccgggagtggaggtaggtgtgggctgtcccatcggagtgtcattcggacagcaaccataccaatctccgtccataaagagaagaaaagtccagtttggaaaggggagggtgcatgtggtatccccttgaagtataaaaggaggaccttgcccatagagagggggttcttcttttttcttttggattcttttccagatttagagctgagaacgggggagaagttggctgacacttggtagctcactcatacacaaatccacaaaaacacaggagtagggtattacgcttggcagcggcccgaacctgtatacatcgccgtgtctcgtgtgttttgcgggcagacgatctttccagatacagagggagagcgagagcttgagatttcaccctaagccccgggcggacccgaccaaggggggcgtgcccggtctcccggtaaagagccacgagctccgtcagctaccattaaatataatcatgaataataatgtagtatatatgattcatcccattaatgagctaatgtttctaagcatggctaagcaactgtaaataacatttagctgaaccaaaccaatatataagattcaagctaatcaatttattacccaaggtatcaaggaatagggcattcaatgcaaattggccataacaaaggaataggttcacaccacccggtgacatttgaaaataaatgcacagttgaaataaatagagaatttaaatataggatcaacatgctcaaaggattgtgtttaggatcagtgtgacttgccttgcaataatcggtcttcaattaatcttcgtgaatacttccgacgcactcacgaaccttcgcaacgacggaaacgacaagctaacacgcaaaacgaagaaaaagactaataaaaaccaaataaacagtacatataaagtaaacaaacatgtagatcatgattttagatgaatttagagacttgaacggcctcattccgacttcatatgaattagttatgaattttacaagattaaactgattttaagatttatttttagaagggaaaagggctttatgacatcacgatgacgtcatcaccggcgggacatcacggacattacggtcaccggcgatctaggtcacggcggcgagaacagagggcaccaacgcgacgagcacgacgcggggaactcactgaggggcggcacgacgacgaacgacgacgggagacggccggcgacgagctccgaacggcggcgaagtcgggacgacgacggcggtggctttccggcgacgagcagcggcaacggaggggtggacgggcttcttctcggtgctgctatgccgagggaggtggcggcacaggtcggggacgaccgaggcgacggcacggcgcggatggaaactcgacgacgacggcggcgctagggtggaagcggctagggcgctacgggcgacggcgagctcgggcgagggtggaaaacgaaagaggagagggaggggactctatttataggcatgggagagagagatcgggcttggaacgcaaggaatcgcgccgggaaaacctagggtttggtttagagagataaacacgaatcgagctcgattccgcgttgatttcttcgggataaagtccgattcttgggggaaaagatagaggaggataagaggaatatttcccctcatctaattttgaaataacacgagagaggagaccggatttggaggggaaatcgagggcaatggcggcatcgggctctgtctccagccggctggaggttgaagatgccactgtagcgacagggacgagaagtagacttctggctgggcttctacttcttggcccgattgaaagagggacacaaagcagacttcagaaaagagagggagagggctgcagactgagaggagactgggccgagagtgagaggacttttccaaattcggcccgaaaaggaaaaggtgaatttaattacttttccaattaaattaatcactgaaatgatctttgaattgttaaaaatacttccaatgctcaaataatttcaagaaaaatcctgaaaatacttgaaaactataaatatttaaaacaattataatcagaccatttaatgattaatttaatatgtgaataattactgaaatgttgtttgtattattaaaattaaaaattgagctccgaaaaatccaagaaaattccagagagtataattaaccatggataatttaataaaaattaaatccatccatgctttatatttaggaaattttatttccaacatttaacttcacttgtaaattaatgaacatttaatataaattctaataataatttattaaataatttataaatcctgaaacgaaaatcaggatgtgacagtttgatcatctataatggctctaatcccaatatagatctgttatatatgtcaagaaatctataacggatctaaataattgacctactacaaatgacttgataacatctatatacaatttagaccttttaatgatgtcctcatctttccgcctacccatttaagtctcttgaagtctcgattcatctatctaataaacataataaagtccgtgaatccctcatcttcttcgcatcctcctctgcttccatcacattattgtcggacaccattgcctaccctacatgtaaatgacacctctcccacaactctaactagtagtggctaagccactcatcgacacgtatccaagcggttgagatggtggcaggttgcgatttgtagggcaacgatgacgatgacagtgaggcagccatattgacaaagctatggcctcaccatgttcacctggctaatcctctcctccacctcccaagctccgctcctattgcttcttccgctttccatggccaccgtgaccttggtgcacttgatccgggcaccagatccgaccgccctgatgttggggggcaccagatccagtttcccccaacattgggctggattgatttggtgatatccagtaactgttctaaggttggggccaggcaggctgggtcctggggcagggccagcagggcgaccgccctgagcccccaagagttaaggggccccatcgtcagtccatatacatatatgtagtataaactgcatgcttatttcttagtgaatttagctcaggaactcagctggtagttatcgtcaatgagctaggagaagcccacgagtcactaaattgttgtcgtttccacaactggtgttgatgccgcctcggtatacctcacattccaaaataaacacgggtgcaaatactgttgcttcactttcgcacaacagattccaatttcaagaattttaacccaattaactaaccttcaaatttgcaagataaacaccaaatatttcatccttgcatggttgaataaaacatcatggttcaattgataccaaatattagatcagtgctttcttgcttattttattttccggagttgactaatcttccttgtagctttacactaattttctaaaaaaggtaatctgccctttttctttgtttttttttattttcagtacttctcatagtacaagcaaagtcttctatatattctcctctgttctagagtttctatacaatcatcaaatctagttgttgttcctttcttagtcctaaaaatcctatattattattggcaaattatttaagtttttttcctgataatgtgttgtatttttcttgtacatccagataatattgataagcaattggattgtcatgattaatatgtaattggtgtttcatggtgattaaacattacttttggaagtgcaataaagaaactcatttaggtatataggccatccgattttatctcaccctaggcccgcgaaagttcaggaccggccctggggcgaggttcactggttcaattaacatctgagacccatacagcaggctatggcagagctgtgttcaaccaagacaccattttttttctagttattgttggaagatagattgaacagtagaaatttttgttaagaagaagacataattttgagtgacctgactaagctgtgttctcatgtactgcaagctatgaaactcttcagcatgatcatttttgcttgtccttttgctcaagacttgtggatctatatatagggacaattgcttatttgaccctattttgaagcctaactaccaatatgaccctactttttctagtttgtttatttgaccctacttttttaacacgaacgctccgtttggctctgttttttttagcactgttaagttttcattcaaaaaagaaaaaaatataattacttttcataatgactaaaataccctcgaccaaaccctatccatatatattcccttctctccctcgtatcccgtctctctctctcgccgagtgcttgcggcggcggcagcgacgggtggagggagggagcggccgtgagcggcggccgcgaggcggggagggagggatccgcgcggtgctggctcgctgagggagggagcagcgacgccggcttgtggagggagggagcgacggcggcggcctaagaggaacttcctcccgccgccctccttgtgcaacagctgccgcgcggtggtggctagatgaagaggacggtcggcggcggctcgacaaggcggaggagtggctgcggcggcggtggcatgggagggatggtggcggctcgacgaagaggaggagcggtggtggcttgacaaggaggagggtcggcggcggctcgacgaggcggaggagtggcggtggcggctcgacgatgaggaggggcgacgccgacagggtggatccggcggaggttcggcgatgaggtgacggatccggtcgcgccgaggcacgtgcacggtggatctagcggcaccgagacgcgcgcttcggtgggtcagcgaaggcggcgcggcggtagtggacttcggtggggaggcggcggttctgcagggagagagggagcaccggcggtggcggctgctccacacgaatgggcttgggagttcgtcgtcagtggtgaggtgtcgacatgttctttttttttttgtttttggtagacataaatctgtgtcacaagggtataaatggaatttttgttttgagttaacaccgtcacgttgacttcacgaaatagggccaagtctcatcttcgtttgtaaaaaagagggccaaatgatcaaactcaaaaaagcaaggctaaattagcagttagtcctcaaaatagggtccaaaacgcaattgccccatatatatatgcccaagtaggagatttgatctgtcggtgatggaagtgatggagggtctccaaacagttgtaatttttaacttatacatatatattcactataggaacttctcctacagtatttttttttctttaaaagaaggcattgttacgctacattctactactaacgagtagggtagtaaaatttaaatctaacaatagattttcttcagtataaaaaatattttattcaaaactccgctaagatatctaaattttccctttaccaaatcatctattgtaacatgctatatggcatgcaaagttatcatggcgttatatattttaacggtattgctaactttctgccgacagaaattgcatccccaaatattgcaaattttgggccaccggatgagcttcgcgattcgtgctccaggccttctccaactctatagcgacctcctcttcttctccgacgccagcaacaccctagacttcggcagagggctctactggttagggtcccggttggggtgggggctggaggggt

SEQ ID NO: 18643 - DNA, 1134 bp, Oryza sativa
atcttgcccacgccgttgacaccctacggccagccggcgaggcggacggcggcgcgttggggcagtggcggcggaatgtgcgatgggagggcaacggaaggaggggagttagggttaatgcctctgcacgaatattaaagcatatccgatggtccaaaatttaaaagatggaaggtgggactttctgtcaacagatatatatacagtgccatattttaatttcaattttagctctaccaaatttcaattttagcgtataaaaaaccttttgaggggttaaaaaagggttaattagatacatgctattataaattctgtggtttagaaaaataacattactattcaataaatcgtaaagatgccactggtactttggtgaaactctctcatcgccactctgtacgcacgaatcggcgttggcgccgtttgtagtgtacggtatttacgtatggactgaaatgccccaggttggaccaggccgactccaggcccggccctgggggggggggggtcgagctgtgcagtggcatagggcccacgaagtgaagggacccaaccccatcagttttgctatatatttgtcgacaaattttctcctaaaaatttaacagatgtaattacagtacaattgtagtgtaattacactaacttgcatgtaattacactgtaactatagtataacttgtatgtaacttttaaaaatctctccgtaatatgttatttcggtaaaatagaggtcgtgggaacaaatccttacacatatgtgtatgctgtgttttttttcttcctcaccaaaataaatcttgtaatagatctaacgattcaaaattacatgaaacttacatacaagttacactgtagttacatacaaattacagtgtaattacatacaaattacagtgtaattacattacgattgtactataattacatatatcaaatttttagaagaaaatttgtcgacaaatatataggtggtcccaaccccatatatgctgtacataatagcctatagaggaattagaaagcccacccgcccaagagaggaagagacacatccgtcgtccgtcgatttggcttccttccgcgatcgcttgttctgttcgcctcatcacctcgcctgttcgctgttct

SEQ ID NO: 18644 - DNA, 18167 bp, Oryza sativa
gactccaggccgggccctgggggggggggggtcgacctgtcagtggcatagggccccaaagtgaagggaccaaaccccatcagttttgctatatatttgtcgacaattttcttcctaaaaatttaacagatgtaattccagtacaattgtagtgtaattacactaacttgcatgtaattacactgtaactatagtataacttgtatgtaacttttaaaaatctctccgtaatatgttatttcggtaaaatagaggtcgtgggaacaaatccttacacatatgtgtatgctgtgttttttttcttcctcaccaaaataaatcttgtaatagatctaacgattcaaaattacatgaaacttacatacaagttacactgtagttacatacaaattacagtgtaattacatacaaattacagtgtaattacattacgattgtactataattacatatatcaaatttttagaagaaaatttgtcgacaaatatataggtggtcccaaccccatatatgctgtacataatagcctatagaggaattagaaagcccacccgcccaagagaggaagagacacatccgtcgtccgtcgatttggcttccttccgcgatcgcttgttctgttcgcctcatcacctcgcctgttcgctgttctgctgccgcggtgcaccgcttccgcttccagtcgcgtcgtcttgttccgagggtttagggcgcgtcgacggggtcgtgccggcggctgcgtcgtcttgtgtttagggcgcgacggcgtcgtgctcggcagcagccggcaactggttgcaatctctccgttcagttccgggaggtacccactgctctcccatttgatgtatgctaagtttatatgtttaaattttgggatttaaattttactccccaattgctcctcttctaatttctgaaattctgattttggggtttagggatccttacgttgcagctgtgcaagtgtgcgtctagggcagtgaataccagcagtcattttaattataatgttgaattgaatttagtatgaaataatttccataattacttactaatttctaaatttacagtgaatgttagaagaaatttttaaggtaagatatataacttaaatgtttttttatgcattacatttatcagaaacatcgttatattattatagttgtattaaagggcccatttttctagctttgcttcaggccactaaattgaaaggaccgggcctggccgactcgagcaacccgtacacaatcatttcccatcccacgccgcgggcggcagcagcggctgcgacggcgacggcggcggcgggcggtggcggcagcagcgacgacggccacgaagatggagggatccggaagctcgagtggatctagccttcatcagtcccagcaagcttcctccatcccgaggttgagatgtgcttgccaaaaacgtgcggtgaatagggtttgcaaaatgtcagcacaatatagcccacacaggcagaatgtaaacacatttaatatttttttttttgcaaattgtaagcacaatgtagcctcacagtcatgatgcaatcacatttgggcacaacatatgaaaagatttgcatttaacaaacataatggttctggatagccatacagccagcttgttctgatagcaagcatatttatgaagtcatagcttcattacagccagcttgttctgataacaagagcctcaaaatgatataactaggcacaatgcagtcttcatcaacttcatcaacttaagatagcagcaaaatgagcattcatgtgccattacagccactacttgtactgtcacttccatctagctacacaaaatagacatcctgaaacacgtagtcgccgtggccgtggccgtggccctcgtcgtcgccgccgccgccgtcgccgtggctgtggccgtcgccgttgctgccgccgccacagctagggttagggtttcaacgaggaagagagaaatggactgctgcatcagctcacggttggtataccgtatatccactcacacaagggcatttaggtcaatatgagaaacggttgcatttctcgtcaccatattcaaattaagcccgccgatattgtagcgcgtggtctgcatgcacattaaagaaataatcaagttgtttaatgtaatttgttacacagccaatgcaagtaagttcaaaatacagagatcaaggccagcatattgttgcagagacaccaacattttcacgtagttgcagtgctcggctagtcgtcgtcgtcgtcgatggcgaggccgcacgccgtggtggtgccctaccctggctccggcaacatcaacccggcgctgcagctcgccaagctgctccacggccatggcatctacatcaccttcgtcaacaccgagcacaaccaccgccgcgcgctcgccgccgagggcgccgccgccgtgcgcggccgcgacgggttccagttcgagacgatcccggacggcctgctcgacgcggaccgcgacgccgccgactacgacctcggcctgtccgtggccaccagccaccggtgcgccgcgccgctgcgggacctcgtggcgcggctgaacggcgccgccgccggatcagcggacggcggcggcggcgctccgccggtgacgtgcatggtgctcacggcgctgatgagcttcgcgctggacgtggcgcgggggctgggcttgccgacgatggtgctgtggggcggcagcgcggcgtcgctgatggcgcacatgaggatccgggagctccgggagagaggctacatccccctcaaaggtgagtattaaccaagcatttgatcgataattaagctaattaatcgaggatatctaatacaccccgtttcatcagcgttgacaatttcgaaattggattttatgccggggaccaaaattacagaaatttcggaaatttctggccgaaattatttaaaattttgaatgaatttgaataaaattggatcaaattcacaaaaatttgcaaaaaaaaaccccggaaatttcatgtgagatttgagcatgccgatgggggagaaattaccgaaatttcaaaccctgcgttttatatagcctccacacgtgtgcctcaaataagtacatcgctgaccatgagagaggtagattaatattgctatagtaaaatgaactcttggtgcctctaaaatttgtttttccactggctttggaaatggaccactagttattaagctagaaatgcactcctcgtaataaaacttttaaatgctagtgtgcttattctggggcatacgaagagagtagttgttgtttcatgtttatttttccccattatatttatatgtctagatctaccactctaaacccacgggtgatatgggtttgtgctaaattaaacagttcattttgttttgtaccatttttagttaactatatttcactatgtgcttaatactttctttttgatcgatatttgcaaaaatgtgaggttaatcatgaatcaatttcctcccatatctaaatacctcaaactagctgaaaatcaccccctccccagcaattttgtgctggtgtggaccttggcgggaggcaacacgtcacccacgctgcattccggtgggattttgtgagctcgtgtttgttcgcatcaacgcaattacgagacgagagagtacattaattaatatgcagtgcacatctggaacagaaaaaaaaaatgtaacgcaataacccatgcactgcacatgatgattatcatatcgcggttgcctacataaactaagatttgcatctcttcctcgcagcttcgcttcttgagattggagacaatgccagttgttttttatttacaggacttacatttggtgctctacagtggtctctaatatacaattcctaaggcaataactaaaacaacggcctccagtatatataaactacgttgcaaatattgcaatggtaactaaaattaattctggatcgacataaaagaaaacattgatagcacatccaacaaaattattattaactagttttgtcaaaacattgatagctagtggaagtgatcaattcttcaggcttctgctgaagcctgaagaaaccatgtcagttgagaaatcagtacagtacaatcaagctagtgatcaatttattttcatgaataataatggcttaaaaaacgacaaataacggctagtagctgggctatgagccaggaaaaaaactcatcagctggacttggttgaggcagggtttggaatttcgttttcaacaaaaatttttgtagaaccgaattttcagaatttttggtatttttggaccgaatttttctgaaagtttgacaaaatttaactgaatttgacataattttgaccaaattcacaaaaattgagaaaaaccaaaaattttggcccagatattttgaggtggaattaatggacaaattaaatgggctgcaaataaaaaaaaaagaagtaaattagaaggaaaaaaaatcaagaatcccaattttgagtgggaaattgtagcttcaataacacgatttttattaatttgatcattgctctcagactagctataatccgggatcaaacatgatttttttttcctttttagtacaagccacgtaaatgccttaggggccttgttgccgaatgccgacaacttgcccattagatcacatcactacctgagcttctttcgtcaagatcaagtcctaaactactcctaatctccgagctctgtgtagcgtgtatcttcctcaccaaatcacttccccaacgcacgcaacacgcgaggtattttctatctattatcataatgtagcggatgatgaaaattaatggagtatttcttatctcaatacttatgttattattatcaattaaccccatatcattgggattgggaggcatatgcgccatggataccatcaccaatctatctataaaaccaaggtggtcgtcgtctccaaatgcagacgacgccattgcagaattgcacacacacgaacatcacgtagttgttgatggcgagaccgcacgccgtggtggtgccctaccctggctccggcaacatcaacccggcgctgcagctcgccaagctgctccacggccatggcgtctacatcaccttcgtcaacaccgagcacaaccaccgccggatcgtggccgccgagggcgccggcgccgtgcgcggccgcgacgggttccggttcgaggcgatcccggacggcatggctgacgccgaccacgacatcgggaactacgacctcgcgctgtccgcggcgacgagcaaccggtgcgcagcgccgctgcgggagctcttggcgcggctcgacgacggtggcgccggcgcgccaccggtgacgtgcgtggtggtcacggcgctgatgagcttcgcgctgtacgtggcgcgggagctcggcttgccaaccatggtgctctggggctctagcgcggccgcactagtgacacagatgagaacccgagagctacgggagagaggctacatcccactcaaaggtaacgaaattaaagatgatagggaccggactgtctaggtatcattttaaaaagaaaaaaaatagtttactctccaaactatttcgctatgatattactccctccgtcccataatataagggattttaagtttttacttatactgtttgaccactcgtcttattcaaaaaaatttgtgcaaatataaaaaacgaaaaattgtgcttaaagtactttggataataaagtaagtcacaaaataatataataattccaaaattttttgaataagacgagtggtcaaacagtgcaaacaaaaactcaaaatcccttatatcatgagacggagggagtacttacataacactaaactagcttggtccgcacattttacacggctagctgccaatgttccttattttctattccaaattttctttttttctaaattgtatttttattgaaactcttatttcaatatttcttattttttaattttataaaattcagttataaacggtatttctatatacactcaaacgtctacttctattttcttttttttaatttcgaattttaggtagttctaaattatatactgatatggattctattttttttcaatattctattttttaatttcgaattttagctatttaaaattgtatttctatatggagtttattatttctttttctctaattccatattttagttagttataaattgtataccagtatgaacgccttctcttccaatatttattatttctaattgcaaattcaactattttaatttttttctatatggacttcgattaatatgagaattcgtagctcatgagagcgaacgtgacttcgattaatatgagaatttgtagcacatgagaacgaatgagaacgaacgtggagtctaattttcctattacttaaataagttaatggattagttcttaatccaattacacttgctctgcattggttaaattagaaataaactttgtgcatgtggtttgtttggtcgtttccatctcaaacttttttacttcgattcctataccttactttaagcttccgtaaaaaataattctattagttatataactattatattaaatctaaactattataatctggatctactatgacgcaatgcttatttttttctctttttcttgattaacattggaatttctatttttcttgtatgttttcactttttttctatctttcttatctgtttccgtttttttttgtctgtttccaattttttttgtccgtttccattttttatcccgtttacactacacctaatctaataccattctctttttttttgtccatttacacaaaacctaatcctagtacccttctatttttattttttttcttattttctttcgattaacgtgggattttctagaccgtgagagtcaacgtggaggctttttttattactttattaagttaatagattggtgtcggttggaaactcgacataaacactggatttcccacttagcaccccaatgacaatggtgaggaaaatcaaatgttccagaaataataataaaaaaaccagcttgatgcataggttgatcgagccgatgcttggagccaagaattaggtacagaaattgaatcacaaaatcatcacaattccaactatacaatcaccttgaaaaactacacacatgacattcataaaaaaaactaaatcacaaaacaatgcatggctccattacctcatctcatcggagaccaaggcggccatcgccaccgttgctactcaacaaaggctaaggactccgctgtcgttcaccgctactgctcaaatccaaaagaccacgatcaaatctagggatggtaggagagatctggaaggatggggaatgaggaggagaggtaccttttagtcatgcagaccgcgcgcggcactgttgctcgtgcgcgtggaatctggcccccctaagctcgtggtggccagatctggtagccctacccccaagctcgtggggaggtagggccgaggggagggtgtcaccgcaatagggaggaatccgccgctgtgccaccattgggagggcttgccgccatgccgatgaagagggagctgttgccgaggggagggcatcatggccgatggaccacctgccgaggggatggtgtgctaccgaccgctgcttgactcaagaggagacatagaagtagaggaacaaggagaagagagaaaggttaggacagattggcacactaggaaatggatgagtgaggaaaaacaaggagatgggctggagaaaaaggataagtacgggtggaggaccgaggcggcttggatcagctggtctgatgtattatttgtgtcgtttttttttaaaaaaaactggcactagtaatattactacatgcgtcgatttttaatgaaaacaagcacaaattacgtggcgactttttatgtgcctatttcattaagaaccgacacttatatatgctgctttttatttttagcctttcctaagatttcgatttcgagtttcccttattaggggttctatacgcgtgctagatatcttaatctcgtaaagtattttttttactcatttcaccctctaagtgcttcactctatctcttaataacattttaccttttggttcctctttatataagttgtattctaagctaagacattttggaaccataaatgacaccattattagagttgacaaatattttcaaaaaaatttcatgaaagtttgcttgaactttcaatcctcgatattttccaaccatgcgaggtgtgattaaaaaaaatcaaaaaatatattggtatgtaaagtcgtatcacatatatcatcataccaaaattaaagtgtaaaatataactaatataaataatagaaaacataaatattgttagaaagtagagtgaaccgttttcaataattcacagtataaaatgagcagaaaagaagtgtgtggggggagtaaaatgggtttatatgggccaaaatccagccggtccacgtgtgccggttttttactggaataagtccactttgactttcttaaaagtgatccaagtctaatccgtaaccctcaaccgcatagccggataagacaactccccaaactattgaaaccagtgcaatttgactctctcagcagttttggagggtggttttgctgatgtggcgctgacatggtgatgttgacctagttttcgtcccacgtggcgcttacgtgacatgagaattaaaaaaaaaatatgtgggacccataagtaattcacactaaaaaatattgtggtccccactgacatgtggggcccacatgtcatcctccctctctcttcttctacttcctccctccctctctctcccttctctctttctctcacgtggcgcaatcggcaggcaggggcagcgacggcgacagcgggcgagagccggagcggcatcgggcaagcagagacgtcagcgagcggcggagacatggtcatggcgcggaagcccgcgagcggcggagatgcaggagtggcacgacgttgtggacgatgatggcggtgctcagcctctcgctggtgacagggcacgtgtggcaccccgcctcgatctccgccgtcacggccaccgctccggctcgccaccgaatcgcgccaccgctgcctccgtcgccccttgcgcgcccacctcgtccccttagcgctcgcccactacccagccctctcccgcctcggtctctccctctgcccacgccgtccatctccgccgtctacctctcccgctctcggggattcactgccgctgcacccgtcgccgcatgcctgaactcaatggcctcgacctcggggatgcggcggtggcggaggtggccaaggcacgccgcctgcagaggctctcgcggttgccgcacgccgccggagccgccgcttgacccgcctccgcactcctccacctcaccccttcccacccacgccaccggggtcgccgcacgccactggagctgccgctcaacccgctcgagttcctctcttgctcatggagcgcctccgccgtcgacgtccctcacctgccgctgccatcgcggggttccatgatgcccccgccctcggcctcggcgacgctcgctgccaaccggctccaaatcaacatgggaagagaaagggggtgagagaagggggagagggggagcaagaagagagaaagagagagaatgacatgtgggtcccacatgttagtggggccacaacatttttttatgtgaatgacaaatgggtcccaccgatatttattttaattgtaatgccacgtaagcgccacggtgggacggatacaggtcaacaccgtcacatcagcgccacgtcagcaaaaccgccctccaaaaccgttgaggaagtcaaattgcactggttttaatagtttagggagtctttctatctggttttgcggttgagggtcttttaagggagtcaaagtggacttattccttttttaccagtgaatgggccgacaccaaggcccaactgaatcacgcatttttttccatttcgcagatgagagcttgctgacaaatggccacctcgacacgaccatcatcgactggatccccggcatgccgccgatcagcctcggcgacatctccagcttcgtccgcaccaccgacgccgacgacttcggcctccgcttcaacgaggacgaggccaacaactgcaccatggccggcgcccttgtcctcaacaccttcgacggcctcgaggccgacgtcctcgccgccctccgcgccgagtacccgcgcatcttcaccgtcgggcccctcggaaatctcctcctcaacgccgccgccgacgatgtcgccgggctgagcctgtggaagcaggacaccgagtgcctcgcgtggctggacgcgcaggagatgggcgccgtcgtgtacgtcaacttcggcagcctcaccgtgctgacgccgcagcagctcgccgagttcgcgtggggcctcgccgcgacgggccgcccattcctgtgggtcatcagggagaacctcgtcgtccccggcgacggcggcggcgacgcgctgctgccgacggggttcgcggcggcgacggaggggcggcggtgcgtggcgacgtggtgcccgcaggatcgcgtgctgcgccaccgcgccgtggggtgcttcgtgacgcacagcgggtggaactcgacgtgcgagggcgtcgccgccggcgtgccgatggtgtgctggccggtgttcgccgaccagtacaccaactgcaagtacgcctgcgaggcgtggggcgtcggcgtgcggctcgacgccgaggtgaggcgggagcaggtcgccggccacgtcgagctggcgatggagtcggaggagatgcggcgcgccgcggcgaggtggaaggcccaggcggaggcggcggcgcgccgcggcgggtcgtcgtacgagaacctgcagagcatggtggaagtgatcaattctttcagctctaaagcctgaagcctgaagcctgaagaaaccatgtcagttgagaaatcagtagtacatcaagcaagtgatcaatttattttcatgaataataatggctagaagccgctgggttattagccaggaaaaagactcatcagctggacttggttgaggtggaaataatggacaaattaaatgggctgcaaacaagaaagaattaaattagaaaggaaaaaaaatcaagaatcccaattttgagtgggaaattgaagattcaatctgttaacatgatttttatttgatcattgctctgagactataatctgagatcaaacacgatttttttagtacgtcaaccacaagtacacctacgagtcgtgggacatcggccactcggcctccagcttggtgaggaggtgagaagagagcaggtcaccacacaagttgcaggtgatggagctccaactatagatggccaaatagaccgtctggcatggctctgctagggcacaaccaaggcacggcccgaccaactcgttgtgccctgccgtgtctgtccacaggctgtacctatggcctaggctcggactgtgccgtgccggcttgaaggcatgactagtccaccgtgcttgtccttcaataagtctaatttgtctccctcatctctttgggctgtacattatatggtggtaataagtctattttacctccctcatctctatggctaggtagatttagatgcagaatctctttggctaggtagatttagatgcagaaactagggattgcaatgtatctttcttatctttaaaaaaaaagaagcaggtaatggagtcggaggagatgcggtgggacgcggtgaggtggaaggctaattaaggcggaggaggcggcacgcgtacaccccggcggatcatcttacaagaaccttcagaccatggtggaacactggaagtcatccgttcttttcgcctccgattccaataagcctgaagcatgaagagtattgttcagaaacaaatgtattcaagcaagtgatcgcgcaacttctgtgtcatgaatataatggcatcaaatcctcacgaaaaaaaaatcatgttgctgaagaagttgttcgtaatgtacttactattaatgaataagagacgggaaaccgttttagaccccctcatttatctaaaaacgattcaaatagttataaaaaaagtaaagaaaaaaaataattggactgattttctcccctttcatgcgagtactactgttctggttcttttgagtgcaactagctagcattacttatttgcaacgtttttgccatggatgatggccagttaaagattgtacagttctcattacgtgagcaaatttcttgtgctgtttgcaaaacgtttgttatttatataaatgtgatttgaagaaaaatcatcagaatccattgtcgtctagtccggttaggatacctggctttcacccaggcgacccgggttcaaatcccggcaatggaacattttctttttctgttacaccgaactcttaccttctttttctgcaccaaatctgcgtgatgtgtttgttacagatttgcagatttccttgttctgttctttggcgtttgttacagacttgcagatttcctttttctgttcttttacaccgaactcttacttctgaaccaaatctgctttgatgtagacttcacggaacaatggcgtttgttgcagacttgcagtcaaatcgttgtagccttcatctcgaaagagggtgcacgtgactgtgttcccggtgaccatcgtcaccggcgcgccgctgccgatggaatattggaatggccacactgaaatctgtgtccaattctccgagagctgtggggttcagagaggaattctccgacatgccacaacctgcctcagactgcattcgagagcagcagacagagagagagagagagagaagagtcgtttttggcgcgtatcttttcttttttttttctttttttttagaattacacagtataacgcagacactcacaacgcacgcgcactcacccctataaacacacgcacgtaaaccctacctctatgagcatcttcaaagactgggccggcaaatcttggagagattaacgaaatcaccacaggtgcctcgctgtcgacgagtacgtcgcctaccactgaaagcacaacgtcgttaaatcctggaaaaattctgaattactaaaatgtgtgtttttaaaagattcatatgaaaagttaattgaaaaaatatagtgatatatttttttaagtgtaaaataattaatacttaattaattatacactaatacctcacattgttttatgtatgttctcaattctcttctctattggatatcgaggtcaagtcggtagatttcgaggtctatccatgtcaggttccctccgttgcaagatgcaacgatgatcgaaatcacacggctaaaatttgtttttttgtttaaattcgagttaaaatgggtgccgacaattaactcatttacttcatccttaatggttatcataagtttgtaagttagctagcgctcaacagatttatcctcttatatattttttttaacatgacaagagagacaatgcagatctagttagccaaaaagctcatacaaacaaaggcaccaagaaattcgagcaaagcagatagtaaattatagtttgggtcaccttttatcagcaatgtttaactttgaccatcctttcgtttggattgtataaccttaccattttttttttggttagaactactcaactctctttattattcatgtacttcaatttcgtgaaaatctgtcctgcatatagatggaaaagttcacatgcgtaccaaaaccgatttgattgagattattaatgagtgctgaagaagttgattgggtggtccaagccaaaaaaaaatttataaagttacctgatccaaaataaaaagattattttaaaggagatccaaagtgaaacttggataataaaatatgacctaaaatgaaattcatacacacactacactgccttgaaatcgtttcagagtttcaggattttcatggtcaggtcttctccagcgtcgtcacggcgtggctgccgaagcccagggcatacgacggcaatagtgtggagattatggataccccatatctacatgacagttataatttagtcagatatacggtaccaaatataaatagaatatctttatgaggactcgggttagttttgaacttgtatgtcaaggaaatacccgagatcttagtcggttacgattgtattttatctgtaattacatattccgttagggatatggactgtactttgtaaagcggaccctttcccctatataaggagggtccgtgtgcctctcggggcacgattcttttttccagtttatacgatcaataacacactcggcggaataatccccggacaggagtagggtattacttcttgaataagaaggcctgaacctgtataaaattcttcgtctccaaacccatccactttcctagcttgatagccacccccttttattattgccgaaatcttgtttcgacagttggcgcgccaggtaggggtagcgtcaagtttttgccgactaagtgcgatgggttctgtctccggcatcgacgacttcgccttccctcccgggcaggcgttccggttcggcagcctcaacttcatcaccaacgacttcggcaagatctctctccttaacttggattcgaaccagtcaggaagagatcaggtccccgtgccgttcggcattccgaactcggccgaggcctactccaagatcatctctcctgagtcggcttcaaaccactcggacgagatccaatctactcctccgcgaccagatcaagacgacgggtcctatccctcaatcctgatgaaacttcctgatgatttggccgctatcttcacagccaagacatctcccactcgaagatcttggcgagctccggcttcggccccgatccaatctagatccagggaggttggcgttatactccaacctcttgggacagtcttgacggaagagttggatggctacctcagctcccccggcgtcagttctcgaccaaccgagatcctcgactacgacgacttcggctaccactatgaccacggcgaccacgacaacttcgacgacagctatgaggataactacacgcccctcttcttcggcgtattcatggctgacaacgaaacggaggaacagcgccgagcccaagaagcggaccaagatcgcgcacggcaagaagctgaacgtcgccgactggaggaagagcgatagcgacaggagcaagaacgactacagcgtgagcaacaagatcgcgaacggattgcaaaggaggctgaagatcgatggcaacacgccttggaatctgggcggtgagcgagagagctcattgggcaacaagacgtcaatggaacagtggtctttcgcaccccctagcagaacgcggttgcagcaatcactctcctcgacaccctcctcaaggaagacgcactcaaccaagctgatcatgttgtcaacatcttgaaccagacgaagaccatgatcgctgcctcggttccagccaactccgcaagcacccgcaccccgactggtagccgagtccctcatcttcgatctcaagactatcaccagccaagcctcagcattgccggtgccggatctagtcgcaggagcaggggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggctatcattcaccggatcgctacgacgacgatgtggacggagttgctgccttcacaagcgatctgcgtcgagtggattgcccagccggctttaagccgactggaatcgagaaatatgacggcaccaccaaccctgagtcttggctcaccgtctatggtctcgcaatccgcgcagcaggaggagacagcaaagccatggcgaattatctacctgtggccctagcggattctgcccggtcatgactccacgggctaccccgcagcacgatcggatcatgggcagagctacgcgaccacttcatcgccaacttccaaggcacttttgaacggcctggtacacacttcgatctctacaacatcattcagaagtctggagagtctcttcgagattacattcgacgcttctctgagcaacgcaacaagatctccgacataaccaacgacgtcatcattgccgcctttactaaaggcattcgccacgaggacctagtcggtaagttcggacgcaaacctcccaagacggtcaagcagatgtttgaaaaagccaatgagtatgccaaagccgaagatgctatcacggcgtccaagcagtcaggcaccacttggaagtcaaagaaggatgcgccgacagcataccatgctatactaggacgaccggctctagccaaattcatggccgtcccacactacacctacatgatgatgaagatgcctggtcctcgaggggtcatatcactacggagcgacatcaagcaagccgtcacatgtgacaaagaaagttgcgagatggcccaaacccacgagatcactctcgctcgtgaagagatccgactggctgccaccacggcaagcgaaggagaggtgcctgcgaccaagctgtcaaagatcgaaaaaggcgacgacaaaactaagaagatttcactagatccctctgatcctaccaaaactgctgtaataggcaccgagttagattgtaaataggaaagcacgctcatcacctttcttcaaaataataaagatatctttgcatggaaaccattcgatatgccaggtattcctagagaggtgattgagcactctttacatgtcaaggaagacgccaaacccatcaagcaacgactccgccgttttgcacaggacaggaaggatgcgatcaaggaggaattaaccaagctattagcagcgggcttcatcaaggaggtccttcatcccgactggatggctaacccagtcctggttcggaaaaagacggggcaatggcacatgtgtgtcgattacaccgacctcaacaagtcttgccctaaagacccttttgggttacctcgcattgaccaggtggttgactcaactgccggctgcgagttactcagtttcttggactgttactcgggatatcatcagatctgactaagagaatccgactgcttgaagacctcgtttattacgccctttggggcctactgctacatcaccatgctctttggattgaagaacgcaggagcaacctatcaacgcatgattcaaagatgtttttcaactcagatcggttgcaatgttgaagcttatgttgatgatgtagtcgtcaagaccaagtagaaggatgacctgatcgcggatttagaagaaacttttgcaagcattcatgctttcaggatgaaactaaaccctgaaaagtgcatcttcggagtaccgtcagggaagttgctcggatttatggtatctcaaagaggcatacaggccaacccggagaaaatcaacgccatcctcaacatgaaaccgccaagctcctaaaaagacgtccaaaagctgactggttgcatggcggcgctcagccggttcgtctcacgacttggcgagctggggatgccctttttcaagctgctgaagaagactgacaatttctagtggggacccaaagcataaaaagcctttgaagacttcaagaaacttatcaccactccaccagttttggcctcaccacatccgcaagagccgctactgttatatgtgtcggcgacctcgcaggttgtgagcacggttctagttgtcaagcgtgaagaggaaggccatgttcaaaaagtccaacaaccaatttatttcgttagcgaggttttagccgactccaagacaagatagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgaagtgggccttagaattgatgtctttggacatatcgttcaagccacgaacttcgatcaagtcacaagctttagctgatttccttgc

SEQ ID NO: 18645 - DNA, 847 bp, Oryza sativa
cctcgcaggttgtgagcacggttctagttgtcaagcgtgaagaggaaggccatgttcaaaaagtccaacaaccaatttatttcgttagcgaggttttagccgactccaagacaagatagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgaagtgggccttagaattgatgtctttggacatatcgttcaagccacgaacttcgatcaagtcacaagctttagctgatttccttgccgagtggaccgagtgccaagaagacatgccagaggaaaagatggaatattggactatgcattttgatgggtcaaagaggcttataggcactggagctggggttgttttaatttccccgactggagaaagattgagctacgtattgtggatacatttttctgcgtcccataacgtggcagaatacgaggcgctactccatggattaaggattgctatctctctaggcattcgccgattaatcgtccgtggagactctcagttggttgttaatcaagtcatgaaagagtggtcctgtttagatgataatatgaccgcttatcgacaagaggtacgcaagttggaagataaattcgatggacttgagctcacccatgtcctctgacataacaatgaggcagccgacagactggccaattttggttcaaaacgagaagcagccccttctgatgtgttcgtcgaacatctttacgaaccaaccgtacccagaaaagaaa

SEQ ID NO: 18646 - DNA, 696 bp, Oryza sativa
ttcagactttcaatacgggttccaaagaccttccgctcatcccaaatatctatctgtaattttaaaaataaagttttttttttactttttgggctatggccttgtgatagagaaaatgaagtaaatagacttttccaatgtaacggaattaagaataacttactaatcttccaactactttctttccatcttctcccccattgacataaaagtctttcaataatccaggaagaaccctccaaaattcattcacaaactcccctcccttgcgtttactattttgcaggatatcatttgacaggtacaggaatgatactttcttatccttatttgcactgttatactgcttctcccatgtatcaacaacctttctggctctctttcggtgaaaaatgcaccaatttgaaagtgctgcttaagaattaaggaataaaaaaggcatgctattgtaatctagatgctattgttaaaaatatgctgtgggaatttggtatcatgactgtgtaaatgatttttacggcattgacatcaaacacaggaaagcaagtggtaagactcgttcagaagatattacatagggattcgagttgctaatatgtaagcaaacggacatgacacaaccatcacataatcccccaccccctttgtagcgtgaatttatggatgcaaatggataaatgctatatatatccttct

SEQ ID NO: 18647 - DNA, 673 bp, Oryza sativa
attgcttgcattcatgattttactgcttttctgtcatatattgccccattctcgttgttcacccaaaatctacacacaagcttatttttgtgtgcaaagtgctcaggatagattttttttaacaactgtactttagtacttacgacaaatcttttgttttcgcagccaaatctgctacaagaaattgatacccagaaagtaagttggaatcctcacaagcattgcttggcatttgtatctgggaagaaccaagttacagttcatgactttgaggagccaggtgagatctgctgaactttcttatgttgtattaataagatagatatgatgaactgaagcatgatggctatatgaacatttattcttgtatttaatgaactgaagtatgtttctcaactcagctgaagccaacaactaatcatttgtattctctgaacagataataaagaatcctacattctaacaagtgaccatcaaaaggatgttaaagctgttgaatggaggccaaatagtggaaaggtgattgcagttgggtgcaagtatgtcctactgccgccatatactagagcactattaaagatttgttttgatattcttttcatgtcataatacctagtggcacaatctactattagattaacttttattattattattttcaggggagggatat

SEQ ID NO: 18648 - DNA, 671 bp, Oryza sativa
atgatattttgaataaccacatctgcatctggttgggaagtcattcatgatatggattgtatggttttaaataaatcacttatggtatgtaacttaggatcattagcaagtaaaggcaagttctccctaatcaattgaagcgcctcaaccattttttttttcaaaatatctttagatctggcttgtaaaaagtctgtctcttgccattttagtatatactcagatgctttcatttaggatgaacctttacatgttcaaaagtctatcatttcatccattacagcctagaaaagtaacttgttgtccagtccatatacttatttatgctagctttctctggttcatctagccgaggcatagataaattagcatgggattcttcaggagagcgcttggcattatcattcaaagatggtaatgaaatgtatcatggccttgttgctgtctatgatgtgaggagatctccacttgtctcagtttcactagtgtaagtgcagtcctctaatttaccatgttatcttggtcatgaacattgaatcttgataattttggaccattgtctgacgaatttccaatgtgcatatacagtggattcataagaggacctggagatggagcaaagccacttgcatttgccttccatagcaaatttaagcaaggaccattgcttt

SEQ ID NO: 18649 - DNA, 645 bp, Oryza sativa
atagggcgaattcgagctcggtacccccaatcccacagcctagctagctgtggtgttggtatagtggcttgtgtgtgaaaaacacccgagagacagagagattttcatccatcgatcgatcgccatgccgcctcaggagttgcatggcgatgatcatggccgccaccaccaccaccagacacccgctggcagcggcgggggcggcgccggtgacggtcaccaccgcgacttcagttctccaccttcaaccacttcttcttcttcttcttcttcttcttcttcttctaccaattctcccaccgccaccgccgcgtcgtcctcttccaccaacacctccggcgccgccatcgtccaccccactacctcaagtcacccctccgtcgcctccggccaccactccgccgccaactcttaccctcttgtcctcaaggtgagtagacaagtacacatttgtgtatatatacatatatactactctgtcaaaaaaaatgaattcctagttacgaatctaggttgatctttttttgggacggaggggtatgtatgtatgtacgtacgtacgtacttgtagagctacgtgcatgagcatgttgacatatgtgcatgagggagggtggtgatgagacgtgaccatgcttttttttt

SEQ ID NO: 18650 - DNA, 680 bp, Oryza sativa
  unsure (1)..(680): unsure at all n locations
tataggcgaattcgagctcggtacccacacgtatgtatatgagcgtctgcacgtataccgaaatctgcaaaaataaagaaagagaaagaaatctgaatacgaccactacttgtgcacaaacggaatgcgcacttacatcaataataatgtataaaaacagaggaaatatctgaaatgaaaaaaaataatgaataagtgtatcaaaattgactcgtatggtggccagcttgaggccctgacgcacaaaaatacaaaaaaaacagaggtgtcatcttcagttaatgctgatgatggtgattagcaacccaaaaaacccatctctgcgctgcacttcctttcgttccccccctccgctataaattacaaaacttcaggggctccacttcgctgcctctccttctcctcctcacctgcacctgcaccaacgcgagagatcatggcgaagagatcgtctcctgatcctgcatcatcttctccatctgcatcatcctcggcgtcgtcttcttcctcctcttcctccgaggattcctcttcggccatgtcgatgccctgcaagaggagggcgaggccgangaccgagaaaagcaccggcaaggccaagaggcccaagaaggagagcaagggaggtggctgatccttctttcaatggcggcggcggcggcaagaggagtctatctaca

SEQ ID NO: 18651 - DNA, 687 bp, Oryza sativa
  unsure (1)..(687): unsure at all n locations
tnnnnnnnnnnnnnnnnnnnnnnnnnnnnnnnnnataactacttgtctcgtgggcaaacagaaggttttcatgacaaacctacaaagaggtgtcgcactctcacagcggcggcggatgatttacggcgtacatcgacaaagatagactgaaactagggtaaagtaaaaaacatggctaaaagtaaagataaaagaaaaagcgattcaagtatattatgtgttcgggggttacaattgaaccggccttgtctcttaaataggggttgatcttgccctctacaggccctcctccacgtccaactcgagctagaaaccaatggaatcctgaaacatgccttcccgagcaaggaaacccgagacccgacaaaaacggcgtctgactcgaactcccgccggtctgaccggccctctggtgtcggtctgaccggcccacatatagcggtcagaccggccctctctggaggaaatcggcagagccccaaactttggcaatttttcctatttcgatcctaggtactaaatttgggtgtaagcaattattttaagtaaatatgggtgtgtttagttggtggaaaagtttggaagtttagggaaagttgaaagtttatgtgtgtagaaaagtttttggatgtgatgtgatgtgatggaaagttggaaggttggataaaaagtttggaactaaacaag

SEQ ID NO: 18652 - DNA, 660 bp, Oryza sativa
tctctcctctctctctctcactgctgctctatcttctcctctctttgtgtgaggctggggccgaatgaggtggtcaatttcgttttgggctaaaatttcagaaattttggtgcaccgaattttttgaaaattttcattctgttatccgaaattatttgaaaatttaataaaatttgattgaattttaataaactttgaccaaattaaaaaaaaccaaaaatttcgacggatattatttgaatgccggtagggtgcgaaattacgcaaattgacaaccctgaccagcctaaactgctgtcgcctccccctgcttctcgtctgactcgtcgctggccggcatcaggccatcccctcctggtgctgctgtaaacggcatcatacttgattgagtcaatggggctgattcttaacaaataccgatcgagtagccaatcttgatgctatcgatttgtatatgactcaatcagtgacatgacgacaggctaattaatttgatgtaaattcaattacatttaacagtgtgttgtaaaaatgagattattatatatacatataaattggtttatggaactttgcctgcatagatatacttgtactgatttcaggcgatcgtacgtgcgacaattgcgccggctgcgtgtgtgcttctcgccgcgactc

SEQ ID NO: 18653 - DNA, 596 bp, Oryza sativa
taattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcatcaaggtagatatatgctataactttctattaattctttgtatcttttcaattttgatacatgttaactagtgccttttccataatgtctgttccacatgtattttcacgctttgatatgaatatttgagtacatagatttgaattatattataccatcttttcctccttagaaaacatagcatgttatggttaaaagtattgatgaaacttcctagctttccatttgaaccatgacaaactccccattccagagatgcgctttcaatgatttcagatggtcatgtatgttgttggattgcagtttattctttgtattgcagcatttcaaaaccgaattacatctgtgttcgctgcacgcagttgggacctatctcagcgcacg

SEQ ID NO: 18654 - DNA, 2202 bp, Oryza sativa
atagaagcccttctctaaaaaaaatttagaagccggctaagtttctaaaaaaggcggcatatatccgttaaaaaggcatttaaatccagttggatgtagttccctgtttctgtttgatatgctaagttcctaattttaaaaaggcattcaagttcctaaaaaaggctgcatatatccatttaaaaggtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattctactgaccgaaaatacccttctcagaaaaaaaaaggtttttcttactgagcgtgcaaaatccgattatagctgatattatgatgactcatgtgttataccttatgcagcagacaacaattttggaaaatcaatttgggttaccttcacttgttgataaagccacagctaacacaacaaaatcttgtggcatgtgcgtcatcttccatgacacccgatgaaataggagaggggaaaaacaatccagatgaggtaatgccattggcatccatcgcttgtttattttagaaatctatgtaatgtgagtgctttgtgttatctgctgcttgcatagcttgattgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggagatgagatcttgagctccatacctatccacacgaatacgcatattcatgtgacacccagactgaggggtggagagtacgtaccgcgtaacttatctatgtatatgtattttatcacttcctactttagaggtgtaacaagtgttcatttgcaggttaattccaatggaatatgagcgtatggatgaacttattgaccgtgcggtccgtgacaataataatgaccttttctattatgtgaaccttcccccagaattgataaacccttataaggatacatgggtaacttttctaagtgatttctcgagatatatcatacaccaactattggtatgtgtttcccgtgatggtcaccagcggaacattacttggtatggtacttttgatctcggggacatactgattcaagcgggcatgttaggatcagcccccatatcgtcgaaaatacatacacccctattggtggtagacttgattatcttaagctagtttcaattctaaaggataaattcgtcgataatttacaaggttcttcctccccttgccatctgaacaattaactttctgtattgtgcactacttcccatgaaacttatggaagatccgatctattcattacattttttataaaccatccgtgcttgttatcatgtgaagaaagagttgcacgataccttcaatatgatcatatgattacaaatcttgtgcaacgcgatcttcgcaaatttaagcaatatttgaatgatacttttggagatcctccttcttggatcgctgatatcagctgggttcctgacatgtggaagacatacaattatagtcctaataacaactcaacgttatggaccccacgatatactttggatctaaacagttgctcacattttgccaggaatttcttgaaccatttcggtcgtgaggttagtctttttttaattattattttaacttttctatatgaaccggtttaggcttttgtttgagcttagacttttaagcaactttttggctcatgtgatttatacaccaatattataggctcttatatctgccagttgtaaaaccaacactgatgaccatcattaattggtgctgctttgtaggtgacggctgccaatctagcacttatgctaggttagcagccaacacttagggtttatttactagtgcttttaagggtcctatcttcacttcacataaactaaaaattactataacttagcttttagcttaacaatataagagtagcttatggtttattggttttaaaaaagccaaatgaaaaaaaaaactaaaaaactgttgtttgccttagattttttagattataagcaggcgtaagcctataaataaaaaaaa

SEQ ID NO: 18655 - DNA, 824 bp, Oryza sativa
  unsure (1)..(824): unsure at all n locations
cacatgacagagtcgcgaatgccacacattagactcatcattctcgctaatatggttcacagcattatgattattacacatgtcattcaaagaaaagcggaacaagccttcgctgtcataacattttccaacaaaagtcccatatttagatacgacacatttattggactcaaacacaagtctaaaaccttctctacacaatagagagccgctaactagattcttctttattaaagggacatgctgcacgttcttcagctgcacggtctttcccgaagtaaacttcagatcgaccgtaccaacaccatgaacagccgcaagcgacccgtttcccatcaacaaggaggaacctcttcccgacctgataagaagaaaacagagaaatgtcagcacatatatgaatattagcaccagtgtccacccaccaatcaggtgaatgataaacagagagaactgtaggtaacattttaccgtaccccgatgttcctccgccctcgctaatgaccatgttggcagacttcctatctttgcgctcaggacagtccttggcccaatgcccagacttgccacacacaaagcaggctccctttgcctttcccttgcctttcttcttaaaattggntgcagccttgggtttgacatcaggcttgactttcttgttgttgggggatgcatgagggttcttcttctgtaccatattggcactagaaatttcctcaacctttttgccccggacgtcctttgccctcgctttctcctcaacacccaaagagccaatgagatcaggaacactgaactcttgtctcttgtgctttagagaagtg

SEQ ID NO: 18656 - DNA, 563 bp, Oryza sativa
gcagtggcggtggcaactccacacatggtgataagcagtcgtgcggaaggcactccccaaaaacctgatcacccgcctacccggtgcagatctcaggcaaaggtgtggtttcggaggcactgctccttccaatctctcgtgcgcgtaagagatcagaagcgaggaagcgagagcaactcaggcgcggagaaggagaaactaactccgggaaagaagcgatgatatcggatcggactcgcggcctccttatctatcaggagaaagaacgtgaaagcgctgttgcggagggaatcgtgggaacgtgggttagtggctgcaaaagccagccacgccctcgccctcgcccacggcccggcccggcgcgcgcgcgtgcgcgcgtgtggcattccgacccccacctcaactggtcaacagggagcctccaataactccctatttaggttgagatatttctcgcttaaatcctgaggtggtattattatcctcaacacttattatgggcctttgagatttaatattataagttgggcctagcccaattattctagcaatccccgccaaat

SEQ ID NO: 18657 - DNA, 352 bp, Oryza sativa
aaacttgataatggtgggttgtgagcacatggttttgagagtcgtgctcatgacaatttaggaccggttcacgagtttcggttgtgaaacattaaccgtgccaaccacaagccagcgtgggcaacggctttaccttttgtatagcatggttcattgcggagcaccagactgagaagtggcggagataagcccatgggggtcgctggggagtctatgccttgtttataagggggtgattatgatccaggaaaggtgcgctgtggtggattgtgttgtgcgaggggtactgtcacagctcctttccgaggtaccgtggtggtattgaggcacatggtgacatgttgtggggctg

SEQ ID NO: 18658 - DNA, 396 bp, Oryza sativa
gacccaataacccataacatgcaaagcatttgcccttcatttcatgacttaattaagaatccattccttgcaacatggtaaacaataatgttgaatgttaaacaatacttatttaaagagtgaagatactactacttacagacacatatccattagatgaagaccatggttctgacgtccatgtatttgtttcccataagtgaaaagttccatcactaattaaaaaaggaaaactatataaattttcaaaaggtatgagcaatgaaaataactaaagttgaagttcatacagcttagcagttaaaaggtaatctccactaggtgaccaccgcactaatgatatactacttaatccacgtcttataggcgttcccaaccctgaagcagaagaaaatt

SEQ ID NO: 18659 - DNA, 1574 bp, Oryza sativa
  unsure (1)..(1574): unsure at all n locations
acttgactgtgattgtagatggcaatatggaatcacatggataatgcatttcttcatattccaaaaaaacatcaatgcataccaaatacctgaatctgaagacagcttgagtacatgactattattattatgtcattgcagttttcatagtttcaaagtttcccacaggcaactgtaccacaaactttgacaatgaggtagcaactattgttaatgttttaaatatgttcaaatactatcttttttgttttttcgttttttgactagcaaagttcagccactaccaactgctctcttcaatccacgtaagtccacagatttgatcagccatttgtcaggtttaacttccaagttggttctagcccctgtcaatcattctaacattcttggacttncatagtagatggcatatggaacatgggacattagaagagtggacatcaacttgtctacatttctaattgtgtcacatgctcattgtatgactgcaaaagggccttctgaaatgaatagaaccatctgcggtctctgaacttaaaattggaatgttctaaaggtcagcaaggagctttatgattacctacacaatttgcaccatggatacacattttgtggcaagaatcgtttttgagacaagctgaagactgataagaacaatatatgtcatcagagtcttgacaagctagaagaaaaaacgctagacattcggcaggagacgtactgaatttatatgcagaaaagcaaccgacagtaagttcatacggtctcagtctcacagatcatgcgcatgtggttagaaataggccaatcttgtacaagtggaatactggaatatgatgaaacacctatcatttaggaaggttcagggaataaatatcaaacaaatatgtttcttttacatgattcctgtaactaatgcatacatggtgttttcgtgttcatgtctagaaacaaagatactttagtcttggaaaatatacaaattttgatgatattcagccagagataagctaatccgctgcgcctcaaaacacaaagggggttcggagttttagactccgagcccccttgggtctctgggctaccgtcggataaggcttgtgtggcccagattgagtggatccactccacagcgtgaggtgtcagcgacttgtttgggccgtcgtgttgcttgctggacctcaagcccagcacggacacatgtgtaggcccaacctcacacttcattgcgtttaggtgtgatcaagatttgacttcctgtgatggcatatgatctgtatactttccatttggtaataactattttttaataataattactccctccgtttcaggttataatacgttttgactttggtcaaagtcaaatttgaaataagtttgactaagtttatagacaaatatagtaatatttataatactaaacttgaatatattttcataataattttttcttggattgaaaatgtaactccctccgtttctaaatatttgacaccgtcaactttttggcacatgtttgaccattcgtttaattcaaaatttttgtgaaatatgtaaaactatatgcatac

SEQ ID NO: 18660 - DNA, 1113 bp, Oryza sativa
aacatttttgttgaatgttccctttattctgaacgagaacagccatttttgatgaatatgcgaatgctactaatcagtttgctgttgctcaagtaaacatctattcataatgattttcttagtttcatttcaaacatcaaaggggatgtagctcaaatggtagagcgctcgctttgcatgcagagaggcacggggttcgatcccccgcatctccactctaaatcgactattttagttctcttctccttttcttttgtctaattaaattttgtgctcttctaaattctagtctaattcagctatgtgttcctctaattttcttctaaattttcgtctattttatttctctttctttttattttgtctaattaaattgtgggctcttctaaattcttgtctaatttagctatgtgttcctcttattttcttctaagtttttgtctattttagttctcttctccttttcttttgtctaattaaatttgtgctcttctaaattcttttctaatttagctatgtgttcctctaattttcttctaaatttttgtctaatttagttctcttctctttttgtgtgccatatgttgccttttttggtctagttatttaattttctgctcaccaaaattttcagcgccttattttgtacgtgaatgtgacacgatgaattattttgacttttttttgtttaatttagttttttgagcttgtaaatttgtataacattttttatgggattctctttagtagtagtccctccgtcctaaaataagtggagttttacactgtttatgtctcacgtttgaccgttcgtcttatttgaattttttttatgattaacatttttattgttattagatgataaaacatgaataatactttatgtgtgactaacttattttaattttcttataaattttttaaataagacggatggtcaaacgttagacacggattttcacggctatacttattttagaacggaggtagaagcgtctttagtgacagtgactgacagcttggtcccatcccacatttcaacgacatcggctagagccatggctataggtaaacggggccatcgtttggccaaacggcatattggtaaacgga

SEQ ID NO: 18661 - DNA, 729 bp, Oryza sativa
gttattgtgtgcctcggctgattcctggacgagggttcacacacatgtaagcgtttggaattttggatagaaattccgggcgtgacaaagggtaaggttttggcactccattgcattatcttgaacccttgcaagagctctcacacccttgtgcacttagtttatctagtgaggtgttagagagtgagttaagccaatccaagtgcattgcttcattgttttagctagtgtggcacttgatcatcctcggcaagcatcctagacttgttactcttggaggttgccgcctcctagacggcttgtataggtgttgcccggtgacctctccgagaagattgtggaggaggcccggcaccgtttgtgagtggtttggagttcaccaccttcggagtgaaggaagaactaccccgagtgatcgaggcttggatagtcctctccgtgggtcggctcccgccttgcccaccccttgacgaagggggcgtgcggtggcttcgtgattgagcggtggagttgggctcgcctcaacggggattaggaaaccggcgagtttccgaacctcggtgaaaaatttcttgtctcttgtctcatttatttgttgtatttacatttgtgctatttacattcatagagacatatttgagcctataacacataggtttgcaaaacttaacttagttgcttagttaaccttgtaccttaccttgcctagcaacttaggttagttttgtt

SEQ ID NO: 18662 - DNA, 826 bp, Oryza sativa
tattaatttgattttatcacactgaacacatgataaagcacgaaaatttaataggttacatatgcatgcttataataactaacaatttgactaaaatgatttgctaattactattaaatggttatatattatgatgaataaaagttttatgattatatttataacgctacacacactcgatgatataacggagggagtatatttgaatacctataaattttcataaaaaaacaagtggtcaaaatttaaacttgaatagtgttattaccaattattcgaaaacggagtgactatatatcatatatatgtatggaaaacggctcaacaacatcctaagcatgaaagcatccaaattttgctcggttacacatcaagtgatattataacatgtcattaataaagggcattatgcaactaatatcattttcaagctgggatgaaacttggtgtgatgggtcacgacctccttgtgcatgttaattttgtctctatataatcgagcaaagattatcttttttgagctaagaaagttccatgtcttatcgtttgacgcacagcagataccaacaagagttggagctccaaaacgacggcatgcatgttctgaaaggccatactacttttgattttgtgaggattcatctcacatgcacgcactagtttaaaaaaaaaattgaaacgaacatgtgtatgtgaaacacatgggttaatatatttcatcaaccttgaattttgaagtagaagaaaatggagttagatgatgtcaaactgcatgtgatctgtgccctgctttgtctcgacagtcaacaccaggagctgagctgtg

SEQ ID NO: 18663 - DNA, 791 bp, Oryza sativa
ggctttttctactgcttccaacatttcttttacacattcagggacatggttttcgcacagaactaatatctatgatgttggacttaaaaccacgattcttgagattccctggtatgagctatattttccaattgaaaatcaagttcttgatatctgcacatatatgtcagacgtgtctgggataattgacttgatttccattcaaacaattgtaggaggttgcttcgtggagggtgaatggttaagaaacgcattcaggtggagggaatctattggtccatgggaagagaggcctggacactttggggatgtttggcattactggactgatgatggccttggatattatgagtttcttcaggtaccagtttagttgacattatttccgcccttcattttcttatcactccctaatcatatattggctttgaattctatttttttttctaatgaaaaatttgaactctacatcaaagctttctgaggacctgggcgcttgcccaatctgggtgtttaacaatggtaataattgccatattttttatatctttatcgccacagctgacctccttaattgctactaaactcttttatatatcaggaatcagccataatgatgaagttgatactgctgcaattgctccttttgtaaaagtatgttctgaactccctggtttattttctgttaagtcagatgcaccttgattcgctaaattgtttccactttaaaatttacctgcaacatcctagctatgactgggcattactatggatatggaatgtgagaaaat

SEQ ID NO: 18664 - DNA, 1127 bp, Oryza sativa
taatttagtcacataaaatctccatagaaaacccttacaaggtgacatttgtttcttacactatttcaattagtatataatattaatttttttatgtcatatgttctttttcctcttttatactcacagtaatatacgttgttattttttatcgttgcaaataaagtaggattagtaatacataaaaacaagtcctggaagcaaaaactactaaaatgtggttattttcattattttttaaaaaaattggatgcaatttttttatgtttgatcataatccccaatggtactgcacaagttttacttgaactgtgtggagagcaactgttgagttctccttttaggtatatgcatgatgttctcttatccgttatacaggtaattacctcaagttttataatgctataagggaggcctatccggacattcaaatgatttcaaattgtgatgcttcatcaagaccacttgaccatcctgctgatttatatgacttccatgtaaactactcatcctctggagttctgttatgcagtacttctcattctgtcaccaatgtcaaggtttttcccatttattaaattctaataattcctttttctctaggtctatactgattctaagactttgttttcgatgaagagtgcatttgatagatcatctcgtaatgggcccaaggtatgttgtatacctggactttcattgctgtgtgaaccttttcatttatggagatgcttgtaaaacagcactgtgaatctcccatctttcatttatattttacattaataatccaggacttctcttggtatattcgtaggatgaccttggccatctatgttttaacaacaattcagtaacatccacagttcatctatgtcacgtgtgatgattttttccatgttttggataattttggaatctcattgcttctcttgcttattcacttctatctttacagatgtgctgcctatttatctcttctcatccctattggccattaaatatatttcttcatatatgttttggttgcaggcttttgtcagtgaatatgctgtttggagaagtgatgcaggtagaggaagtctacttgcttcattggcagaagctgctttccttactggactggagaa

SEQ ID NO: 18665 - DNA, 758 bp, Oryza sativa
aattatgataaataagttagtacttacatttatgtacaatacagatggtggaaagagcttaacgttgaatccaacttaagcttcattcgggatagaatagtggaaatgcatttttggatgacaggagcatgctcggagccccattattctcttttacgaattatacttacaaagatgacagcatttatcaccattctagatgatatatttgatacatatgctacaaccgaggagagcatgatgcttgccaaagcgatatatatgtaagccttcattataatatgtggtaatattaattgcatctttattttgtagtagctagtttatactaagtgtgaaatttctagttgtatgtggaatcaatttcacaatagactaaacacataaaaagtaaattataacaaaatcatagtataaaggagccaaataactctatgaaattatatatatgcaatgcacatgtatatccgtacatgttctgatacttgtaatctattcaccatgttgtattaatatattaatcccatgtatgcctcattaattgagaaaaagagtaagcatattaaattttctcctatatataattaccaaagatcaaggaaaacaattttctcttagaaaaagaaatgcaaacatttaacctatctgggcattaattgtaacggttacttaaaacctcattgtaatattaacagttggtcatttgctgccatgcatgttttatgcaatatgaagttgatacataagttaaatcataa

SEQ ID NO: 18666 - DNA, 784 bp, Oryza sativa
acctctatatgcatgataataaaggtccaatcgggccaacagtatggctaccgaaggaaatcaggatcaagggagaggacacgtcactccagtctccagacgtgctctcgtcctcgcctgttcctcttctatttcccccagacctcctcgttccttcaatcctttcctgagacaagcgttggtgttgccacccctgtctcttctgatttctttctgtgatttgtttaccactcggaccagttttgctgacttgcctgtaattcgttttccctcttctatagatctggttcagagctaggagacatataaaggctcagattggtgattcttactaacagtaggctgctggtatgattttcttggctataatgtaggagtatacagaactaagatacagttttggaaaggttctaaagactagtatattttgaggtgttttttcagatataaaaatctgaggtattcatgttttgttagtactatttcaaattctaactaatttgcacatcaaggtactaatgtactccatattttgttagtacttgtgttcggaggtcaaggtagatgtgtcttgtttagcccatattttctgattgttatcccgtagaatagattgctcattttagccttagttcgtgcagatgattgtagatgatcaaagcttttaatacgcatcttgttgcataaggttttatttgatatatgcaacaacctagagaaaaaatctgtctggtatgccatcctgttcttgtctttgattctgttctttgagttggcttcaaat

SEQ ID NO: 18667 - DNA, 1416 bp, Oryza sativa
cacccctccctacaaggagccgccgccgcctagccaggctatcaccgattcctcctccctgtgagaagctgccactgccattgcctggttgggccaccactgtcgcctcctccctacaaggagcagctgcctgactgggcctccttcctacacggaactgccgctgtcatcacctcctcttcgccgcctggctgagctgctattgccttaggtttgggggcatgaatttggatttgggataggaaaatgactcaagggtattgtttgcatatggcaaaatctccacgggtagaaaggttaactgttaagttgaaataatattatttcttgttttgttactttttagtttagcaatcctggacccactaacttctataaaaaatatttgaaaagaaataatgaaaaccaaaaaatagggaaaaacaatatcggaatcaaagtagcagcaagaataaaattgtcccaattcaatatgatggatgaaatgaaacaaaaagacgattatatcttgctgtttcaaattgctatgtgatgcaaaaattatgaaattgtttcaaaatcacactacaatatgtaagtaaaaaaaaattaaaaagccctattttaatctggttggggtaacttccattcgaaattaatttactagctgaatttgattgcattaattacgaactctatacttataccagtaaacattggtccttattgtaatacaatggttgacatattaatggagtctaaatagttcttttttttaagaaataaggttataggacccggctaattgttaaacatttatgtccccttaatgcacatctttataaaattgactaatgcgtgcatgcagtcaagctttacaaagtttcgcaacgatcacaaacaagtatcaacatttattatatgacattgaattattactagcctttagggcttaattgatcatcctcttatatttatggcctaaaatgtaaaggcgcaacagagttttgaaagtaatctacgcgtcttgagccaatccatcttcttgatgattttggtttagcttatagcaattatcggtgcaaataccatgtgtatatggaataacatgaccaacagtattataggtggcaaataacaattaacatcggtaccattagttgtggcatacaaaatcaaataacaattaacatcggtaccattagttgtggcatacaaaatcaggaaaaggctccagggtgttggtctgaccggctataggtagcccgatctaaccagccaggtacttggtctgaccgacggctataggtagcccgatctaaccagcctggtacttggtctgaccgacagttagtgagatggttagaccggccacaagaggcatgatctggccgaggtagggcgcagtctgaccagtcatgatgagcacggtctgac

SEQ ID NO: 18668 - DNA, 352 bp, Oryza sativa
cggcaagccggcggcggggtggtgcgcgaggatgtcgtcggcgatcggcggcggcggggaggggaggaggaagaagggtgcggcggcagtggcgaaggagaagacgatcatcagcgggatgtccggggttgtgcggccgggtgagatgctggcgatgcttgggccgtcggggagcggcaagacgacgctgctgacggcgctgggcggccggcacggcggcggcggcggcggcgggcgggggatgctgtccgggaagatcacctacaacgggcagccgttctccggcgcggtgaagcggcgcaccgggttcgtgacccagcacgacgtgctctacccccacctgaccgtcgcc

SEQ ID NO: 18669 - DNA, 344 bp, Oryza sativa
gaggcgggtgtctgatataataacttttccaacaagggtacgctggtgatagtgcatatatataacttatttccttatttatatataggtgatatcaactacatttcattacacgcagttgtaggcattatgaacatctctgagcatacttttatttcctgttggtttcaatttcaccagccatgtgagacactttgacttgttcttgtaaccttgcacaataactctttgccagtgtctcttattcccggacttatttgctgccacccctgaaaacaaccatgtggacttgttatggaattgttgtagcttgacttccccaaagtcacacaaaccaccttttt

SEQ ID NO: 18670 - DNA, 648 bp, Oryza sativa
caatccctagtttctgcatctaaatctacctagccaaagagattctgcatctaaatctacctagccatagagatgagggaggtaaaatagacttattaccaccatataatgtacagcccaaagagatgagggagacaaattagacttattgaaggacaagcacggtggactagtcatgccttcaagccggcacggcacagtccgagcctaggccataggtacagcctgtggacagacacggcagggcacaacgagttggtcgggccgtgccttggttgtgccctagcagagccatgccagacggtctatttggccatctatagttggagctccatcacctgcaacttgtgtggtgacctgctctcttctcacctcctcaccaagctggaggccgagtggccgatgtcccacgactcgtaggtgtacttgtggttgacgtactaaaaaaatcgtgtttgatctcagattatagtctcagagcaatgatcaaataaaaatcatgttaacagattgaatcttcaatttcccactcaaaattgggattcttgattttttttcctttctaatttaattctttcttgtttgcagcccatttaatttgtccattatttccacctcaaccaagtccagctgatgagtctttttcct

SEQ ID NO: 18671 - DNA, 298 bp, Oryza sativa
gctatagtttctttctgtggcagcactgtttattgtaaactgtcgcaaaaaaaaaggatactactttcaattacaagctctattttgcatattattcatataggaatgcacttataaaaatggatagaactcataccatgccccaaaatcctggattgtaaattccaacaccaccggctggacaatcgtcacagacaacctctatccttacagcaacaggattttgactgaaacaggatgagcgatcagttgtcacgtgaacagaggattcatctccaatgatggaccatgggtcaat

SEQ ID NO: 18672 - DNA, 307 bp, Oryza sativa
cgagtatttaccagaaatctccacaagaacacaccccgtctctgaagtgatggaaccgggtacggtccctcatgacaatctctctaccatacacccgagatacaagctttgcgctctcatggcaatcggcacacacccggagattcttgatgatcctaatgggagctcctggattggaagcgatcagagcaaaggcaatggcgagcctctcgctgtggtaggacagtgtatccgccttgtcctcctcctcgacatcaaacaacgcagacaaggtgctcgaccggcgtccgcactcgattaacctggt

SEQ ID NO: 18673 - DNA, 757 bp, Oryza sativa
  unsure (1)..(757): unsure at all n locations
tttgccaataatcaatccgtttgatttctgcctaccttgtgttttctgtgggattgctaaactatcaaactgtgcgaagctacgaaaaaaagaaatgctggaatttttcagagttgggtacatggatgtgccactgtcgtgcagcgcattgccaatacgccgactgctgtagattgcaacgtgacggtacgcgtcgcgcgttggcggctactagcgtttaattgtgtagggatctctgtgcggcgttaggtctcgccatggaagggaaagggagaaagccattacactagctgtacaggacggtctggcctggcggtgcccacacatgctgtgaggagcgtgtggcaccgctgctgcaaccacaacaacattgatgtgcttttcacgtaacctttttaccttacgtgccgtccttttttagaaaaggaaaactctcataactttattagatcaaagagcagttacatcgctcactaaccgcttaattgaagctactggctcctccaaccaaatagatggtggattaagccaggctgctctagcaagctcgtgagaaactaaattagcctctctaggacagtaaacaagagttaccaatgtagaagcttcagaaagaaccacacattcattatagatcgccgcagctgctgtcgtcgagaaccctccattttgcatcattgtgatgacttcgnnnnnnnnnnnnnnnnnnnnnnnnnnnnnnnnnnnnnnnnnnnnnnnnnnnnnnnnnnnnnnnnnn

SEQ ID NO: 18674 - DNA, 744 bp, Oryza sativa
  unsure (1)..(744): unsure at all n locations
nnnnnnnnnnnnnnnnnnnnnnnnnnnnnnnnnnnnnnnnnnnnnnnnnnnnnnnnnnnnnncatgctcatgtccaaaacgataattattatcaacccggagtgagtactactttattctttgtcttgcggtgattaatttcctacctgcatagttttccttctatttaattacgcccgcctttcacagtgcgagtacatgtcgactagccctagcgcgccaatttggatttacgctgatgtgttgactccgcgcgagctcctgctgagccgcaacgcattcttcgaccgcctcgacggcacgtggcgtgaaaactcgaaccacgcctgtgctgttgtaacatcctaaaaataattattttctaattcagcaccttaataaccttctaaacctaggagaataattagagtaacctcctcaaactaaccaacatttaatttctattgtgttttttatttaaaaatatatttggctaaattgatgaattttgtgattgaattttattttcgaatttcaaaacttttttagactaaaattcctttatttaatttaattgaaaaactttttacttgtatgaattatggtctaagaaatcctctgatattgcccttgaacttcaaccaccgtaattctgatttcattcgaattaatccttaaccaaaaccttggatctagagttatctctaattctcctctatccaatttttttatataaatattccaatagtcaattcctatctagtc

SEQ ID NO: 18675 - DNA, 4661 bp, Oryza sativa
gaaaagtgagtttttaggccggctcctcgtccgtctcgatccgtgcatggaagaatggcatcctaagccttctaattcgatgcattgttgcatggcatcatttggcctgagatttgtgtgtttgctgccatgtgtggtgatgtcgctgtcgttttcgacgaggccacgttgcatgtgaagaggtagtgaagctcaagctgaagggttcttggtttgtttggctggctggtgttatgggtttgttggaattgtgccatgttttgggtactgtttttcttgcaagcgaagttggagagctggattgataggtgaaatacttaaagaactgtggccctgaggtatcagtcctgctagtttcttcagattcagaaacaattctcctctgctactgttcaaatgtgaataaatgtggtagaaacaagaagattatattacctgccagcaccaaatgagatggcccatgatggtgtcctctctttcaattcaccaagagatgtttagagacctgaggccttgtttagttcgcaaaaagaaaacttatagacgtcacatcagacgtttaaccggatatcggaaggggttttcggacacgaatgaaaaaactaatttcataactcgcctggaaaccgcgagacgaatttattaagtataattaatccgtcatttacacatgttggaaggggttttcggacacgaatgaaaaaactaatttcataactcgtctggaaaccgtgagatgaatttattaagtctaattaatctgtcatttacacatgtaggttactgtagcacttatggctaatcatgggctaattaggtttaaaagattcgtctcgtgattttctatggaaactgtgcaattattattttttaatctatatttagtgcttcatgtatgtgtccaaagattcgatgtgatgtttttggaaaaaaaaaatttaaaactggcctgagtattgatttttagttgctgaatgaccacacatcatcaggacatctctacccaacaatgtaggtagtaaacaaatactatcaaagctgtttggtcaggtaaatcattaggttggttaagtctccattacacataactgaacttgttgattgattggtgatgcagctgaacagtcaggtcatcactagcctactaccacccacgtcctaaaatacaaacattcttagatgagcacggatgttaaaaaaaatacgtagaaatgattagagaaacaatataattggttgaaaagaaaaaaaatagataaaaacaattaaatggctaatggttatgatttatcgagagaagaagtaaataaaagaaatagctctattttaaaatagcacactgtactacaataactatattttgagataactatatgcgtttagtttccccctattcctaacttttcatcacatcatatcacataaaaactttcctacaaacataaactttcacaaatttttttaaactctcaactttcttcgaacttccaaccttttttagaaactaaacacacccgaaatgaaccaacaggttattgagacatttgtcagttgggtctacggttaggcacacctccaggatcactgcatctgtagttgcattattgaagctgcagggaacagtgtgtgtgcgtcagtggtcacacaggcaggagaagccgtgggaacggatacatgtagcacaccatacggccggccccataattagagggacttgtgcctctgccaactgacgtgtgggctcacgagggtgggtcccacgtgacagtgacacatgtccatctttactctacgtcggaggaactgcttcccaatacggccatgcattttggttggtctcttcaggaaatggagcattgctatatgtttgtaagttgcctgctggtcctgctattggcattgtgaagacactgttttagacatttcctttttcttgctcatagatctgatctggggtttatggtgagttggtgacagtacatacaaaccaaaaaaaaacaagaagaagaaatacatggataaaggttttaacattatcaaatttcggtagggtaaaagaactacccgacctcgacgaagtgtaacacattgtgaggcgctaactgttgccgacatgtgctcgaaatcttcactgatctaagttcaattatttgctttgatattgacctttttggcggaaaacaaaaaggttagaggcagagggtacaaatctataaaagcgagtactactgattagcgacgaaattcagaaaaacaagagtcttagagcacccacaatgataaattaaagtgctctctataaaatatatacatctcagcaatagactagattaatagtaaaccacctcaatagtatgtctacatgggtatctataactctctaatgtattgtctcgtttttctctatagactatctccaggttagtagatagctttgttctctctcttcatttaatctcttccaagtagaaaaatatgctgatatgaatctcttgtagagagcctataaataaccattacgggtgaccttatcaattatcaccctactctgtgtactccaaatcggcaggtactgatcaccgtgatctctgggaaatgaaatttgacaacatgtaaccctataaccactaaccttttgccttttggttgcacggctctaggcctttttgacaatgctagggaaattttaatgcagagttatggcagcattatgggcttgattagttggtgttaattcgtctttgttgttctgtccaagttgttcttgcataaggtagttgaggaatgaggattggaatgaggaacaatttggccaagcaaaaagcttctgatgactttttttttctttttctctgcttttatattttggagcgtctctgttactactactgtaccatggcagtacattgaagtgacacactctctctctcagacagacaggtgatgtaccttgacagtgtaatgacacgcggtaagtgactttgttgactgtaattttttcctccgtgagttaatagcacctttaggccatgtcgaaactgacatactgaattctaagagcgttcacagagcgtcacccactttcactgttcctcaaataccacctagattaggaacactattagccacacccttcgcagtgcaggtttattgtcgcgggtcccaccatctctctcaagttccttcttttcgcctccgccaggggtcccaccatctctctccttccttcttttcgcccctcttttcgccttcccctagcggaggaagcgaggctaacgtagcgacgctggtaccggcaacgggcagcggcgcacgagcagaagatgacaggagctcggcagcgctgtaggtatcggcggcggcgcagcccaagcggcgccagcgatggcgggagctcggcggcacacgagcgaaggacgacacgcgggagctcgacggcgctacgaacgagagatggcaggaactcggcggggcggatctggcctcctcttcctccggcgccaacagcgaggttaggtgccgccgccaccgcctcctcttcctctggcgccgccccatcaagctcaccaaatccggcctcaagttcaccggatctggcgagtggcaccattttgggggctcggcgcggtttgctcggggcggtggcctcgccggtgaccgagaggaggagaacgttggaggggaatagcatcatggcagcgcgcgaaaccacggagcgacgaggcgatgacctccacaacgccgcgcccccgcctttctccccgtgccgcatacctcgattccagcgaagttcgtgtgaccagttttggctccgcggctggctgacgtgtcgtcgaatattcggttctcggcaacaaggggaacgacagatcctcccactggtgaacgccctaagagaaactgaaccgtataaattactgaaaatatgtctgaatgctttacatgagaaatataagaaaattaacaattttggtagcagtctctaatgggtagtagaatcaatcttagtcctattttctagatatatggtacatatctatctacactgccatatcacctaacagtagtaaaatagtttatttatgctggcactaatagccataaatcaatggtttaaattgtttctactaatgataataataaatatttggcagtgcttcaaagaagattatagatttgtagaaaggagtgatcttcttggcctccttaggaacacaaaccttaccaaaaaaaaattgcaggactttcacatggattagttcaatcctgtaagaactaagagaaaattcatgtgctacaaaggatccattgaaacagtccctagaatattcgccattgaattcctccatttttttctaggatattcttatgctaaagaaaacctaattcataaacatgcacgtgattggcatcttgcaaacactacataaccgcataatgataggaagttagggttagtgttagggtcaaggaggtggaggggggagggcctgaagggaaagctgggaagtggaagtggtggatcgagcttagaagcatggcatgggagatggcgcacaagtggtaggcagtccgtgtcaagaaaggtgggaggcgaggcggttgtaatggccaatgcgatccaacaaaacctttggtcggtcccacgtggggggcaaagc

SEQ ID NO: 18676 - DNA, 2880 bp, Oryza sativa
  unsure (1)..(2880): unsure at all n locations
gccaccaccgcgctcctcctggccgtcctggtcaccgtcgccccctgcgccggcgcccgccgcgggggggactcgccgccggagccgtgctcgctcgggtggaccttcggcattgccgtcggcgcgctccgcgccgagctcaggccggacccggacggcgctggcggtggcgccgtcgcgctccttgcccagctctgctccttcgtcctcggccccggcgacgccgcctccgtgctccgcgtcggcgagatcatgggtgagctctgcgacaccggcgattcttgcctcattctagaacacaagccagccgtgctgttcgaccacaccgagctcgagctcccatggcatcaggccgccattgacgcccaaatctccatggatcaagaggttcttgacgagatcaaggacggaatcgaggagaagaaggtcgttctcgaggatctaaaccagctaagtgctccgcatttttcttcagagaattgttcatcgaggagcgacacgtcggtgcaagacattcagcgacagagctttggttcgtcatcagatggcgatgggttcagtgatggcgttgaggagaagagactggagtgtgaccctgtctcagtggagatcaagaaatgcgagcctcccgcgaaatcgctttcttcggtttctcggagaatcttgcagtgggaggcgcaggcttctggcaatttcaagaaagttcttgatgaaatggaggagaattcggtggatttcagtttggagaaagcctcgttcctggatttcaaggaatgcaacaaattggatggtggagcttacactgaaaaatgcgaagttgaagaaattgcttctgttgcagagtctggcatgcaccaagaagaacaagtattcaaggatgtgaaagaatgcgtgcaatctgaagctgaaacctgcactgagaaatgcagcaaggaccagcaatctgaagaaagcgtagtggtggttcagtctgaagaagaatggcaagaagagaacctcaaaattgttcttcctgagccagaaatgcaagatcaggagtacaaagatgtggaacctgtcaaagaattgcaggatcaggagtacaaatttctgcaacctgaagaagaagaagaacagcaagaacaagattctgaaaatgatgcacaacctgaagaacagttacaagagcaagattgtgacaatggcgtgcaacctgaagaagaagaagaatcgcaggagcacgagatgcgactgcaagaatcgcacgatgatcaggaggaggagttcaaggacgcggcggaccaagaatctccaagggaggatcccctccggccgtcgacgtcgatcgcgcggcgggtgcactcgcggacgtcgtcggagcacctcctcgtcgtcggcgaggggtcgccgcggaaggagaaggagtggaagcggacgttggcgtgcaagctctacgaggaacggatgcagctcaagctccgccgcgaccgcgccgtcgtcgagtcgtccagcgacaacatggacatgctctgggaggcctacgaggtcggcggcggcggcggcggcgccacctccaccaagggcggcgccagcaaggcgaaacgcaagcaagaacgagccactgtcgaacgcaagcaagaacacgcgaccgccgacgaggaagacgacgacgacgacgtcgacgaggaggaaggctcggtgaggcagctctgctgcctccaggctctcaagttctcgacgaggaagatgagcttcggcggcggcggcggcaagccgagcctggccaagatctccaaggtgctgaggagggtggccgcgttgtcgaggtccggatcgcggcgaagcaccaaaggttgaagaagaagaagaagaagaagaagaaacaccagcaatggcgatgaatccatccaatccaccatggactcaatgcgttgcatcaaccagcaatggattgctcactgtatttgtgctcctttttaattgctcgaatttttcttctttttctttttctttttctttttcttttttgaagtttgtgtagatatatgatatatgtgtacccaatggtttcagagagattgggtctggtaattacagggctgtcactctggcatgctcaatgtaataaagcttaattgggtgtgtgttacttttgttagctttgtgtaaatttctccatgggagggactatgggtaaggctttggtgtctagttcagatttcaaggaggcaaaaggcaggctatgcatcatttctttctttgctttctgtgctcaactgatatatatacatatataaattctgaaaacaagaatggccaatcttgctcatatgatttatgcagattcagtgccatttcaacgcaaagatttttaacatcctaaatgaaaatccacatatttttgacccgacttctcaaatagcaaatgcgctcctgattgatcactttgtttttatatagttcaaatgttttatatcaccggactataccatcaaacaaagccaataagtttttttttactttagataaaaaagtatatccttgaaaaccgattctaagaatatagtacaattgcatgtaataccaaattcgtacaaaagcatcatatactattactaatatactaatagtgaagccaattggaacgtacgaagataaccagtactgagttaggctttattttttttggttattgaaaattatcatcgtggcaacaccatgttgatcacttttgagttacaatatctgggttcatcctgaattcttacagtcttaacacaatggcagtgacaattatctgaaacacagagggagtggcaaaatggcattgtttgctagtnnnnnnnnnnnnnnnnnnnnnnnnnnnnnnnnnnnnnnnnnnnnnnnnnnnnnnnnnnnnnn

SEQ ID NO: 18677 - DNA, 21966 bp, Oryza sativa
  unsure (1)..(21966): unsure at all n locations
nnnnnnnnnnnnnnnnnnnnnnnnnnnnnnnnnnnnnnnnnnnnnnnnnnnnnnnnnnnnaatctacctaaggctaagactatccaaggacaacaactgatggtaggtaggctaggctagagatgactttctatgagttttaattatctaaactaagcaaaggtaatttttcaactgatggtaggtaggctaggttagagaggattttctatgagttttaattatctaagctaagcaaaggtaatttcctatttgttgcttcgggtgccgacccctgctagtctgctagcattgtttcggctatagctctatgatgtatccgaacgtggaggattaggattacttggacgggattcagggctgtcaccacctgccgcctacctctgacaaatctgtgggatacacaacaaacaaaggtatctctaacctagacaccatgtctaagttattaattactactctaatatttgcgcaggaacttccttctctatccggagtcctagtacgagagcacttagtatgaatactaaacaatgaacccgcaaagatggaaatatatcttactcagactaaataattaaataacataagaaaggaacacgaatgcttactttatagaagttctccgaacctagagcagagtgtaccgacagctccggtactcctccagaattcctcctaggaagctacactcgttgaggtagaagtcggatgagcgctaaacttccgggcactcctccagagcttcccctcactctctaccttattctaatgtacaaaagatacaatagagcctcttgtaattcagctcaaagttgtgtgtcttggaatgaaagtgcagacctccttatataggctccaaatgacggttaggggtatgggaaatgaccaaaacaccctgcaactgccataggggaggaatccaagccgtccacgtggaagcagacggtgaaaggtcgcataacgggtttggccgaactggttggttcggccgaacccaaaaagtgtcctcccggcctctcctttggctggtaggttgcttaatgggcctctaataacctgcactatgttttggcccaattctaaatggtttttattgacttatggggcctctaatccgtgtaaacgtgtcttggatgtgcagaggtgcattttgtcgtatgacggatgtgttttcacctcaaattacctgcatacacatattgcaccaacactagtggtaatgattagtaataatacctaccactaagttggataccatgttttatttcattatatatatgcaggtattgacggtcagatattatgatttaaggaccgtcaacaacacccccacacttaacctttgctcatcccgagtgaaggctatggactctacaatagagttatgacttccttactaacaatcatgcaaacaaattattcaaagtcatacctgtacttgtggatctttgtagtgtctaccatgcagtcctgggcaattgagaaatggaacaatcttgattcaagtcaccctaacttttcaggaagaacaacttggggtttttttcaagtaagacgaatattataactttgctttgctcctccattgattctctcgatcactcaaagtgtatgattcctcacaaaggcatatgattgtgccttttcttttcctaccatctaataaggcttatgtggagttcagggtatggaaaagagtagagcattgcttgcatcacatatattgcaaagtaaaataatggatccacggaaatacaagacatactttctggtcaagaatgtgcatgtgtatgtgtatggtaaatttgtgagtggaaaaaggaaaatgaaaataactccttttgtatgcctcctcctccatttattttctcttttgaaatttgggagagtgcatggctatctttttttttcttttttttttctcatcatcatgctccatacttgtatgagcacttttttttcatagccatgcccctctctctctctcttttttttaaagaactttggaggaagaggcacaaatgacatggagtatttattttgtggactatggatgaaatgaatgacaaatgaggaatgctaacttccagtgtataagtcaagcatatgtgcgtgtatgtggggtgtgtgtgatcttgaccatgaaagtatgaaaagcatttcactagggtcacaaaacttgacaacgctttatgaaatgacaagcagcgtatgtagcaagctaatcatgaatgatcaacctatggctctaataggaataaaaagatcaatgaggaatttagcatcattatatgtttttttttctttttataaaattcccaagtgtacaacatgaagagcaagatttctatcatcagactatatcacattcatcaattaccttgatagcatgggatccctattggatttgtcactacaagaaacaagtaatgagcaaagaataataggcatgcatgttattttcagggagaccatgaactctaattgtaccatccctagcttgagtttaattatcttcgatattttagaattgataatcaaattaaactcaagatagaatggatgtcccgaggaaattgtgcaaacctgagccctgtataaaacagagaacgattcatgatagaggtggttcagttgaactggaggttcgactgtcccctcattggttctgactgcatcaattccccttgtgtggttcgtcatggctgatcactcctagggtgatcttgctttggtttcggcgttgatgtgcaagatcacccccacacatgtctttgtacctggggctctttattggacacaaaaaagaaaaacaaagacgagtgaagcaaaaaggactcacttggttggaagaccaaggagccacatttatttattttgttttattttcttgtattttctttttttatggcaacgatggatttggcaggatgaaaacatgggatgaggatgcacaagttgttgaggattcttatcagataggtcttaccaagctttgaacctcaattgaatgcaaactgtttttcatatgttctgcttggttccatgtgcatctctttcccatggacaaaggagcgtgatataagtgtttgaagttattgtacactgctccttgattgtcattttatttcctgcaaaaggttagtggacaaaaaaaaaatactcgaagcactacaaagattttatcatagcctcaagattaattgttcatatccatgctaaaatgaaattagatttaaaacttaagaagcatggatcccacaagtttgccaagattttattttattttgagagacagtccttttattctgaaacatttttttttcaaatttttattattcaccaaattttcatttaagcacaactcatacatggctgaggtaaatttgcatgatcatgctaaatgagcaattagtaatatacgcaccgtgcaccttgataggtgatatgtgtctcctttgcatgttagcaattgatttgttcccggccctgacctacctctattgtgaattgaacttgaggactcacccatcaatttgaaaactttcctgcaggggttagtccacagaagatatatatccaatgtctatgaacaaattaactatgagagttcattaatcaaactcgactccatgtctaatttgattaaagtagactagtttaacctaagcaccatgcttaatttaaaaagcctatggatgtctcgcgaaaacacccaaaacagagcatacgcaaaaagacataagaaacataaccatgtatactcaagtctcattcaaagagagataagtatgagtaaaagatgtggtgaatttttctgcctttcgtatacctgagtgcacttactgccaacatgatgtgtatgttgaaatctctggagcggtggtatggccacatatgattgttgatttctcctccacctcaatgcagattgtaccggaggaaggcgctttgaccataccaactcaggcaagcagtttggtcatgcacacacctcgggtgcaagaaccttatgccttgaaggcgtgattcgttggcacagagacgtaggatgcatctatttctgggcaaatatgcaagtgccaactagagtggagcagcaaacacctagaaaagaagagggcatctcctcttgcctacatgcgtgtaggtgttgcgggagcgagaagttgtgcacagctagctaggagtggataaagtctaaaccaaggtggcacatgagcttgagagagggactgggagtaggcagcatgattgctactagcgaggtgtatcgccatatttcaaagacacgcacataatgcggtctttgatccaaatgcagctcgtcagctctcttgctcttttcttcttctcccattttttcttcttcttttcttctgtctctcttttctcctcctttgttttattatctttttttagcaagctaggactaacaccaacttcaaactaagatggccctagttgatggaactcgtcatgaaaagctcgtcgaccttcccccccacacttggacttttgtgtcgcaagacatcaaaaccaagtgtgtgatgtcggattctcctatagagtgtgttccaataccaaggatcaccaaagtgtacagttgatgtagctaccgtgttcttaggcattgcatgaccctcgttcttaatctcaatctgaaatgattagtgaccaagaatacccgaaggtgcatattatcctaagaactggttcttgcttttattattaaggaaacttaccatgataatccagggtatctcctgacagtgctttgtttatggtcaaaagcttgaccatcggaacatcgctctgcaagattagtgccacaaacaagtacgagatttgcagtattatgataaatataagcatccacaaccatccttctaaacatgttagaaatgagaaccgaaaggtggttgtggtcctcaaacagggaagtgggactaatcaaacaggactctggggatttcttaagcgagcatgaattaaggggaatttcaaaataaaaactttcatgctcatatgtggaatgttttctctcgtcctccagagtcgatgtctcaagcttgtccgtggcctgaaggttctccttcacaactgatgcatcgtgcaagaatcgggttgtttcttggtgataaacaagaaaaacgttctgagggccagagggacaaggcttaggcttgatcgagggtgatgagagtcgttcagtttcatgaagatgggaaataggtccagaagaaacgaacgaagatacaaacatcacctcctcgaacggctcattcttgggatgagccttcttttcgctggaataattcagggtattctcataattttcataaagatcacccctgaattggaatggaatttccggggaatgaatttcttcttcctccggctccagcgactggaatgaggattcgacagttgagtcgggtttcgactccatgtgcagaggatcctcatggataatctcgatctccgggatggcttcgctttggccgaaagaatcgttctctaagatcaaatctaagagttctcttccttcggcagttgtcttgtgtgcgaacgatcctccgggggaaatatcgagatttgcggcagactccttatctaacccgtatcgaaaatgttgtaacaacacatgatcgggtagagacaagtctgggccagactgagttaacagtgaaaacctggcccaagctgcaccgagagattccttctcgttctgtcagaacgaaaggatgtctaatcgaagattgattacacgggttaatggaaagaaagcaaggcagaatctacacttaagctcctcccatttaccgtggaatttcttgacagacaaagtgtaccattgtttcgcttcatctctaagagaaaaaggaaacaacttccactttagagtttcatgtgtcatgcctacgatggatagacatgaacacactagctcaaagtcccgaagatggaggtacgggttttcaccaacactaccagagaaggtttgatctcgaatgatggctataaggccaggactgatttcgtagccatcagaaaggattggttttgaagaacaggacggctcacaaagatcagcccgaggagcagaaaggttttgaattgcgggttgctccatcaaggaaaggaataagagaagaagaaataaaaataaagatacgagtatgacctagactcggataaattagcaaccgttccccggcaacggcgccagaaatgcttgttggtatttcttacgatcatagataaatccgcaagcgcacggaataccgctgtagcacttcaccttcgggtgaccccaaaaggatatcgaactcagggaacgtgtgtaatctacctaattatctaagctaagcaaaggtaatttcctatctgttgcttcgggcgccgacccctgctagtctgctagcattgtttcggctatagctctatgatgtatccgaacgtggagaaattacttgacgggattcaaggctgtcaccacctgccgcctacatctgacaaatccatgggatacacaacaaacaaaggtaatctctaacctagacaacacgtctaagttattaattactactctaatacttgcacaagaacttccttctctatccagagtcctagtactagagcacttagtatgaatactaaacaatgaacccgcaaagatggaaatatatcttactcagactaaataattaaataacataagaaaggaacacgaatgcttactttatagaagaagttctccgaacccggagcagagtgtaccgacagctccggtactcctccagaattcctcctaggaagctacactcgttgaggtagaagtcggatgagcgccaaacttccgggcactcctccggtgcttctccccactctctaccttattctaatgtacaaaagatacaatagagcctcttgtaattcaactcaaagttgtgtgtcttggaataagagtgaagacctccttatataagctccaaatgatggttaggggtatgggaaatgaccaaaacaccctgcaaccgccatagaggaggaatccaagccatccacgtggaagcagacggtgaacggccgcataacgggtttggccgaacccaaaaagtgtcctcccggcctctcctttggccggtaggttgcttaatgggcccccaataacctgcactatgttttggcccaattctaaatggtttttattggcttatggagcctctaatccgtgtaaacgtgtcctggatatgcagaggtgcattttgtcatatcacggatgtgttttcacctcaaattacctgcatacacatatttcaccaacactagtggaaatgattagtaataatacctaccactaagttggataccatgttttatttcattatatgcaagtactgacggtcatatattatgatttaaggaccgtcaacaccagctcccactggagttggagtttggagcactaccgaacggggcctaagtaaggtttgtgtatatagctataccgctatatcgtgcaacagacttcaacaattatatttaaaatattcgtaacctcattaataaaatttagctataaagtttggatgcaaatatatagtgtggtggtagctggtaagtatctttttttgtaaaaagaaatggtgataagtatatctgagaatggaaaagtgccccttttcatttagaattcatgtttgatagtgaaagttgctcaaaaaaatctggcaaagattttttttttaagataatggaatgaaacatcccggcctttgctcaaaagagctacatcccattattacaagagtagcacactaaaagagcttagtccaaaataaagcaaatataccaaccacgaataaaagaaaagcaaacaagacaaagagaactactcgagtctgttggtgaatctctagccatggttggcgaaaagttgcataaccgtcgtctcaagattacgacatgcaacattcaagaactctccatcttcctcacacttttgcagttgagcccacagccgaagccaatatgttgctctgaaaattacctgcatataggaaacagatgatgatttatcaaaaactctatcattcctactcaaacacagagcccaacataaagcagaggcaccaacaagtatcagtttactctttttcttgtccacccccaaagccaaccataaaaaatatcagatatgcttctaggaaggtataatccaaaagaaaactgaacagctctccaaataaacttcgcataatgacaatctatgaacaaatgatgaatagtctcatttttcatacagaaactgcatcttaaactcccattaaaattccttcttgctagattatgtttagttaacacaactccctttagcaagtaccacataaagatcttaatctttaacggcatcttaagcttccaaatgaacttatttctatcaatgtaaccgttatttattaaatgtaagtacattgatctaaccgagaactgaccattctgatgataattccatctaaaacaatcagaagaatcatccaactggatatgagcaatagaagcacacaattcataccaacatgttagattatgtccaactaaagctctcctaaagaaaacattaagcggaacagagcccataacacttgcaatagaagcagttttccttctgacaatagcctataaagatggatatttatctctgaaggccctattccctagccatttatcctcccaaaatcttgtttgttccctattattcacaatccaagaacccatacttaaaaaagtatttttgacattcatgagtccctaccaaaaatgagaatcaccttgttttctgtcaacttgtgttatagacttattataaagatactttctcttcaataaatcttgccaaacaccattctcattaattaacttgtataaccatttactcaagagacatttcttttgaatctctaaattatgaacacccaaatcgccctggtctttgggttgacaaattatatctcatctagttaatctttacttttttcttatgatcatccccttgccaaaagaaacgtgatctaaaataattaatcttttgaagaacccctttcggtatctaaaagaatgatattataaacatagctaaacttgaaaggactgaattgatcaaaaccaatctacccccgacagacaaaagtttacctttccaactactaagttttttttctcaattctttgctcaataactttccaatctttgttactcaacttcctaaaatgcattgaaatcccaagatatttaaaaagaaaaaaccccagcttacaacgaaaaatactagaatatcgatcataacactcatttgcctggccaaaacaaaataactcaattttatgaaagttaattttcaagccagataaattctcaaacacaaataagatcaattttagattctttgcttgttgtaaatcttgctccaagaaaatgatagtatcatctgcatattgcaacatagacaaaccatcatatactaaatgagggattaccccattaagaaaatcactatctttagcccttttaattagcaaagctaacatatcagctactatgttaaagagaattggtgataaaggatccccttgtctaagacctttatgtgtttgaaagttgtcaccaatttgatccttagctttaataccagcatgtcccccttggataaaagaggatatccactcacaccatttgggagagaaacccttcatcctcaaagtctgttgaacaaatgaccattttatcttatcatatgctttctcaaaatcaatgttaaaaattactccactcatatttgtacgatgcaattcatgtaatgtctcatacaaaataaccacacctgcatgatgtttctcccaggaataaaagcaaagatggtggcataacatattttttgagaccctctagcgtgcacgtatgtgcgatgcgtgtagcataataaccctctaatgccgttatgtcaaagtccatttctttatgtaatttaagcaaagtccattttttttactcttgtataaaaaacggctttgtagtttatggtgaaaaatggaatttaagcgacgttcaatgagttaaaacggactctaccattaattagttttgtgattgtgctagtgttttaaggagggtctaaacagaggaatttttatcctaagtagaggcttaaaaaaggatggttactattaacacatttaagcgctgtcagatttggggcaatctatgtattcgattatttttcaattgtaattaattaattatttagtgttcgtaagccggactgtgcaaacatgcatattaaactaaaccggttagatttcttatattgaaacttatgtgcttaaatttaagtactagatttaacactgatgctttcatgtacaactaatcatttttcattctttccgtgtttgccgacgtagccatcgataatgaaacatctccgatgactttattaatctcaaaatatcccggattaatctcttggaggagtttctataggtagagcgtacatgtgtatattgagtttccacaggtagagcgtgcataggtatattaattagtgtgtgtttttctgtatatggaagcatatgcgtctgtaaaaagatattaagcatttaacaaacgctttgcaggtagaggacagaaaagattgatagcccagcccagcgtcgccactgggccctttggtaccatttcatgactcggccgatctgctaggaggttcgtccgttcgtgaatggaataagttcatctgagatctgtaaacttgtcgacgaatccgattttcgtccttcaaccagaaaaccagatacaacgcgtctctcaattgttaaaaccagtgtaaatgaggtccctcggcggtttttactgacgtgacgcctacgttgctaatttgactcggtcttcatttgacgtggcattgacgtggcgtttatgtgacaattcgatctgcaagacagcaaaggtagccagtagccatgtacataattttttaaacaaaaatcttctcgaggaagtgatatgttgatcccaacgataactcctttctccttctcctctcagaaccctctccgatccctcctcgtctccggtggttcgccgccggcgatgggggaagagaggttgggggctccttttctttgtagatccgtcgtcggacttgtcctgtgtgtcaaattttcttgtagttgagagtttcctttggtgctcgaggttgtagtcgacgctagtcgtcctcatcatagcgccatcgcgactgcctccggtggttttgccggagtttgctcaccatgtctctacctttcttgctgctatcgtcaattgggtcatagtcagatcggatcaagggttggtaacgccgaccatattgtccctctccggcatgcaagaattaaaggtggcaaccatagcacgcttctacgttgaaaaaactgcagtaatgaagcttctacctccaatgtttggaggccccagctatggctcagctcctaagctgatccaggtgtgttgctttctctttttatctctgagactctgacagtgtatttctgtggtaaggctgagttccatcaggtttgccaaagccaaaacctcgttgagggattgagccaaaggcaaaatctggtgcagctttgctatgggcaatcaagtcatctttgacgacagatccagcaaggcatgcatggaggacttgattgcttttcttgtactaacctagagcccgtacgttgcaatggaaaataaattgagtttctagcttattaaatcaattaataaaacccttatttagtctaagtaataatatgatttttcttattgaacaagtaggtgattttgaaatttggagtgagtcaatagggaaatagggaagtactcgctaaaatgtggtgtaacactatagattgtgggacccacatgttagtggtaggagcggtgatgttaagtgtacagattttctatagtcgtttgctaaattcaggacttttatgtatgttctctgtacccaaaagggaaagagattctgtgacttaactgctgtgcagttgagtcactgacgtgtgggccatagcaaagtaggacccacatatcagtgactcaactgcatgtcagaggatctgcttccacccaaaaggggttgtcctgtaagattggctatacgagcccagtccttttaataaactagtaatcgtgcacgtgcaaggcaccttgggagaaaacaacacttgcaaaagtctgttcacacacttaagttagaaatatttctagagcatgtttccacactgaatttaaatatatttcaagtgcatgttcagacaataacttggattttgtaagtacatatctactaagtccattatagaatcaaatagtttgtgtacattgtataataccagttcagtatgaacttgtatagatcagataatacatattgaggtaacactcacatgtatgaatttgtaaatactaatagctaagccccaaacattaagaagggaccgtataaaatatatgcagactgtgagtttaggtgaaaaggaagaaaaaataaaatgtaatttccatgactgatataccaacaaaatttttgagtatggatgaccatggatgattgatccagaatatgcagttcagcagagaaaagcatatatctttattttgatgtacatgcattatctaacaatcttgagtggagtttgctttgtgcaagaatggatgtctggcaatggcatgacaagattgtgctcgatcgatatgattggatagttctacatctgcatttcttgaatctgattctgctttcgcttcagactaacaggtcatgaatcacgtctaaaatagcttatttggctgatcaagttcaatgaaaaaaacttaagaaacgtcaaaacccccaactgcatgttgtgcaccaaatgtcagatctgaacatcagtttgaagtcaaaataaatggattctattcgggtttcagttaagcacctgatgtcaacatatcctacctctgcttctctgcagagttcttcaagccagcgaaaagatgacagagtcatccattggtaagctgcagtcatcgcatcaacacattcagctggagaaccagatacgagggcttgagatccaaatataaaaacaccagtgcatccctagccatgacgttgtcacttagtcgacaagcaaagggcctccatactcaaatttgatcaattaatattagaaagtacatttcatcaagaattcgctacattccgtaacagccatcctatccattgcatcaaaatatcattaatagaaacatacaaactgatagataacagctttgacttatatatttaattaaacagtgcatattctataccaacggcagcaaaccataaaattgagcttaaattggttatacgttgataataaagaatatggtttaattgatacctacatccaacaaccatgaatacagtacttacatgacaaaatttgcatcaacaaggagcatatgagctaactaacaatttgtattgatgaaaattgtatatatctacaaaacaaaacatttagaacaatccatgcacacaaacttttatagaagtatttctgaaagtaatgaccttcttaatatcagatgattcacattgctagtgttcacattgaaaagtatttcagaaagcagagaggaagaaattaactcacatattgttggcaaggtagacattagtgttgtcgaagaagccgacaaagccgccgcggcctgggccatcatcgagggtagtaaatttgtggaagaactcgtcgagggcacaccaagcttctccacctccaaatcatgttgtgaaggcggtggccggtgcgtggatctgctgcagaggagcgatgcgacggctgtgtccaatgcacgtcttgcggaacttgctcctatcttgagacctattcagcacatggatggtttcaaccgatgacctgaaaatacaataatataaccaaagcaacaaagaattagatccaatatatattaggtaaagatgattagcaaagaaacccagatgaatttattaacctgctagtaaatttaggcagcttcgatagttggcaacggaaaggtcatgaggcaaaggcgagcgatgatgcccatcaagctgtgcgagatggcggatcgatgatgtcagcagcctcatttgcagaactggccggattcggaatggcggagccgtggaggcgatctaatcttctctgcctgaggtggagcggcacggtgccagcatcgaccgtcggggaaagagcaagtgcgcggaggcggcgatgtgatcgagcaccatgggaagaccttcctgctaagtagccgtgacgaaggcgggaggtgaaagcatagtcgctgtcaacgtaatgtagcagctccaagtcctctgtgttcagatgggagtcaggaatcaacaaggaagtactgctcaccattcaatggtaaaaaatggaccaaaaaatgaatcccatcttacccacatccaatgggaatatagtatctacaaatgggaatataatcatgagcataaagtttgattgttttattctgactttgtgtgttccaattcatactgcaagctgccgttatgtcatgcaataactcgcagcaaaactcttgctagaaggctggcaaataagcaatgacagaacctttctccagatgttcaatttcagacacatggtcccctttaaaaaaatttagaaacattgctgtccaaggatataaaattcatatagaagacgatgccaaattcagaaaaacaaatacagtggagaataaacccgcacccaacaattatccatctacctatccactaaaacaagtatatgatatttgctaccggctttcagtcaattacctcatctctcaaatgacatgctttgaactatccctcaactccagtgtattttgttaaaatcatgtgattcttcaattatatatcgagtgcaaaatttcagtatgcagcattctatttactaattggcattttttttatcgatctgtatattttattggcattaaaatttcatccattgagatatgaggtacataactgttcgtgaccatactgttcatcatcgtgagatgaacaaaagttcatcgtttgagagatgagatacataacggtatgaaattgatacaagagaagatttccatgactcaccttggagagagcggagagcacaaacgattctgatggaccatgttggggatcgtgagtagaggaggaacgatggatgacgacctgtcagtgagtggcgaaggggtggcgtgatgggacgatcggcgggggctcggtcaccgtgaccccgaattggcggtcaggaatcgatggtggtcgcgatggcaacggccgtgaggagatcggctatggcgtctgaaggggagagcagaagaaccgcgggcgtggagagggagattgcggaaggggagagcggaggaaccgtgggtgtggagagggagatcacggaaggggagaggggaggaaccgcaggcgtggacggctatgtggcaacacccgatctaggggaataacggcaaatcgcggggggcggcggcaatgtcgcaggggtgtcagcactggcaaggtgtgggtgtggatgggcgcgtcggtgatgcgggccagcaggagcggcgcagcgatagaggagcaagagcggctcagcggcggcgaaagaaggaggaggcgcagcggcggttctgggtgacttttttttttttttggcgaggagagggattgagaagcgctaattgcagggttaatccggcgctaattgtaatcgcggtattaattgcacctaacaactcgtgctttttatattagtctataaatcaacggcaattttctaatttttcattaactagtaagggaacccgcgtattgcgcgggcatgtatttcaggatgcgtttgaaaaatttagatgggcgaaatatcaacaggatgataactgccatgtttcaaaagtactatttctacataatttttctaaactatttgttagcttttaaaaaatatatatttaattcattcgtataaatagttatctatcatctgtataaataccaaccatgtttcaaaagtaaatatttagattgtttggaaacttgtcggacaaataattaaacgtaaactaaaaagtaaaatgttttgtcttgtttaattgaatgtttggtagccttttttaacaaatcctaaataactattattattagtaaacatgctttccttatttgtaccatcaagttagttctcttttttgttggttcagattcatacaagctgagaggggaggggacggctagtgttctgttgtgcccatgtgagaggagggcgaagtggagggggtgttttgttcaaaatgatttaagtgaaaatcgatgatcctgtttcttttatcaaaatttctaatatcctttttttctaaattttaagatgtagcacatgacagcttaagattttctctaaaattatatatattggttaaaaataatggatccacctattaagtacaaattgatggtcacatgtcttttcttacaatttgtaaggttttatttttaattaagacataacacgtgatgccttaagtgtgctacagaagatgtacattgatttgaggtgatataatacttgtcgacgtttgatgtcgcgattccggtatttgcatagtatggggatcgttggtgctagggtatacgcgagactgaggtaaaagagacggagacgatgatttttatacaggttcgggcccctgaattgtcaggtaataaccctatatcctgttggccgaagccggtattgctcttattcaccataatcacaccagtacaatatttggggtagcctatctaactgttgtcgacatagcggtctgaaggtctgactcgtagtcgacaacagggtagccttcctcctcgagttcgtgcccggcgagatcagagacagcgcaatgtctctcctatcagtatccggagacaccgtaggggactagccgtgcctatccctgaagtcgatatccggcgtcttgtcttgacgtatgttggcttctgttgttctgtagattgtggtgggtgttgattgtctatgttgatcgtctccccctcctagggggccttatatttatacccataggtgtccccttgtctaagtaaaattagggaaaccaatatggatacaatccgagtagtccttgtagtttacatgtagaactctggttgtctttccttatccggaactcctcctatattcgcaggttatttccgtataggacatggtatgtggtgggtcctgccgagatttagtcaactactattaggtatgtggtatccataatcctgacagtagcccccgacttcaatgcaaatgaacgaattcatattctcaaccacgcgcagactttggagtaactgttatcgagctcatgtgaccgttctcgatgagttcagagataacgttagacttcctttatcaacctcgtgcgggcacctaaagggtttgtctgagtcaatctctgatgtcaactaagaaagtagagagcatacgactaagtctcccgtcttgctgtaatcgagaatttggattgaagtcaagaaattttatctcggcgggtacaccatctcttcattccgtactccttgtcgagatccaccaaccgttctcgagtaatcgagtaggcgtagagtctgcgacggagccttgtcaacatttgtcgtactcgccttagtcaatcttggtgtagaaccatagagacatggagtcttcgataatgtcgaatagaattttccaatgttttgtatatgagcgtctaccgacttcgatcagtcagtttgttaagttatacactctccctagcccccagccttgtcatcggagaatcgttctcggataatgaggctcttggacctttgacctgcctcggttgaacaagcactgatcctagcccccagccatgaagttggaaaatctatttccgattacacggcttggttaatacgcacggcgagaactcttacacgactagatcttacatggtctttcgtctctgaagaatccgacaaggccttatccgctctgggcgtccccaaccaaagttcccttaggttcctcggaggccttgtcaggacgacgtaaagggacattaggataggtttcaacgctaggtgtctttgtggtaagggatctctgggtaaaacacttggcgatactgtgcacctgatatcaactttgttgaagtagaggtaatgggagaatcgctacacctctggtcaagaaccaggtagtagtcgtaactcaaccactagaagtaaatgtacgagagatcgctacgattgactagttgagaaccagtgagtaggtatctctcgatcatttgaagtcgtagtacgaggaccgctgcgttattgctgtagtcatacctcgaccatctgaggttgcaccaatggaagcgttagagttggtttattacatgtgcatctcatgtggccagcatgactcacacacccaactagtagcatatccggatgtccgttcgcaatcatgtcgggtgatcaaaccgacaacgttcacaaggaattatccgttaacaactttttctcaaatagtccagccatggccggtgctatgagataggtcatcggtcttcgttggtaggttgggcacgacgactctgcatttgtcgagatcgtcctcgataatgcggtgtacttgaccacaacctactcgagtgctcaattgttcctgcaaaatattttctagaagacaagatatatagcagataatatcgagtatgtactcaaaaaactgcatggatcttctagcattatcaggatataacgagcagattaaatatcagggcattatgtaaaccgtaaataagcatgatatatacataggaaaatagagcgagcccccagcattaaaccgttgtcgatttaacatcggggacacttgcacaatatatattgtataaaaaacatgctttaggtaattaaacataataaattatagatctgacaatgctgtatgatctgaataggtatgataaattgcagataaaatattgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagcaccaaaatccccctacctggtgcgccactgtcgacgtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacatgacggtctgaaggtctgactcgtagtcaacaacagggtagccttcctcctcgagttcgtgcccggcgagatcagagacagcgcaatgtctttcctatcaatatccagagacaccgtaggggactagccgtgcctatccctgaagtcgatatccggcgtcttgtcttggcgtatgttggcttctgttgttccgtagattgtggagggtgttgattgtctctgttgattgtctcccctcctcctagagggggccttatatttatacccataggtgtcctcttgtccaagtataactagggaaaccaatatggatacaatccgagtagttcttgtcgtttccatgtagaactctggttgtctttccttatccggaactcctcctatattcgcaggttatttccgtataggacatggtatgtggtgggtcctgtcgagatttagtcaacaatacttattgtcattttttacaaagctctgtttttttatatttggttagcatgcaaaggataggtgtgtatgctcaaattgtgtatttctttatttttgtaaagtgaaatatgagtgatatggatcttgaattatttatttaattataaataaaataacaattcaaataaactaaaaatcaaatataacataagaatcataattatttagctttccaattattgatcatttttatattatgttgttaattagttaaaaattataagacagatgagttgagtgagagaggagatgaagagaaagtcaaatgggacaaaatatgaacactacaaatctactaattttattattgatttattatactatccgaatgggagaagtaatttttttggaacaatagtcagtgttattaggtttactttacttttgtcattactttattgtgaacttatatacaatgataaaacatatatcattatttttcataattttataattgtttgaatgacatgcaaaagtcagaaaatataaccccaaatatgggtctttaaatgtaaaataatcaaaagacataagaaaaatattacttgtatgatttaggggatcccatgatttatggtatagctgcttattttttagcataactcttgctttctaactaaatattttgggaacattactcatagttatttttattttacgtttatgattgtagatatcatttaattattatgaagtgtataatattgttattatttcatatttttacaatttattgaatggcatgcaaaagtctaaaattataatccaaaatgacatcttttcctcaaagttaaattattgtggaaatttggtctttagctgaagatttaatcataaataattttaaagatataagcggataaatattagttgtttgatttaggtgttataattgctgaattatttaataaaaaaatttttttttcaaactctaataataggataataaatatgtaaaaaatatgaagaaatcgagggaagtatgggtggaagtacgtactatcctataaaagaaacgtatgtaacgtacaggcccatggtataccccggtttggggttaggtaggatttttctttagataaacctattgttggaaaataagggtccacctaacttaatgaaaatcagtggatagatattttgttttttcttagaaattttataaatttatataatttattatagtaccacgtggcggtttatgagcgtctgtaggatgccacgtggcggtataggagtatcggttgccatggctacttacgggacaatggtgtaggtggaaggatttgtttaaattgatctggcggatgaaaatagtgggtccaccgacttaagttaaaatcatgggataaatattttgtttgttcttagaatttcttggaatttctctattttttagagtgccatgtggtggcttgagagtgtttgtaaagaataaatggattaaacgggctagggtatttcaactctttatgtggtactatgtttgaacgacttgcaaagggtcaaaataaaatgaatgcaatttttacaagtgcaattatagtcaacaggtgtatcaaattttaatttgtgattttaatcatgcataaataacgtaatgatacaaatagaacgtataattaaaagttaaaagatgttatgattatttaaagtatccaaaatatttcttataaagaatagccaaatttggtctgttagaaattaaagaaacattcgtaaagagaaaaacggagaggaggtacataccaatgtgcaaaccgcacacaccctgcatccacgggaagagggacacc

SEQ ID NO: 18678 - DNA, 7956 bp, Oryza sativa
  unsure (1)..(7956): unsure at all n locations
aatagtgggtcaacgacttaaggttaaatcatgggataaatattttgtcntgttcttagaatttcttggaatttctctattttttagagtgccatgtggtggcttgagagtgtttgtaaagaataaatggattaaccgggctagggtatttcaactctttatgtggtactatgtttgaacgacttgcaaagggtcaaaataaaatgaatgcaatttttacaagtgcaattatagtcaacaggtgtatcaaattttaatttgtgattttaatcatgcataaataacgtaatgatacaaatagaacgtataattaaaagttaaaagatgttatgattatttaaagtatccaaaatatttcttataaagaatagccaaatttggtctgttagaaattaaagaaacattcgtaaagagaaaaacggagaggaggtacataccaatgtgcaaaccgcacacaccctgcatccacgggaagagggacaccttttattattaagaaagagaaaaaaatgtaatccaatggattggagtggtgagtctattatatttagtgaaaatcaaaggctatttgtttcttttttcttagaattcctaaattttattctaatttattagagccgcacgtgacgctatagagcgtttatatgggtggcatgtggcggtttaggagcgtttataggaagtataatagatttttagtatataatagatagattggatatcatcaatataatttgggacgtgtttgtagaattatttaaggtgacataatatatgttgtcaactttttataattaaaatatttcctggttatattttgttgcgatgcaaagaatatggcccatatatagaacaatatgaatcaacaatatggacattgtttaattataaatataacaacaataaaaagtaaaacatgtgacttaaatttaacactgaaattagagattgggaaagggagtacgtacaaacctaccggaggaaattaggtaacgtactgggaggggaggtggggacaggtgtttattagacctaatgttggaaatattgaccccaccaatttaaagaaaaattattcgttatattttagagtgccacttgacggcttaagagttttttaggacgccacgtggtggtttaggagcgtttctgaaaagtttaatgaaagtttaatgtactttatataatagatagatttattaataataactaatactgtattgtttaaactaaattattagtaattcgtttggacgatttatcaaaatatgaccaacaagtccacgcttgctggtgcagccagaccagcaatacacgaccagacgagaattatagaaagaaaaacctattgcattgatggcacagcgcggaagaaatcattcgacctagggttggggattgccggcacattgccctctcccccttacacatagatcctgccgccccttcgacccctccccctccccttccccctccccccgcgcaaggatttgctggcggtttcatgcaaggacgatgatgatgaggatgacggcagcggcaacgttgtcatttggattccagggttagggttttgatttttggaatttctttttgcgatttttcctttaagcaatcagaccgcttacgcgttagcattaaaaaaccgattttcgcatgcacttgttctacacgcatgcaaaatttttattttcacagatacatacgggtcaccctcccgcatgtaaaaatttgtttttatgcaaggaagaatcttttacatagtagtgaagtttgtaatcaaataatttttttatcacaacttccctgaacacctttgtgaggtacacggtacccgggtatccaacgataagctttgggccgcacctcatggggtgggtcgagtgtcctaggcccatgcgacgtacttgtaaataaagaaagagagattccctagataagatataaatcttagggatcctgcatatcttttatagatatagaatagagagatttgtagatacttttcttgtaaccctccccctcatcctatataagagggggcaggggtcccgagagaggaggtcggatcatctccacaacccgacatatctcctcttcttggcttctcagttcatttttccacataggtacagagaaaaacacactggatataggacactggatatagggtattatctctttccaaggacctgaaccatcataaacacctacgtcaccatctctgtttaattttgcgcaccccattaaatatattgtcagtcataaaaatcgaccaccttgctaatggccttatatggtcaagcgatcccacggtgaggtaagaatattttattttatagcatagaccagaaagagagaagaaacagaaaaaaaaaaacgtccgagcggttaggtagcagcggtgagcacacgcggcagtcctctcgtacagaagccgcactactgtgtcagaacagctccatctttataaagtcaggagaactatgccaaagtccttgccaacgtctccgtgcactggatttaataataaattaaaaatatgcgtctataataaattagagatatcggtttaaaaaccagaccggtagtattggtgatggtttttctttagaacatcactaatgtatatggcaaaataatccatatagatgggttctatctaagtatactttacctatagcaatccttacaatatatatagacacaaggtatcattagtagaaaaaaagagatgagtcgagatagataatattatttattttcatatggatagtccatatgtatgtaagtattttttttgttattttttctatatagactagttgcacaatagtagtaagtggtatatagaatgatgattcaaatgcaaaagtaagataatatgactttatgagagaagaaaattaggaagatagtttggaccatatattaatcatctaagagttaaaaacaattgaagtgatatggatcttccttttctcattctcagctgcgctacggtgttctcccctagaaccgtttgagaggaagattggcaaggtcaaaggggtgaatatataactctggagtctcacgtaaactggttttcagaagtgctgggagtgcaaactcgtcctcatcaagcaaaagcagggtgaacaatcgaatgaggccattccgccaatggttgatcgatttgatggtcttcaaccccttacttctctctccacaagtggttgggggtgttgttgtgtttgcttgtttatccatcggcgtaggtgccttctcctatcttattatacgactctcgtcttttattttatcttctcttgttcgttaagtttatatatctattgttatttgggtttccttctataagttgacaggtgacagggttttatttgtctttatctttacctatgttggtatttcttaacgacattactagaaatataattaccagcaatggcgcagaaacactcgtggtatattatggttacaatttcatctgcaagcgtgcggatatacaattatatcatttcacctaaaagtattccaagggtatcgtatgtgtttaatcccgagagaaaattataatagagagaaccgagctaatatttatatgttacttgtaataatcaaagtctaggcatgggtcagtttaattcaaagggtagggtgacacgaatcagaagcattcactattctcatacatactaattctaggccaagtggaaaaaatatgaaaaaaaatcatttcctatacttctaatatacatacacactttagtcgatattatctactacctccgtcccaaattagtggtcactttgacttttttatgcaacgtttgaccattcgtcttatttgaaaaattagtgcaaatataaaaaatgataagtcatacttaaagtacttttgataataaagaaagtcataaataaaataaataataattctataattttttgaataagacgaatgatcaaaagttacaaacaaaatcaaagcgacaagtatttgggacggaggtagtactatatgattatatagccaataccccttacgatgccatcctggtatttcgagataccacccctggttgccgagttccttgcgacaacccgtcatggtcatccaaccagggctaaatacggagaagtaccctccccaggaaagtaacttaggattatatacacacgcggtggaatacccgtactgagttgtcaccatcaacggcccatcttgacgtatccacagcatataaccgcaaataatgatattcaatagcctatgcacctcgcttatctaccaaatactactctacaatcaccgtcgtgactcaagagtattcatataaatgaacattatacccacaccattgcatctcccgagtaagctagctagacaattatatctcgaataatatcttataaagtcggtactcaaataatcacagtgaagtaaagtactgtaaatatattgagaagaatattctataaatagtacaagtcttacaaaagaaagaaaagctactagagccatacccgaactcttccgaagactccggggactgaagattctatcctatttctattccactatgctctagagactatactaaacttgagagaatgtatgaagcttcttgcttgagatgtgtcttgaaatagagggagtgagggccttttataggctggtaatgacatttatggcggttggaaaggtcggtagtaccctccaaccaccatagggaagcaatccagaccatccagccaaaccctgcatcggatggcgttacggctggttcggccgaaccctgggctggcccaatcgggccaaactttggcaggcggactcctcttgcgctcctctgcgcagacttgtgaattttggtcttactgggtcttgtaaatttggtgttctcagcccatttgtcttcaagtctgattctcgacagcgtaggattgatctattgtatggttttgctatcgaatctcctctatttatgtttattctctgcaagaggttagaaatcctagttctagtggaatatatcttattttgacacaatatgcattgcaagcatgacttagttctcctttattttggtaatattgacgggcgaaactgatcgctaacgaccgtaagcaatctaaaagattaaaatctgctttcaaccaaaaattagttcgtccgtccaaaattttccatacatcgtgcatacgtgtgcaatccggccccatgctcccttcctctcccgcggctttctgctggcgcctcccctccctgttgccccattgtcccagcactcctatcctcccgtgcgccccctcccttctagcagctatctcctcccagtgcgccactcttctcccgaccctccatcccttctcgccagtgcgtcctcccgaagcnnnnnnnnnnnnnnnnnnnnnnnnnnnnnnnntgaatattgttagttgatttctgtttgtctttcgttcctccctcgtgttaactaaaacggaacccccctcactcggaaacacattttgacacattcatctggccgtgttcactatcagagatcgttgttgttgttttccggggaccacttcattgccactcgtgttcttgctatcgttgtcaaccgcagcgtgttcaaggaaaacggaatcccctcatctcggaacgcgttttgacacactcacctgtccgtgttcaccaccagagctcgtcaagttgctgtttctctaccgggaccatgtcgttggctcccgcattcccattgttttggtaattcagttttcttcgatgccaacaatagcacgtccaaggaaaaaggaatcacctcattcacgaacgtgttttaacgcactcacccggccgtgttcaccactagagctcgttgttggcgtttctaatcctgttaggaccacatcgttgttggtcgcgtttctgttgttttggttttctttgttgccaaccaccgctatctatggacgagtcacatcgtggaacacatccggacactttcctcgctaccgtttggtgaattggaaaattttaatatatgtcaaagaaacgagtacccgttcaaaattaatatttcatctatgggctaaaataagttttttcaatttctagctaaatttagttttcagttgtttttctatttacagtatttgttttactatttgatccaataaaaattattgaaacttatatttttccttcgcattgaattatttatagctatatgaataaaaggggactttagcattatattaataattccggtcaaaattatttgtagtgtcatgttgttatttctatgattatatttcctttattatttatgctcagttgtaatatatggtttaggatttttatttatgttgatgaatgttatttaggacatgttgcaacgggaggcattacgctagtctcttctactacttaaaaaataaaaagtgtttccgtcgtccgtcaaaataaaaaaacagcgaaaaaaatatccgattcccaaagtggcgaaaaagccaaaaaaaaaacacgctatagatccaattcctcctaaaacggcaaaatataaaaaaaaaatcatattcctataaaaggggaacagaagtggtgaaaaaggaaaagaaaaacataggtctgattttccataaattggagaaagcaataaaaaaatccgattcctataaaaggagaaaagaaaaaaatcgtaaaaaataaaaaaaatagaaaaggtcggactccctaagaaagtggcaaaaaaaaaggtgagaaaaaaaaagtaaaaagggcggaaaaaaggcgcggcaaaaaaaaatccgatttctattcgttttaatagtcattatcatctcttctctatctctaatctaatataatctaactatttaaaaaggaagtcagaaaaaatgtgcgagaaaataaaaacgcgtgagaaaaagttagaaaaaagagcaaaagaaaacccgatagaaaaaattttccgttgtccataaaaaaagcgcgggaaaaaaatatttccattgcctgtaaaaaaaagcaaaaaaaacatgcgaggaaaaaactgatagaaaaaagggaaaaaacgcgccatttctaaaaaatggtttgaaaataccgcacaagaaaaaaaaacatcggtcataaaaaaaacaagttgctcttgaaaaaactgtaaagaaaatgctaaattgatggacgcttggggtcggatatgatccatcatttttttttcatctcctacctacctagcttttgtttctttatctattctcctgtattgaaaaccctacatattctgtaggcaattattagactattttttaagtatagctactattttggataacatattatatgaaaataatattaaaaaataaacatattttaattgttatttagagaaaagtacaaaataactctattttgtctagaattgaccatgcgaggcactgtaggatttgattgatcttattattggttgcaagaatgacattggaagagtattttaaattatatgcatggtgtcatataaataatccaattattttaggtaaagcaaagcatcggtaaagttgtcatcatcaaggttgggccattacattgaagatgttctaattttctgattgttttagctataaacaatctatataaatattatcattgatatggttatgcatgaaaaacgtatattgtaattagaattgtttcacccgttgcaaatgtacgggcatttttgctagtaagtaaaaaaaaaagaacagcaaaaatgtccgagcggttaggtaggagcagcgagcacgagtcagtcctgtgtccgaacagaagccgcagtactgtgtccgaacagctccatctcccttttaaagtcgcgagaaccaatgccaaagtcctcgccaaccgtctccgttcactgccctcgattgcaatccacgttcgtcgtgagtgacgatgggaagcgccggtgcggc

SEQ ID NO: 18679 - DNA, 12086 bp, Oryza sativa
  unsure (1)..(12086): unsure at all n locations
cgcctgcgacgccctggtcatcaagacctgcgccgagatggaaggcccctacatcgactacatcgcggcggagcacggcaagccggtgctcgtgacggggcccatcgtgccggagccgccgcgaggcgagctggaggagcggtgggcgacgtggctctcctccttcccggacaactccgtcgtgttcgcctccttcggcagcgagaccttcctgctgcacgccgccgcgacggagctcctcctcggactagaggccaccgccctgccgttcctcgcagtgctcaacttccccaagggcacggacgccgaggcggagctgaggaagctcacgccgccggggttggaggagagggtgaaggggagagggatcctgcacaccgggtgggtgcagcagcagcacatcctgcgccaccgcagcgtgggctgcttcgtcaaccactccgggctcagctccgtcgtggaggggctcgtcgccggctgccgcctcgtgctgctgccgatgaagggcgaccagtacctcaacgccgcgctgttcgcgcgcgagctccgcgtgggcaccgaggtcgcgcgccgcgcccgcgacgggtggttcgggcgtgaggacgtgcgcgacgcgctggcggcggcgttcgccggaggagaagacggcggcggcgaggagaagaaatggcgggagttcttgatggacgacgccgtgcagaggaggttcgtgcgggagttcgtggcggagctgagaaggctcaagggctgaaaacggaacgtcacgcgtcgttaatcagatcgacagctgtcacaactctgaagaaaatcggactctgttctgaagactgtgaagagaaggaatcaacggctgtgattgcttgatactgcatcgcggttctcgctctagggagtactacatccgtcataaaataaaataagtgcagttttgcactggttatatccaacgtctgacttaacgtcttatttataaaaattatttttatgattagtacatatcactgtgtaatactgtgctacatcatacttttgtcattttctcaaactgtccgccgcatatcgcatatatagatggccacaggacccgtccggcacggcacagcccggcccaagcacgcgctaggtacggcccaccagtgatcgggccggcacggtacggtcggcacttcgtgccgggcagtgccggcccaggcatggcccattcgcatataagtgcttctcgcagctgcaacctggaacttgtatcgatgatgatttgaaacctaaaacctactctctccgggttgataatacttattattttacataggagttaggtcaaactttagtatctttgattataaatcatttttataatatttatctttcaaatacagtgactacatatataaattagttttaaaaaaatactttaataaaatcacatatttgttaaaaattttacacatattaaaataaaaaataatggttaattttttttaagaccatgctcatgtccaaaacgataattattatcaacccggagtgagtactactttattctttgtcttgcggtgattaatttcctacctgcatagttttccttctatttaattacgcccgcctttcacagtgcgagtacatgtcgactagccctagcgcgccaatttggatttacgctgatgtgttgactccgcgcgagctcctgctgagccgcaacgcattcttcgaccgcctcgacggcacgtggcgtgaaaactcgaaccacgcctgtgctgttgtaacatcctaaaaataattattttctaattcagcaccttaataaccttctaaacctaggagaataattagagtaacctcctcaaactaaccaacatttaatttctattgtgttttttatttaaaaatatatttggctaaattgatgaattttgtgattgaattttattttcgaatttcaaaacttttttagactaaaattcctttatttaatttaattgaaaaactttttacttgtatgaattatggtctaagaaatcctctgatattgcccttgaacttcaaccaccgtaattctgatttcattcgaattaatccttaaccaaaaccttggatctagagttatctctaattctcctctatccaatttttttatataaatattccaatagtcaattcctatctagtctgtaatttaatttctatagcttgactccaaccttggcagaagaataatatttttagaataattgcaagaaaatatattttatcctcccatcccaaatccaaaacctcatttagcccataattaattctctaaatattccactccctccattttccttccacatactcaaaagtatatccaaaattaagagccacatcgttttcgggccttgagcgttacaaatggtatcagagccgaccaatacaactatacatatatatgaacatgtatgcgggcatacgttgcatacgagatgataccgaagtgtcatggttggcatcgtgtcacggacagaaattcgcttactcgaatttcaagcagaatgtgtattaaatctctatctagatccacgttttacaaaaataacaaaataaatctcacaaatgcaacggaaaaaatgaataaacaagacttaatcttcacgaccaaaagcatagcttccaccataaaccacatgcaatcttcgacgtccagaacaagataaaaaaatttggtttattttgctgtttcagtagccttattgcttgtatttcttgtatgctttgttgtcgtttagattccgtcagttccggagatccaatttatttccaagtggttgccgagattcagtcagctcaagagcaaggcaagtcatacatacatcattgatcatgttgagtctattttacaaaatcccctactttctattaaattgcattgttttagaatgtcatgtgggatggatgcctatcgtactcagcatgttgaatatcttatgccattgataacttgagttataattgactaggtgattggtttaggaatgcttagccatacttagatcaattagctcacaatgggattcattataatttagtccttaattgtatgatgatgtaccaccatggttacggtttaattaaactaaaatatgctttaatggtgggttgtgggtacatgcatgattttggaagtcgtacccatgacaattaaggaccggttctcgggaatccatggaagatatactcgttcttatcacatgccagcatgggctccaggcttaatctagagtataacttaacctagctaacataccatggcaagggtagaggcgattgtgcggttcagacctagataattgtctctgttgtttccggatttacctaggcacgagaggggattgcccgacttggcataaggagggggtgaaacctgagatgggtatgtttggttagggagagttatatgatgggttttgtcacgatttccccctttgcagtatcgtggcggtacttcagggcatgtgatgaggacatcactccttcagatacatacaacaatcctccaccggtcattcaaggaccaataacaagagctcgtgcgcgacaattgaatttagaggtgagctcgttcctatattcttctttatatgattttgagaatagattgctacctaatgaatatattgtgattaggaataaaggagaggacaaggacttagagagggacttagaggcatggaggatcatcaaggacgtccaagtcaatatggaggcccaaaccaggtcgacttcgagtacgattcagagtccaggaccagtctgcactaaaacaggcgcccaagtcgcatatgtgcacggattggggcgttccttatatggatggaaaacttagaacataacctttccaatggttctggtcccacgttcaaattctttccaagtcaacgggaatcgaccgaacaatttaacgtccataatctattccggtgctgcgtcatcgtatttgggcgtttaggccgtgtatcgtgttggaacccattagggttgcgtcaagggttgtttacacgaccctaaattctatatatcaatacccgtcgtcatatttagggtttgggttttgcttagattattctgtcaagaacagtttcgccgctagatcggtttgtaagaccccaactcgtgagctttatcatttatttgcaattttggttgtattcttctttgttcttgtttgtgttcttcgattcgcaaacagggatttgccttctcggcgaggtcatccgtgtttcaacacgggtgataaccagaggagacgtggtgctgcgattgcggggctcaagagcgtgtttgtttagaagccggatcgaactgtgtcgtgactccgtccaaatcgactacctattagaacctttcggaagatcgggaaccctagtcaacatcagcatggtaacatgtgtggaatcatgtcttgtgggtaaagttgtacacctctgatcagaggtaaaactattcgaatagccgtgcttgcggttattgggtggtcaaccagttcaccgtgattagtcccactataataatatgacttatagaactggtgtagttcaggtggtttggttggacctgttgcaacgtggatttagcgttggacaatgatgatttaatactacttaattatacactgtttttactcattcaaaataatgatttataaatgttgcttttattgcaaatatccaatgagccactcctttgagaataccttgcatcataccttcccgttggtatgacttgttgagtacagtggttggtactcagtcttgttttatcccccccacccccacccacccagaggcagaaattggttcagatgatgagttctctgaggattgagcttgttccggacgtcaaggattgcctgtagtttatggaggaagctatacttttggtcgtgaagattaagtcttgtttatttgctttttccgttgcattttttagatttattttattacttttgtaagacgtggctggccctggacagatatttaatacacattctgcttaaaattcaggttagcaatttctgggcgtgacacatcgtctgcaaccgaaggaggaagacacgcgacgcggaaggtgtagcgcgcacaggagcaggcgacgcgagcacgggcgcctaacagcggccgtgtcggacagctacactcctagccaatgataagtttaattgagattggattgttatctccacattttcctcattatttgttaggcattaagttagatttgtaagcctatttacagggcatttgggattgaaatcagcttgcaagattccactttggttcccatctctttctctggtttctcatctcttcttctgtgccactaccacgggtcgccgatcttctaattaagttgccgaaacctcagccaccgattactcactcctaccccattagatcatacaccggagctcgtaacaaccaagctccaagaccatggtgtcagaagatctctccatccacaaacaacccattctcaaacccaccgactcgcccaccaagctccaagaccaaatgtcagaaggttccagggatgtgatcattgttggcttccaagcacgatctagctgatctcagtcggaccgttgcggtggccacatcacgcatcacatccctggaacaactccagggcacgatgtcatcatcgtcgccacagatcgcaccttgtttgggcggcagtggcatcctgggtacgcctgccgtgacgggccaatcgccgccattggtgacaggaccacaggatacgggcagcgctaccagcgttcctcgtttctacaaattggagttccccaagtatgatgacaaggacgatccgctcaacaggttcaaccactgtgagcaattcttctgtggccagaagacgcatgacagtgatcgtgttgggttggcaacgtaccacctcgccgacaacgcacaggaatggtactttcactatgaaattcacaaggggcctccgacgtgggatgagttcaaagacctctgccatggccaattcggtccaccgatccactgcaactcgctcggtgaactgaagcggctgatgcagacatccacggtggctgcctaccagaccatgttcttgacgctcgcatgctaaatgtctgaagccctctccgaccagcagtaaatctagctattcacggcgggtttacatgatgaactggcgatcgatgtcgagctcgaccagcctgatgagtctacgccacggacgagcctcgcatgtccctgaacaagctctccggcgttgacggcgctaacacccctggttcggccaaaccctggctaagccccctgacagcacctttcatatgggtcactgcctggtgggtcctcatgtcgttttggggtgtttggacgaagttgaggcggttcacctcctggtgtgtgctctttgatccatgtactcttctcctcattggttggaattatgttctcttatttgtgttttctcttaatttgcacaagtaatcacttgcatacaaatactcaccaataattatggaattggttagtacgtaataaatccataccgctagatttggtggtagactttggtaaaatttatgcaggaattgatggtcaaatttggtagttgaggaccgtcaacagcgacgatggttacgatatataggagtaacatattttggtcgggtcatttctcccagaccccaattcgtcgatgtcttcctcatcggaaaattcgtagcagcagtgtcttgatgtagattgggacgatgacgattctgatttgaagtggagcataattcggtcaggtcatatctcctaggtctgaagacgtcgaagattttttgttcagaagattcgccttttggacccatctcgtcgaaaccttgaagcaccaaatccccctacagtatttgtagagtatggggattgtaagtgacagggtatacgcgagatcgaggtaaaagagacgggagatagtgacttttatataggttcagatcccttaactgatgagtaatttccctactcctattggctgaagttggtgttgccgtttatatatcaatatcacataagtataacattggggatgccttaatctagtcccgatcagcctagcggcatagaactctcacatgtggtcggcggctagtgtattctgccttctcgaatatcattcggcgagattgaaattgtattgtattggcttgtctagatccgtatttgcttttgttcgcctcccatgtgtgtcccctctcctactaggaggtcttgtattaggaaaacaagtatggatacgataagagtagtccttgtcgtgcttaagtaggactttttttctctttctttattcggaacacctttcgtatatgatgcatgattgcatataaaatttggtatatggtgggtcctgtcgagcctaacaaaaaatattagtgatgtcttatttataacaccgacacttttcaagatcgattggcaatttcattgaagcttgattctttattcttctgcaaatgagaatgaattgccttgtgtatattgagtctgcaagacgttagcttgaagcaaagatatatagcgggaaacacgcatttggatgagtctgcaaaatacatttgcatgggcaagttactaatactcttacaagggacaaaccagggttctttctgaaatacttcggccctatcacatttaggatccaatgcgttacttttgcgtgatgtgttctcacctgcacgtaataattagcatgaccaaaggtgttcatacattactacgtatatgtactagaatatgtcatttcacctaaactgatagctacatgctaattgtctatctaacatgcgtaacggcattggatagcaaaaaaatggagtaaatatttatggatggtttaatttctgaaagatcatttcacctaaaattgacatatataacttctctaatctctatatgtcaattttatggatggtttaatgtcatatttaaacatattgacatataacttcacctaaacattatgcaagcaataatgtgataatgatgtgaaaatattgtttagctattgcttgcatgttaattttaaaaatacattagaaatgatatgtcatattgacataatatttaaaatacgatgatgtgacatacttgtatatgatttaaaatactctagataataatatattgcttgtgggtgatgatatgacatacttacatgttgagttttaggagagtagtgagcatcaactttatagtaactagcaaaaatacccgtgcgttgcaacgggcgaaaaacaatccaatatcaatatacactttttatgcataaccatgtcaatgataatgtctgtatagatcgttacagttaagacatatcataagaaaaattagaacatctttaatgtaattgtggatgcttgctttacccaaaagaattggattattcatgtggtagcatatagtctaaaatactctttcaatctcagtcttgcaaccagtaataagatcaatcaaatcttacactgcctcgcatggtcaagtctacacaaaataaagccaccgtgtactctccaaataacaattaaaaatatgtgtatttttttaatattatttttatataatatgttatcaggaaaagtagctatacttaacaaaatagtctgataatcgtgatgtgtagggcctccaatacagaagaatagatgaggaaacaaaaaccactccatcaattttaattttatctcgttgtaaaaaaaaaagacaagcaagactaagattcggacgtcagaacattcaaccaacgacgcttcgaaaaaaccaaatcgacatgatagacgatggattacacaacgttaggaatcttttttttttctggaatcgaacgtttttcttttcaaatcagacattttattggcattgcacgatgccgaaccattttttttataaaaagtggtttttctcacgttgagtcagactgctttttttgagcggttttttatttctcgcgttgagtcatatggttttctctaactttttttttaaagaaacagtcggttttatttttcgcgctaagtcggacggtttctcaaaccgttgcgggttttttctcgcgttgagtccgattgtttctttgatccggtatttttataaacggttttttttccttatggttttttcgaagcggcttgtttttataaactaagttattttttcttccgttgttttctccaaccatttttaagaaatggcacgttttttatgacagagccttgttattattctctcactcgctacgtgtgcagtttatttatccaattattttattcctaaaggtgagccacaagcttaaggtcaatcttaatattcaatgcctcatggttaagtctcacaatgtataaggttcatcataaggaactctatgggtcttttaagacccacattgtagacaggggcagagctagaatgaaattggaaagattatgggtaccgcatacccatatggcatgtatatccgattggttatagtagatagcttatatagatagaatatgtttagaaaaggactcgtgtattatgttaacttgaatataaggaagtatcccgtagtccgtaaggtatatgggttgtccattgtaatctctgctcctccccctatataaggaggggtccggggctcctagggacatgacttttctcccagattgtcagatcaataatacactcagtggaataaatcctcagacaggagtagggtattacttttcattgagaaggcctgaacttgtataaacatttatcttctaacccatccacttttcaagcttgattggcaccccttttagtattgccgaaatcttgtttcgacggaaatggagaagggtgcctcttgcttaatttactctgctttagatcaagtttaagttgatacgggtgtctaagtttatattaggggtgcacacatggttaaaattggtgaggtatagctaaaaaattttcttgactggttcctgtgcaacccggcacccactcctatactttactgtgcacccactcctatactctacctccgtccctgattgtgggtgtctcaagtagcgagcatcaactttatagtaatattggatttgccaagcaaacattgacccggcccattaaatgtgtgctaattattgatttagccgtgcccttaatataggagaatgcccagcatcggttgaccgggggaggtgggaaaatcggtccctccccctcccccacgtgctcatctgttggacccacccacttgtccctctcctttttccaaaaagatgtttcacctagtgtatttacaatgtttcactatttatatatctaatgttgcagtgaattaaaatattttttacaacaaaaaaacccacatattttggaaaccctctattaagggaatttggtttattttttgttccaccaaaaatgtttcactatgtttaatttggtttttttccaccaaaaatgtgatctgaaacattttttcgctatttgctgaaacattatttttatataaggtgaaacaacacccgatttaaacgattgagacattttcaatctacttagtgaaacaattccgatatacctggtggaacataatgcaatatttaaaaataataattcaataataagctatttttttcatcggaatatattcatgtgtgatcttgttttgaagatttaattacaacgaatttaatggtgcaatcggattataatttatataaataatttaagagaaaaatcagtttaaaataattttgcatttaaatcgacgcccgattttaatccccttccatcgggcgcgaaaccggagtcgcgtcccgtaatatggtaatgggatacaaatacttctcactgaaaagcaatccccaactaagaatggccggtgtggatgccacggccgccggcggcgacgaggccggcgaaacgttgcacgtagcgttgttcccgttccttgcgttcggccacatcaacccgttcgtgcagctggcccgtagcctccttaccgtccgtggggtgcgtgtcacgttcctgtgatcctgtcggcgcctcggcggcggtcaacgtggcccacgtcgaggccatgctgccgcggccgtcgacgtcgcggcactgcatcttatatgaagacaagagcacgacgtggggaactcaccgaggtgtggcgcgacgatgccgaccgacgtaagctgaaatacgcccacagacgagccagagctggcgacgttaagtaatttctccgtaattccttcctcttcnatnccacctattatcccccttgagtagcgccgtcaatcgcccggaacggccgcgccatctccgtccaccttccatgcaagccgtccgcctttcttggcgccgttccgccctctcccgtgcccggctagctcccctccgctataaaatgggatccccttcctccgttctctcgttttagcctcctcccgcgtctccccgtggtcgcaccgcctcttcccacagccctcctctctctccagtgccgctggccacttccagccgcctccccctcatcgcccgtgcaccggtagaccgtgtcgtcgccatcttaggcatggcaaccgcctcctctcccccagcctgccctccgtttcgcacggtgaccaccggaggcgcgtcctcgtcgacgtccagtggagtcgccgccattacaccgcctccggccgcctcggctgccgcgcctgagcctcggtcgcccgtgccgtcgcctccctcagctccgcggcgtcgtcctcatccccggccttaccatctcctcgcccgaatttcgcccgaacgccgtcgtccgcgccgcccctccctcgttctcgtcggcacccactccggcagccccttccgcctagccagtgcgccggccgacgtcgccgtctccaccttcggcattgcagtggcaaggttatcctcggcgtcgcctccccctcctcccctaccgcgccggtcgtcctcgccaacgtctcctccggtcggccgttcctctccgtcggctcgtcgtcccatggcgccgcctccgtcgtcggcaatgcagtggcgcgttccacg

SEQ ID NO: 18680 - DNA, 1036 bp, Oryza sativa
  unsure (1)..(1036): unsure at all n locations
nnnnnnnnnnnnnnnnnnnnnnnnnnnnnnnnnnnnnnnntcgcagtttacaggcggaatctgtaatttgtttttgttattagtctatgtttaatacttcaaatgtgtgtccgtatatttaaaaaaattggcacacaaactaaacacggcattatacgagggtcaaagttaccaatggtcaaagttttaaaaaaagtcaactctgtcaaaattacacgatgacggacagacagatatcaacttttgagcatccatgcacttttccctgactgtacatgtgtgtagacctgctgttcctatgcaagctaggacacgcatgcacaggccaagtttgcattcagcaagctgcttctatgtgaacaacaacatgcatgattggtctgaccttacgtcgacagtagatatagcctacaataatcatgtaccgcaaggtacaccaataattccagcaataatctcttttactcatcctatttatgcaaaaatactacgaccatcctaaggccagccacctttatagggtactggttctacaatatatatagggtgtccttaatagatccaacaaacagctttgcatttttcagaacttattgtatgccatattctagttaccagtgcaatacaataaaggttgaaaaattatggttgaaaattcaaattttgactgataaatataagcataagcgaaaagatgaggccgcaagatatcactacgtataaaatacaaattgacagcatttttaatgtcaaagaagagagaggatagattttatagaggcattaaattgcactaataccatggcgaaccattgtgaaagagagaacacaaatagggttccaccaatcctccaacttaagaccacacggaaaaatcattctaactttctctgcacttaacatctcaacatcatctccatcttatttatacgtgccttgtgttacttatataagctcggtgtagatatctacgagactacaattagggcatgtaggcgccccaacgagggtttattcatgcgcacgtgtgacaggg

SEQ ID NO: 18681 - DNA, 1312 bp, Oryza sativa
  unsure (1)..(1312): unsure at all n locations
tgcacttaacatctcaacatcatctccatttatttaattcttgccttgtgggacttatataagctcggtgtagattatctacgagactacaattagggcatgtaggcgccccaacgagggtttattcatgcgcacgtgtgacagggagttgtcaagtgtgcaaaattcacaaaactacaaacattttatcaaaaataatacttaagtgtaattctaacttaatatccacaaaactacaacaataacaaacaatttttgttatgaaagcgcatgcccaatggagacacattttttatccgaaaaatccttacaaaaaacaagggcatgtcaaccttaaaaaaacaagggcatatcaaccggcaatgattaatatagagaagataattacaatgcatgggatacaatggaccattgtaacctcccatgcggcgccggctcttgcaaaagatatataaagaggaaaaaatagtaatgctagtaggtaaagaactattacattctaaaatacggatcatatatttaatgattttaatataaaactgtaactttgccctctttttatgattgatatgtggactcaatcaatcaaatggataacattatagttcctaataaaattgacatgattttgtaattggagccttggaagcggcacaactcgtgcaaaatgcagattagcaacaggtgtcgtaaaagcccaacaccactgataatgtttgcaggaggagcatgctgagctgctgcccagggccagcagtgtccagtgtcagcgggaacagagagctcactcacttctgaggctgagagagagagagaggatgggcctggatgatgataaagaaaaagccttcaattgcaacagagaggtgcttccgaaaaggaggacacacagtgatgcacaaaagattagggaggatgaagaaccaaagcttggtcccttccttgtacccttttgctgcccttgaattattgcaactgtgagacatgcagagctgaggggatgcaaggagcaatgagaagtgacagcaaatgctgccttcagagttttgttctactagcaaacaatgccattttgccactccctctgtgtttcagataattgtcactgccattgtgttaagactgtaagaattcaggatgaacccagatattgtaactcaaaagtgatcaacatggtgttgccacgatgataattttcaataaccaaaaaaaataaagcctaactcagtactggttatcttcgtacgttnnnnnnnnnnnnnnnnnnnnnnnnnnnnnnnnnnnnnnnnnnnnnnnnnnnnnnnnnnnnnnn

SEQ ID NO: 18682 - DNA, 769 bp, Oryza sativa
  unsure (1)..(769): unsure at all n locations
nnnnnnnnnnnnnnnnnnnnnnnnnnnnnnnnnnnatctagtacttaaatttaagcacatatttttttatataagaaatctaannnnnnnnnnnnnnnnnnnnnnnnnnnnnnnnnnnntttagtttaatatgcatgtttgcacagtccggcttacgaacactaaataattaattaattacaattgaaaaataatcgaatacatagattgccccaaatctgacagcgcttaaatgtgttaatagtaaccatccttttttaagcctctacttaggataaaaattcctctgtttagaccctccttaaaacactagcacaatcacaaaactaattaatggtagagtccgttttaactcattgaacgtcgcttaaattccatttttcaccataaactacaaagccgttttttatacaagagtaaaaaaaatggactttgcttaaattacataaagaaatggactttgacataacggcattagagggttattatgctacacgcatcgcacatacgtgcacgctagagggtctcaaaaaatatgttatgccaccatctttgcttttattcctgggagaaacatcatgcaggtgtggttattttgtatgagacattacatgaattgcatcgtacaaatatgagtggagtaatttttaacattgattttgagaaagcatatgataagataaaatggtcatttgttcaacagactttgaggatgaagggtttctctcccaaatggtgtgagtggatattctcttttatccaaggggga

SEQ ID NO: 18683 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnnnnnnatgtaagttaagttgtaactcctactctctcttttcttctcccctccaccttaccatattagtttagatagcatattacttgctctaataagagcatctccaacaaaattggctatttttgtggaagagggtattaacctgtaggctgtaggagtcggtgtggattgggcgacgatggcagggctcttgatgacggtggaaaccggagagacgacggtagcatcgagcgcttgatccggggccaacaactttcagtctggggatggcggcggccacaacagtggacgatggcgcggcgatggacaaggggcgtagcagatagacgccggtggcggcgcgcaatagggtcatgcgttggatctaggaagggggcgatggccgtgcgctcaatcgcacactagatctgggaagggggtggtggcctcgtgctcgatctaggagcgcagggagggtgctcgatctgggatggaaagacaatacatacaggaaaggagaaaggggaaaatgtgtggggcccatgcgtggtaagacaactttgtcattttggttggccaactttagctaacgcatagaggactttggccagtcggatggttttcatccggttggcaagtttgttggattaggattttgattcaaaaatatcaaaatttaatttgaagaatgagatagccactctgttggcttcaagttttaacctttatttttt

SEQ ID NO: 18684 - DNA, 650 bp, Oryza sativa
aatttttatctattgttgtacgtggtgttatgtggatgtgacttattttgatattttgttgattcatttgttaatgttgcaccttgtattatttggatgtttcagtaaatattaagtgatgtttcaatcgttacaccccgatgtttcatatagtatataaaaatgtttcaattaacaatattatcaattgttctcataatatggtcatgcttataaagatttaaattgaagggtgaaaatgaataaaacggcgtaatcggattgtagattgtatcaatcatttagaaaactagatttaaaaaaaaagtttgcatagaagtgaggcaacccgacccatgagaggagagaaaaatacaagctgcagagaatcataccccgatccgtagttatctcctgagaatactaatgtccacgaaacaacaacccaaattcaacctaacactatttaggaaagacagtcaataagcaacgagatgccatgcagcccaggcaaaaaggcgaagagacgctacggcaaagagatgatatttgacccatgccatttgagatcagatcgtaacttcaccactccaccgggctaaggtcgcacaaaaaatatgacatacttttcagcaaagcatttcactgcagattgatagtattaattaatg

SEQ ID NO: 18685 - DNA, 561 bp, Oryza sativa
tgtgtacctttgtagatacatgccggatgtatctatgaaattagtagatcaatttaaaaaaccaatctatcaattaccttgtcacgtactcgttcgatatcatgcgatctgacatcttttggtacgtcgcgtatcttgaggcttggtcgatctcgagagatcgaattgttgatgacgatggttccgatctcgtcgggagatgtacttagacaggttggatctccccacagctaaagtcgtcgagtagcttgttgtcggagagtccatctcttaaacccatctcgtcgaaatcctgaagcaccaaaatccccctacctggtgcgccactgtcgacgtttgatgtcgcgattccagtatttgcatagtatggggatcgttggtgctagggtatacgcgagactgaggtaaaagagacggagacgatgatttttatacaggttcgggcccctgaattgtcagataataaccctacatcctgttggccgaagccgatattgctcttattcaccataatcacaccagtacaatatttggggtagcctatctaactgttgtcgacat

SEQ ID NO: 18686 - DNA, 1189 bp, Oryza sativa
  unsure (1)..(1189): unsure at all n locations
ctagaatgaggcaagaatcgccggtgtcgcagagctcacccatgatctcgccgacgcggagcacggaggcggcgtcgccggggccgaggacgaaggagcagagctgggcaaggagcgcgacggcgccaccgccagcgccgtccgggtccggcctgagctcggcgcggagcgcgccgacggcaatgccgaatgtccacccgagcgagcacggctccggcggcgagtcccccccgcggcgggcgccggcgcagggggcgacggtgacgaggacggcgaagaggagcgcggtggtggcgaggagcggggagaataagcangcgagcgcgaggaggtggcgcgcgaagaaaagcgcgtacgcggcgtggagcgggtgggacgcggcgaaggcggccacgccgagcaggtcgtggagcacggacagcgccagccgcagcggcgcgtcgcgttcgagaaggtcgcaatcatcacggcaatcgccgccactgtcggcgcactggcgcggcgccaccattgtcgtcttcttcgctcggtggggcgtggcttggcttcgtcggctagtagctgctacctaggcgcggccatgggtgccacggagcttggcctggacgcgcacgcaatcagtggaggcagcatggcgcgttgcggcgtggtgccatgtggtgtcgcacagtggcgatctttggcatggagggggaaagagatgaagaggagtaaaaaagagaggcaaatttgatgatgatgatgagatgagagagagtggctgtgtgcgggtgggttttgtggtgatttggcgggagggtgtgcagtggcacgggttcgcgccatgtgtaattatacggaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtaaatttcaagaatttgcacgatgtcggatactcactccgttgaaaattatagaggtgtattttgtgttgttacaatctctccggctatagccatttgtaaatggttctagctatttgctctcatgtacaattaagctgctatatctgtttgagaaaactaaccgctaaatgtcttattccgctatttaaaa

SEQ ID NO: 18687 - DNA, 1310 bp, Oryza sativa
gttcgcaccatgtgtaattatacggaaatataatcctactagtaataataaggattacaaatggttggctccaccatggtttgaatcttttggaattttcgaatttaaggttaccccgagtacatgtaataaattcccctgtacccgaaaatctccacattgttcgaatttaccaggaagttgtaaatttcaagaatttgcacgatgtcggatactcactccgttgaaaattataaaggtgtattttgtgttgtaacaatctctccggctatagccatttgtaaatggttctagctatttgctctcatgtacaattaagctgctatatctgtttgagaaaactaaccgctaaatgtcttattccgctatttaaaacattgttacgattaggctttgattaataattactttaaatggacataatttttgttgcataaaaataatgtcattatttagaattatttaagattatgttttttataattggtccacgtctcgtccaaacgaaataaaataaattaaatacgtcttattttcatggccggagggattactattttagacatcagagtaactgattttggttttcctttgctcttgttcaggacttcgaggtttgccttcattcagcagtaggaattgcgtagctcaaaggccacgaagctcttgtacgcaatcccttcacgacaagacttcgtcgttcaaaggtcaaaacgttctactcctaccacccatttgaagtccaaattttaaatggtcctttccgtttcgagttccaaaagattgcaaatctttattttcaatgaaataattgcaatttttttctatgtctgctttataacttctgcattggcgcccgaattacagcacttcataagacgagacttatttaattcttgtaaactattttttttttggtctgaagctccatgtgtgaactacaactacaatgaatgctattactgtggaccagtacaaagtacagacactattacgggagtacttttaccaactgagacagacaaatgggcccaactgataagccgccaaaatgtttctgacagttcgtcaaaacgctctaaagcaagatgttttacgtacttatagtaattaatggtatttagtgtttgctagtatcccatggtttcaataaaggtaagtctaatggcgggtgttcgtagaccgcgaacacgttgcgatagcccaatccattagcccctactcctctctctgccttatcttctttacacactgttttctgtggtgacagggacaatgggaatggcgaatatatctctgacgaactccct

SEQ ID NO: 18688 - DNA, 8379 bp, Oryza sativa
  unsure (1)..(8379): unsure at all n locations
acgtcgacggcgtgtgaaaggaccggtgacggcgtgcgtccggcaggggcgccccaaggtgttcgataaaatgtcgataagggagctcgtggcgtggagctgacaaatctagccaaacactttgacaccaacctcagcttctattggatccagctgttggtatttcttacgatcacagataaatccgcaagcgcacagaataccgctgtagcacttcaccttcgggtgacccaaaaaagatatcgaactcagggaacgtgtgtaatctacctaaggctaagactatccaaggacaacaactgatggtaggtaggctaggctagagatgactttctatgagttttaattatctaaactaagcaaaggtaatttttcaactgatggtaggtaggctaggttagagaggattttctatgagttttaattatctaagctaagcaaaggtaatttcctatttgttgcttcgggtgccgacccctgctagtctgctagcattgtttcggctatagctctatgatgtatccgaacgtggaggattaggattacttggacgggattcagggctgtcaccacctgccgcctacctctgacaaatctgtgggatacacaacaaacaaannnnnnnnnnnnnnnnnnnnnnnnnnnnnnnnnnnnnnnnnnnnnnnagatgaacagtatacgggacgcaattagactttcgtcttgggctggctgaaaaacaaaggaaagaaagaaagagaaggggagctcggctgggccgacttgggctgcacagcacgcgcgcgaaggagagagatgttgggctgaaatcagcccaacggcttaggagaggatttaacaactttccaattaaaataatcactgaaatgatctttgaattgttaaaaatacttccaatgctcaaatagtttcaagaaaaatcctgaaaatacttggacactcaaagtacttaaaaaaattataagcagaccatttaatgattaatttaatatgtgaataattactgaaatgttctttgtatggttaaaattaagagttgagctccgaaaaatccgaaaaaattccagagaatataattaaccatggagaatttaatagaaattaaatccagccatgctttttatttagaaaattttatttcccacatttaacttctcttgtaaattaatgaacatttaatataacttctaataataatttattaaataatttataaatcctgaaacgaaaatcaggatgtgacaggaggggagtgagaatgacatgttgggcccacgcggacccctccattttaattattttttgttgtaactgacatgtgggcctacaatttttattattttccagatcacattgccacgtctttgccacgttggatgaagacttagttaaaggagccacgtaggcatcacgtcaaccaaaaccggggtcagcactaccgagggatctcgtttgcactagttttgtaaattggggatgtgttgtttccggttttttggttcaaggatgaaaatcgtattcggtgtaagttaagggacctcgaataaacttattccttttgggtacatgacatctcatatcggtgtttgctgtgtcggccttatgccagcatcctgcatcattattggtgttacttctgttattattgatatgtctgttgaaagttggaaccatgtatttattgtatctctctgtatcctctttgatgaactaatggtttgtgtacatttctgaattcttatttatagccttatggtccagcttcagacatctgagactgatagctcagtcaataaattcagacaactcatctcacctcgtgaattgtgcagtaatttagatagtttaagcattatggatatgatttcgttactagaggtgtaatagcgtgttacatcgggtatattatatagggtatcgtatgggatgttcgggcactaataaaaaaactaattataaaatctgccagtagtccgcgagaaaaatttattaagcctaattaatccgtcattaataaatgttttactgtagcaccacattgtcaaatcatggagcaattaggcttaaaagatttgtctcacaaattagtcacaatctatacaattagttatttttcagcctgtatttaatacttcatacatgtgttcaaacgttcgatgtgatagggtaaaatattttagggtgggatttaaacaggcccataatctaacttttttattattatgaacaaaacaaggaccataattgaggtacaaaatgtgcctttttttctcttttacttatatcatcaaaaatatattttctcacattatccttatatcatcgcaaaccatcctttttccattattttgtgttctaacatgccaaaatcattttgtatttaccttctcgatattcgatagacatggaagtattatttgtattcgtcttcgtccttcattataatgttcacattatggcttacttttccatagtgagaactattcacagtccagaaattatacagaggccaatttgagtatttctgtaccaactatttgccttaatatttatgtgctattaatgaagcaccgatatgataggttctctagttacgagtgtatatttagtactcctgtatgttgattatttcatttggcaattttcaggtaattataaatcatctgcataagcagtgttatcccccgaccagtgattgacccggtcaggtcttcggttgaaccgtaggttttctttgcatacgttcattcagggattatgggcttgcttactttgacgttactaccaatcctattaaattttgatatgagtaaattgcatattcacggtacatcaacttagtaagttggtgcaatttagtgaaggaatttgagaaataagcatgctatgacaacaacatgctaagtggatgcaacgtagtacaacaacttaataaatgagtttatgggtacgactatttgaaaggtgggtgtgattttgatgcaataacttgagaagtggtgtaaaaacttaattatgtatttttggctatatgtaaacagtttttacttacccagttgttaataaacttatgtagatttgtacaagcatattttctttgtcattctagtaactaaaagtctgagtaaaaaaatttaaaagtaaaaaaaattactgtgtagaaattttctagttgatatttgagatggtaaaaaaaaatctaaatcaatggtgcaaattaggtgaacaatatattcttacagattacatcaaacattataagattaattatatctacggaattgctatgtgatgacatattaacatcgtgaaaaaacttacatagcactcattaaccaaggtagcacatatctagccaagttattgcaccaaaatattaaattatcaaattcttgtattaaagtgcacccacttgctaagttattgcactttagacgtcacattcttcttgtcctaaatagaacccacgtatcaacgtgttgtactgtgggtgtaatttactcttttgataaagtaaaaaactgaacttatacatatatagcaatgctatcttaccaatatttggtaactttacggcttactcggtttggaggaatttgaatccataggaataggaaaaatgaaggaatataaatgtttgtacacatcaatctattggaatttttctaagagatttgactggatggaataattcttatgtttcctctatataacttgtagaaaaggaattttttttctttggttttcttatacttcaatcatataaattgaatgacactcataagaattgatctttaggaatccaaattctttgtttttcctccaaaacgaacaagcccttacaagatttcactattgaaaattccctcaaattgtaaggttttaaactaaacatatccaacagtattaaaatttgataatgtacaaatgtggcaaattttagtagggtaaaaagtggctacaaagttaacaagcccttatatatgattggttggttgtatcacgtgggtcagaaaagactaggtagttctatgggttttcgctggtctaaatcgactcgactccagagatattcccttcgtcctaaaaaaactcaacttctggaatttgagttttatctcataaaaaatcaacttctaacactctatctactctcagcatataaaacgacaagttttatcccttaaataccctatacctacctatcactattactactttttctaataatgataggtattttggtcatttttactctccactactttcttaggattatagggtttgatattttgtgggactgagggagaagtctaatagcctggactgaacaggtgaaggtgttaggtctggccaaatcgtggtcctagcgtttcgagtgacttgaaacgataatttactcgttattctttaaaatgattttcaaattactaaactgttattgtgtgaaaaaaattatatagaaatttctttaaaaattatattaatctaattttaagtttgtaataactaatatttgattaaaattatacgctaatgacttatctagttttttctcagccaacactgctggagagatgcacatctctcccagttcgtaaccccctttattcccgggtaacgaaccggaagaaaaaatccgggattaaaaatggatttttagtcccggttggagactccaaccgggagtaaaaataaaagcgccacgtagcgctttctctttctcttttctttttttattttttttgctactttcatattgattttgcactgaagtcaataataaattcatccacacagacaaaatcattcaacatcacagattcatttgtaacttcatagaaatatctgaaaatcatccacaaatttacatcacaaaatcatccacaaatccacaaatccgtcagcggccgcctcccatccgcgccgccttctccctgcgcccgccgcctctaccaccgcgccgtcgccacgcggggccgctgtcacccgccacgcacaggcttgcatgcctgcagcgcgacgcgggcggatccccaccacggtcaccgcctgctgctgctcaccccgccgggcgcggccctaccgccgctggccgcctgcccgctgccgcggatgacaggaggggaggggacgagaggaggaagggatctgaggtgttggaggctctcaaatccaatcttatctagatattttggtgaggaggaaagtctcgtctgggacttaaccgaacaaatatggtagagaaatatttactcacggttagagttaccagccggaactaaagatggattttcagtcccgggagtaaagatctaaataatctttaatcccggttggtagtaccaactgggactaaagtggtgatctttagtctcggttggtatcaaccgggactaaagctcctcggccccctgacaggggatgaatcaggactaaatatcatctttagtttttaaccaggactaaatatcaaaaaaatttaaaccgggactgaagaacaccaaccgggattaaagatcaatttttctttaactgggactaaaaacattttttgttagaaccaaaactattatgaaaatcagccgacccagtaaagatcacttctcctgtagtgcaaaatgctaagtagaacttaccctaataacacaatacaccagtactgtacaaggttaaaagacccataaaattgtcctgaattacatgaaaaataataaaagtgaacagcgatcaatatttatgcgtataatatgatatttaacaagttagtatctgaatgcatttactttcggctgcaaaatgcaaattacaagttgcttttagaagaagcttgcacatatattttcacgccaaaattggaagtttggttgaaattggaatgatgtgacgaaaaagttgaaagtttgtgtgtgtaagaaagttttgatgtgatggaaaagttggaagatcgaagaaaaattttggaactaaactcggccttatatagactttacgcctttacttgccaggaaaatgctctctgttgtacctgggcacattttataggtgtatgctataaaattgtgcacatcttatgagtgtgttaagttcacgctaaaattggaaatttggttgaaattgaaacgacgtgatgaaaaagttaaaagtttatgtatgtagaaaagttttatgtgacgaaaaggttaaaattttaaagaaaaagtttggaaataaactcggcttaggtatctacatatgtgaaagcaacaagctttctcaaaaagccaggtcatgtgaataataatagccttaggatgagagtaggaataaaattgggccgttggatccatttgtgttataccaatcacacatcaggaaagttccagattaataggtcctatgcatcgatcggtgtatatacatatagtttcatatggtagtagtgaaagcaaaactagtatagatggagagcaccagcagctcgtctcattgacccgcaactacagaaatccatccaccgtagtgccaattctattaggccctgtttagttcaaaaataaaaaattttatgctaccatatcgaataaattggacacatgcatggattattaaatgtaggcaaaaaaaaccaattacacaaattacgtgtaaattgcgagatgaatcttttaagtcttattctgccatgatttgacaatatgattcaacagtaaacatttgctattgatggattaattaggcttaataaattcgtctcgcagtttcctaacggaatctctacgtttaatacttcaaatgtgtgtccgtatatccgatgtgacaaccaaacccaaaaattttccccagttaaacaaggccctactcccttcatctcaaaatatagctacctttaatatatataatttatcctacttcacatattccttcatctcaaccaactacaaccattttctatttaatttcatcatatacttctttatcttaatcaaccataaccttcacagtttctatcaaaaacaaaaataaaacacaaccctcccatttaattttattgccctctccttaatcccttcaaaaaaacataaaggtatctactctctatctacaaatataagcatcacaaatgtttaaaatttattcaaaaatataaggatttatataataacttaccttcaatctaacctcccattaaagaaaaaatatcttactctcgactattttctcaactcctatcatttctcggtaaagggatataaagttttatatgatcgaacataatctttcttaaacaatataaaaatccttatatttgaaaacagagagaatagtctcacaaaaattatcctgtaattatcaagatcagtcgtcaactcctatatgctggttatgccagcgctcagggtcgcgcgaagcgggactgggtggctagtttaggtgcttctagctgcaacaacaaaaaatgcgaacgctagctgcaacaaaatcactgcaatgaaagtaaatctctgataccgatttctgggtctaggctcttgtttttcattaggcgcgtggcaccctacaaatttagttagagctcactcaaaaactgccatgtgtgatgggtgaagtattcgcatcgaaagagatcgggaaaaaaaacgtaaacgtttgcctgcgtgcgtgtgcgggatgggctttgcatctagctagactgtgcgaccttgggcctgggcctggccctggcgccccacggccttttctgcaatatgtaccgcagtccgcagtactggtgcatggcctcttcacgcagcggtaagcatgttcgttcaaaagaaaagggaagaaaaacagcgtgaaggactgaagtgtatagagccagtatagaacaaaataatagtaataaaaagaaaaggagaaaaactaaaaataataggattatgcaatcaactacaattactcaaatgagggaaagtcacttcatgttagcatcatgtgtttctagaaaattagaaaaaatagtgaaattaaatggaaaaaaatatagcagcagcaaggattgtgttaggacaatcgaaagcctccaaataaatacaatctagaatgtttacttcaaacgaggaaaatacctaaaattctatagaatggaaagaataaaaagtgaaattagatgaacagatgtattctctgttaaccgacaagttcagcactactttcctattaattcagagcattttgtttttcctttattaatcctcaccttatactttttctggatgctaggaatccatttattttggaacatgggtaagtaacgacaataattttgctatattttttgtttgtgaaacacaatgtagatgatatacacacgagcaccttttaagactaggccgtcagacatatatttggattgataaa

SEQ ID NO: 18689 - DNA, 1189 bp, Oryza sativa
atataaggttgctacattttaggacggagggagtatataatatctctctcccttgatgttatcacgaactcctacatgacttataatggatgtgctcacttgaaatcaagatttctaacttttcactgccctttctcaagacagaaaaaatggaagagcagaggcccaaggccagcgagaacaagcctgtgatgacagaatgagcatctcctgaaacagcatttgatgcttaagggtgtgtttagttcacgctaaaattagaagtttggttgaaattgaaacgatgtgatgaaaaaattgaaattttatgtgtaaaaaagttttgatgtgataagaaaattgaaagtttaaaaaaaagtttggaactaaactcggccaaacgaactttcgctagcttaaaacgaaagcttcctgagatttttcatgcacggtatagtgtccctttctagcctgtagaattttggatgctctggttgaacgtgcaccgactgttgctgttacagtgagatggattggatccctcagctacctatgaatccctgatcctctctgatcaatgagagatgcatatgattgagagccttttttccagacatcatcctgttcctggttggtgcatccgtaccaggggtggggtgccactgccatggtgttcatctctcattttctctcccatctcttagatataagatatagattttatctcaatttatgttaacatgattttaagcagttaaacatcatatttcgtagaagatgttgttttaaaatattagataattatattttttaagtttaaaataattataacttaatcaataatatgctaatggttttttcgttttacgtgtccatatagggtcgaagcaggccacaagtatccagagattctagaggaggaggcaggaaagcggaaaagtgagtttttaggccggctcctcgtccgtctcgatccggtgcatggaagaatggcatcctaagccttctaattcgatgcattgttgcatggcatcatttggcctgagatttgtgtgtttgctgccatgtgtggtgatgtcgctgtcgttttcgacgaggccacgttgcatgtgaagaggtagtgaagctcaagctgaagggttcttggtttgtttggctggctggtgttatgggtttgttggaattgtgccatgttttgggtactgttttt

SEQ ID NO: 18690 - DNA, 609 bp, Oryza sativa
  unsure (1)..(609): unsure at all n locations
nnnnnnnnnnnnnnnnnnnnnnnnnnnnnnnnnnnnnnnnnnnnnnnnnnnnnnnnagtccttttctaaacatattctatctatataagctatctactataaccaatcggatatacatgccatatgggtatgcggtacccataatctttccaatttcattctagctctgcccctgtctacaatgtgggtcttaaaagacccatagaggtccttatgatgaaccttatacattgtgagacttaaccatgaggcattgaatattaagattgaccttaagcttgtggctcacctttaggaataaaataattggataaataaactgcacacgtagcgagtgagagaataataacaaggctctgtcataaaaaacgtgccatttcttaaaaatggttggagaaaacaacggaagaaaaaataacttagtttataaaaacaagccgcttcgaaaaaaccatggaggaaaaaaaccggttataaaaataccggatcaaagaaactatcggactcaacgcgagaaaaaacccgcaacggtttgagaaaccgtccgacttagcgcgaaaaataaaaccgactgtttctttaaaaaaaaagttagagaaaaccatatga

SEQ ID NO: 18691 - DNA, 965 bp, Oryza sativa
taaaaaagagaggcaaatttgatgatgatgatgagatgagagagagtggctgtgtgcgggtgggttttgtggtgatttggcgggagggtgtggcagtggcacgggttcgcgccatgtgtaattatacggaaatataatactactagtaataataaggattacaaatggttggctccaccatggtttgaatcttttgggattttcggatttaaggttaccccgagtacatgtaagaaattccactgtagccgaaaatctccacattgttcgaatttaacaggaagttgtaaatttcaagaatttgcacgatgtcggatactcactccgttgaaaattatagaggtgtattttgtgttgttacaatctctccggctatagccatttgtaaatggttctagctatttgctctcatgtacaattaagctgctatatctgtttgagaaaactaaccgctaaatgtcttattccgctatttaaaacattgttacgattaggctttgattaataattactttaaatggacataatttttgttgcataaaaataatgtcattatttagaattatttaagattatgttttttataattggtccacgtctcgtccaaacgaaataaaataaattaaatacgtcttattttcatggccggagggattactattttagacatcagagtaactgattttggttttcctttgctcttgttcaggacttcgaggtttgccttcattcagcagtaggaattgcgtagctcaaaggccacgaagctcttgtacgcaatcccttcacgacaagacttcgtcgttcaaaggtcaaaacgttctactcctaccacccatttgaagtccaaattttaaatggtcctttccgtttcgagttccaaaagattgcaaatctttattttcaatgaaataattgcaatttttttctatgtctgctttataacttctgcattggcgcccgaa

SEQ ID NO: 18692 - DNA, 760 bp, Oryza sativa
ttgtatgtcgtgtctataggcgttgtagcccataaactcactgtaaagtgtgaagtgtatatacgtgtccttgtaaggccctgtttctttcagcttaggattattataatctagattattgagttagattactataagctagattgctataatctatagtagaataagcggttagttgtttctttcctagcttattagagcctagattattgggtttttaagtctaaatagggagtggggtggcatggtggataatttttcacccaataatctggaaaaagcttacctaaatgagcttatcagattataataagctgggctctagattataataagctacttcaataagttgtttgtttctttcagcctactctcaataatctagattataataatcctaagttgaaagaaatagggcctaattacatctgtacatgtctgctctgttcaatccgacgttttgataaatattagcttttctgtttctcttttaatgttcggtttcaattatggatacacacagttatttaaaattggtaaagatcgctttaacgtacatgtgtctcgaaagggtaagagtgataactgattatgtcaagaaaaaagttgaaaagagagatgatgctaccaatggtttctctccaaagggtaatactgattatgacagtaacttgatccatctgtagattggatcaagagctcacgcctgaccttcaatttcatttgtgattggacaattcgaagggggatctttcggttt

SEQ ID NO: 18693 - DNA, 2299 bp, Oryza sativa
ccgtctccgccgagccattcgtcgtcgtcgttcccacgcctcgtcgcgtggtggtaagggtccgtcctcccactgccccgtcctcgtcctttcggtgttgccccgtgcccgttgtgcggttgtcgaccccggtacccatgtatcggtgtcggtagtcgttcgtatgtgcgtgtggtgaccgcgttagtgtgcccgctcggtagccgcgtggtttccacgtgtgcagcccgcgtggtgtctagtggagtacgtttgtcggccactcacctcggttgacacacggggtccgcttctgttgacccgtggaccgtctctgtgtacccgggctaccgtggtcccttatgttgacatgtggggtccgcatgtcaacagcacagcctttctgtctttttcaggatagcgcttacacatgttttataggtgcaaagcctaattataataatccgcaaatctgcatataacaacattaaacttcgtatgaccatatcttggtcatacgaaccccgaatcgacccgttcaagtcttttaatgtttgttataacctaaagaaccctatgctttctttttatatactgggattgcttctttataggcttgtagctttgcttgtgtgcttcgtgtagcttctttcgttccggaggttcccgaagcgtggctcgtggtcgtcgccgaaggttcagaaggccgttctctctgagcaaggcaagtcgcatcatccttgagcatattgaatcccagtttataaaattattttgatttaaattattgcattatcgctttatttaaattcccgcgttatcactgtttttagtaatacctattaatccttgttatagccttatcattactattgtttattatcacctcgcttaccctaggaaaacaaaaccccaactagtgggtactgtattaatggttccactagtatgaatttaggtagatgcttcgctgattaattatgccacactagatggttttataactgattaattagttctcatatcatttggacattatggaatggttggcttgtgatggaattgaacacacacctccccctctattcaaactcctaaatggttgtaggctgggctcgaggtgcatggttttgctaggagcacctcggccaccataaggaccggtcttcgggcctctgttgcaaagcactaccgtactaaccatatgtctaatgggtaaggcttaactcggtgctcagtctagtcctgaacaaaaggacacggatagagatggatgaagtcgttgagacgatggatatctctgaggcaaatgaaggctacgtgagctgcggcttggtaatcgagatgtctagacaaatgaatgctacacgggtcggtgcccgttagtcgagatgccatggcactagactagtacgcgggtggtctcacccctatgtgtgtggcgcacccggtctagatcctgttgctaggggctcaatcctggcctgcctatctaggatactggccgtaggcagggttgggtcggtacttttgttcacggctaggatgggtgaagggttatgtcacatgtttacgacgagttccaaggccatggaatgtggagtaaagatatgtcttgtgggtaaagatgtacacctctgatcagagtaaatctattcgaatagccgcgcccttggttatgggcaagcctagcaatgtacccaagttagttgtttaattcttaaaacttgcttaacaactaaaatgtggaatggttggcctgggttggcttgggacgagttgggaccaggtcaggttgccagttcggtctgaatcatcgtaggccttgggttaaggcaggttcatgtgggttcacggccttgattaataatattgtgtagctctaggatcgtgtttacaaaatagctttgggcaactaagtgacttttaaatgctgtttactgccaaacttaacccctattattatccccttgtacccccttgcattaatcatgcatctcctggtgtggcttgctaagtactgtggttgtactcattcttgctctatctttccccccttcagtaagagaagctttggagaagaagtcctaggtggagtcatggcttataccccagttgagcgcctgtgaacatggagtcgtaggctcgctagtccgctgctgtttatttttgtttgtcaggcctgaagtgcctttgtaataatgtaaatattatcaatataataaatatgtactttttgtatcatatttgtttggtgtatcccggcttttcctgggacgggtattaaaaccctagtgttctggaaaaggtatttttccgg

SEQ ID NO: 18694 - DNA, 15845 bp, Oryza sativa
catatttgtttggtgtatcccggcttttcctgggacgggtattaatacactagtgttctggaaaaggtatttttccgggcgcgacaaggctgtgactaagaatggaggcatgacagtcattgaaaacttgaagaacgacttgatccgacaacgcactataacgggatgatacgttttcaggccctggggcgttacccctacgtatgcacaagagccgcaacagaagctaaatagtgcgatcagagaagtcgtgaaaaaataggtcttgaaactcctacacgctgggataatatattttatgccgtatagagagtgggttagcctggtgcaggttgtgcgtaagaagggaggcatggcggtcattcaaaactcgaagaatgaattgattcgatgacgcattgttacgggatgaaggatgtgcattgattacagaaagctcaacaaagctacaaagaaagaccatttcccgctacctttcattgatgagatgctggattagctaggaaatcatcaaattcccatctatgccgatgatcaaagcaagacaatgtttacatgtccgtcgggtcccagaactaattacttggatccgactatgattaatgtatcaatccctggatcagtaaatattgatacatacaatataactggttcttaattgcatacattaaagttctacaatactaagggttttacaataataggtactcacctaattaattaactagaattaatacacagcggaagtttatatacatttctgactagagaggtataacctttagggattttctaaattatcagggtcatcgtagtaatagtcataggggtcctcctcttgacccaaatctgaaaaagggctataagagcaagaatgagtattgacaatactcagcaagttatcatggaaatatgttatgcattggcatataatggggttctttgtgaaaagcattaataaacaatctagaagagttatagcaagaatttataaatatatatatagactttaaatttctaaccagggtaacatatgagtcctggtactcaattccatgagtacggctattcgaatagtttcaaagatattctactgcagtagatgtacgctttacccgcaatccacaacttgctgataatcatcggctatagtcatggcccaatattaagttattaacaattgtggcacctattccatgaacttatatcctcatatgctctgaacgtattgttaacagcagcaagaggagttctggcgttcccgagatatttaaggggaactaatcgtatgacaccacgtcatctcgattagggtttagaaatataccatataatttatactcgagtatcacaaaccatttacctgtacatggtaatggttaaaagttgcctttcgctgctatagttgcctcctgcgcgaggacttaaaaataagaaccactatacagaggtgccatattgttaattaacataataactaggtctatccccattctagaaactgtggtcgtacccgttcgttcgacataagtacctggtaaaaactatatcgatcgagacagtactagccacccagaaatcaaccaaaccttacgtactgtcccaatctaagtttaaggaattttaagcagattgtaagcaaagtaagcaatactaaattatctgggtttctatggttgaattatgcatataaaatagaatattgaaaagaatgctataaataaataatttgtaaaatataggcttaaatgatcaaaaggtatatggtaacttgccttgctcgatgtcctgagattgattgctattatctagtgtgtcaaaagattcctcaagacctagggttagacatataaaattcaaattcaaaaggaattcagatacaatccaaaaataagaaaaatagggaaaataaaataaaatagaaaaataacaaaatgggtctcaaaagatagagaatgattttagaagaatattggtccaagtttcaatggaattggacctatattttcaaagatatgggtttctaaagtttgaaaatcaattaaatgtgaaatggcacggtgtgcgggtcccacctgtcagtctctctctctctctctctcttctcttcttctacctccagccgatccctatttacggctggcggtgctaggattggcgattgcggcggtgatggaggagaagaggggttgcgcccgagtatgggagggagctagggtactccggcgacggtgagcggcggcggaggggttaatttggtatgtggttgagctagcggctagggcggcggtggcatagttaagccgtgaaggtgatcagggttatgtgagttagacatggctcggggaggggttctagagcatctatcaggtacctagaagggtttaagcagcttgccgacctttcgcaaggtgtggaatatatttgccgacgagctcctccattggcggtggccgtgctcacgtcggcagcccagagggtggcatggtagagcaaaccaattgctaaaatagaatctagggagtacatagatggttatatcgaaagaactcaccgagatcggttgaaacgacgggtcgcggccggaaaaactttgtggcggcgaagaacagaacagcgcggggccggcggtgctcggcttggttcggcaaggtaaaactcgacgcagagcttcggttaggatctagtatgctaaaacatggtaggatataggtgttctaaggggtatataaggtgaagcatggatggaggggtgtggagtcgatcgcgcacaaggtgttcgatcgacggccgagggtggttgatggaatggattggtgaaacagagcttcggagttgcggggctatggttattgatgatcgatgatggacaaggaaagggttggggtcctatttatagggccaggggaagtggatgagttcggacgccatcatcgccatggatgagctcaaggattggatatgtcaaaggtggcagaggctgtgagagggtggccaaggtcaatatgagtggcgggaggccacgtttgaatacttaccagcgaaggattggcttgaccgcgagtagaaacggctggcgacgtgttggcgccaatccgggcgtgacgcgcagcggtagtgagggttaaaacggtcggcttgggggtgaatggcttgaattgagagaggggaaaccaccttctatcttcaattcaaccgtgtggcaagaattggcgcgattcaccctgggtagaatcaaaatcggactcggcggcggctttggacgggaacgcacggcatcgagcggcgatttcttgcggcggaggtcatcccggctttgtcgtcgtcaagattggtgcggcggcggcggcctgagggcgtcggacgggcgacgacacgccaaggcaatcgggcacgcgcgacgggtcccgaggccgacgcgcggcggctcggcgcgcggcaaggtaggaagccaggcagcgcgcgagaaggggaggagaaggccaactaaaccatggtttttgagtgggatgtggtccccaaggatccaacatagactttgcaaaagattgggtagagattgggctgagttagctgggctaggcatttcatcgagctccttgtgtgcgatgaacagtgaaattcaacaattttgaatattttccttgagaagatttgaatttaaactatgaatttggaaaggtttcactatggtttggagtatagcaaatccttactaatattagggtaaattaaggaaataatctaaagattgaaatttgagagaatttgctcaaatttagtaaggttcggaataaagggtataattagggtaaattagtagggttctaaagaagtaatacttgaaccacttaggaatcaaatagatttttaaaacacactaaattaatcaaaagccagcatgatgcagtcaaattttagttttaaaatttgaggatgttacaatgtccttacggaatgtacgcataccagcggatgtcgttcggttgtgtaatgcacccgtgtcgttccaacggtgtatgatgtctatcttctccgacatgattgaggaaatcatggaaatcatcatggatgacttatccatctatagaaagagttttgatcaatgcttggagaacctggacaaagtcttgcagcggtgtcatgaagaggacttggtgcttaactaggaaaagtgtcatttcatggttcagaactagtaaaagtgccacttcgtgaaaaggattttgtgcttaactaggaatagtgctcgaacatcgagtctccgaaaaagcagtacaggagtacaaagttagaattgtggtaatccaacaactccgacctcctataatgttaaaggggtccgtagtttcctgggtcatgcggggttttattgtcggttcattaatcatttttctttagtagctagacccctcaccagcttgccagctaaggatgctccctttaactttgatgattagtgcttaaaatcttttagttacctaaaagactctggcttacaactctataatgtatccgaatgttaaggattaggaaagagggacagggttgtcatcacctaccgcctacccctacaacccgtggagcacacaacaaacaaatgtaacctccagcctagacacaatgtatatgctattgattactactctaatctcggtaccaacttaagactaaagtactctacctaagtagagcaatgaatccgcaactatgagaaaatatcttacttaaataagaagagtaaatacaacaaagaagtcatgaatgcttacttatatgaagacaagtttggagaagagtgccgacaaaccttgcacttccccaggagaagaatgccgacagcccagcctggcacttctccagacattctcttatttactccctactctaagaactagctaagtagatcttcacctttggaatgtagcaatgatttatatcttggtgtgtgttgagagtaaggaatggaggcctatttataatgtggaggtgatttgagagaatattcctcctccaactcctttcaagccacagcatgtcctcaaaccgacattctatagcggttactcaccgtgagccttgcaccaacgtctccaggagagagataattgatgctatgtggaaattgtgatagaggggagccacccctcattcgaccgaaccctggctaagccccctcgcgccgccttttatctgggtcactgcctggtaggtccacgtgacggtttggggtgtttggacgacgttgaggcggttcacctcctggtgtgggccctttgattcatgtactcttctctcattggctggaatttgttttctcttacttgcgttttctcttaatttccacaagtattcacccgcatacaaatattcaccaacacttgtggaagtggtttgtaataaacccctaccgctagatttagtggtagactatggtaaaatttatgcatgaattgatggtcaaatttggtagttaaggaccgtaaacagcgatgatggttacgaaatattgtaataaaccccaagtcgtcgattctttgtcatcggaaaatccatagcagcggtgtcatgataaagattgggataatgatgattccgatttgaagtggtgtgtaattcagtcgagtcatatctcctaggtctgaagtcgtcgaagattttttgttcacgcgattcgcctcttggacccatctcatcgaaaccttgaagcaccatatccccctacctggcacgccactttcgacgggctatagccgcctacggtatttgtagaatatggaaattgttagtgacatggtatacgcgagattgaggtaaaagaggcaggagatggggacttttatacaggttcggaccacgtaactaatgggtaatagccctactcctatcggctgaagccggtgttgccttttatatatcaatatcacacgagtacaatattggagaggacttaatctagtcccggtcagcttagcaacatagaactctcacatgtggtcggcggctagtgtattctgcctcctcgaatatcacacggcgagattgaaattgtattgtgtggcttgcctagatccgtattggttttttcttcgcctcccgtgtgtgtcgtctctcctactgggggtcttgtatttataccctcaggtgtcctcttgtctatgtagaattagataaccaagtatggatacgataagagtggtgcttgtcgtgctcaagtaggactttgcttctctttccttattcggaacaccgtccgtaggtgaggtatgatttcatgtaagacttgtatatggtgggtctcgccgagccaaaaaaaatattaatgatgtcttatctataacattcacttttcaagattgaacgaaattttaatgaagcttgattctttattcttctgcaaatgcgaatgaattgccttgtatatattgagtctgcaagatgttagcttgaagcaaaggtatatagcgggaaacacgcatgtggataagtctgcaaaatacatttgcatgcgcaagttactaatactcttacaagaacaaccaggattctttctgaaatactttggccctatcatatttaggacccaatgcgttacttttgtacgctgtgttatcactgcacgtaataattagcaacaaaaggcgttcatacagtatatgtactagagtatgtcatttcacctaaactgatagctacatgctaattgtgtatatctaacatgcgctgacggcattggatagcaaaaaagtggaagaaatatttatggatggtttaatttctgaaagatcatttcacctaaaattgacagataacttctctaatatctataatatatatttaaataatgtgaaaataatgatttgatattgcttgcatgttaattttaaaaatacaacaaaattgttaatgatatgtgctaattattgatttagccatgcgccatccgcgtatatatagatggtaatggggtacaaatgcttcacactgaaaagcagtcccgaactaagcatggccggtgtggatgccacggccgccggcggcgacgaggccggcgaaacgttgcacgtagtgttgttcccgttccttgccttcggccacatcaacccgttcgcgcagctggcccgtagcctcctcgccgtcggtggggtgcgtgtcacgttcctgtcggcggcggccaacgtggcccacgtcgagactcgagaccatgctgcctgcggacggccgtcgccgtcgtggcactgcatctgccgcgcgttccggggctccccgagggcacagagagcacggcggaggtcgacgcggacggcgccgagctgctcaagctcgccctcgacggcacgcggccgcaggtggaggcgctgctcgcgaggctccgcccggacgtcgtgctcttcgacttcgtcacgccgtgggtcgccgacgctgccaggcgtctcggcgtcaggtcggcgcggttctcgatcttccccgcggtctccggcgcgtacttcatggcccacgggcgcggcctttacggcgcgcgcccgaccgccgaggagctcgcgtcggcgcccgaggggttcccgccgtcgtcgccgctctccacggtgccgacctaccaggccgcccacttcacccacattttcaccagcttccacggcatgccgagcacgcatgaccgctccgtcgcctgccacaacgcctgcgacgcgctcgtcatcaggacctgccacgagatggaaggcccctacatcgactacatcgcggcgcagtatggcaagccggtgctcgccacggggccactggtgccggagccaccgcgaaggcgagctggaggagaggttcgcgacgtggctctcctccttcccggacaaggccgtcgtcttcgccttggacaaatatagaataatctgcatggaaccatggacaaatatagaataatctgcatggcaaaaagtattgtttttggacatggtactcacatggtatttgttattgtaaacgatgctgatgccatggatcaagttctgcaagtaaatggagatcacaaccataatgcctttccttttaatctcaactttgatgccgatgaggaagacctacaaatacatccaggtaagtcatttaaccgacatgaatattagacttaaaaaaaatgataaaatgtggttttacccaaaggatcattgaagaataatattatttatctgaaaccatgttttaaattagaagttagtaatattatatcatgccaactacctacaatagtacgtctagccatgtcattggttgtattagttgcaataacaattaaggattgtaaattagacatttcagcacatagtaaatcacaaataataatgagattgaccaataaatacattgatatggtgtatttacatacaattgtcatgtcaattggttcactaccacagcaatctgaaagaaagcacataaactaaattgtgtcaatgtctctctgtcgcacttagatctaatatgtatggttaaatcatattacaaataaaaccacgtggtgaacctaaaaagttgtgccataattttgcaagaatgttgatacatgacaataaaatattaaaattctgaattgatacagatgactaaccttataattgttgttgtagacatgcaagagtacggcgtgtatgcgggtgatgtggaagttgttttcgaacaagaggagttggatgattcaggttaggaagatgaacatcaaaacaaaaatctgaccaaaatacaaagacaacatatatatgctgcatttgctggaaaaactaacaatggaaccctaagaaaaaaatgttacttcctccgtttcatattataagactttctagcattgtctatattcatatatatattaatgaatctagaaatatatatatatgcgcctggattcattaacatctatatgaatgtggacaatgctagaaagtcttataacctgaaacagaggtagtacaactgaagttacagcaatgtttaatgtgaaaagggctagagtgcaagctatttggcgaagagtgaagcaatgtcttgcccacggaataccaatcgatgtaaggtctaggaaaaaaaagaattgtggttgcaaaaagaatgaaatcaacatgacagatgttgctaatgttcccttgcaactaaggggcactttacggtcatttgcatcagcctctggtataccaaagagcatgttgcataggatgttgaaagaagtgctgctaagatgtcactcaaacacactaaagccattgttgaaggaagagaataaaccatcaaggctgcggtggtgtctttccatgttagattggcatactttgccaaatgaacccaagttcattgatatgcgaaacactgtacacatagataaaaaatggttcaatacaactaaaaggacaagaaccatttacatggtccattgggaggatgatccatacagacctgtccaaaacaaaaattctattgataaaatgatgttcttggcagcagttgctaggcctagatacaatgaagaaggtatctgcacttttgacggcaagataggcttgtggcctttcaccagaaaggtaccataacctcttcatatatgcatttttacttagtgattttatctaaattaattgttaatctaacttgattattgtactacttaggaaccaccgcaaaggacaagtcataatagaccaagggggactctagtcaccaagacaatcaaggttgatcgagataccgtaaggtcatttctaattgctaaactcctaccagctataatagcaagttggcctcgagaagaaacacacaacagtatatggatttagtaggataatgctccttctcatgtcctagtggatgatcctcgatttgcctatgcagtttcccaaaagggtttgacatccgactcatgcatcagcctcctaattccccatatatgaatgcactagatcttgggttttttgcgtctctacaatcattaacatatagaaggatatccaggaatatggatgacctaatagataatgctgagcatcaggcctatgatgagaacaagctaaatagggtgttcctaacattgcaatcttgcttgttagaggttatgaaagctaatggtggaaatggatacgagatccctcatatgggtaaagagaggctagagcgtctagacattctccctaatacccttagttgtggttttgagctatataataaggtaagaacagcattagccaaccaagtgcagtaaatcatgcaatatggtaaagcactatcctggtttcaacttttggttaaatgtcaggttgtatatatgataagttaagatcagtgttacgcaagtaaatgcaacaaaccatgtaatgtgagaagttttatgatggtttcagcttttgaaatatgtaatatgggaagtttatcatggtttcatattttgggcagttttcaggttgtatatatgacgatgtaatatcagcattaggagtaaatcatgtcatgtgggaagctgtatcattcttgagtttcataagcattgcatgcatcatcgtcatattgtttgtaatgttagaaacatcatattaatttcatttaccacaataaacgatcatattttaaaataattttgcaggataccattcatcaccactcatgtactaccataattacacatgcttccatatacaataccaaaagtccaaacacttcaagatactatgttaggccatcattcataaccaccaaaccagcataaaagcaacacataatttaatcattcatctaaattttgtgctcttaaaacattccggaaaattctttaccgatttttccaacgcatcttggtcttgcatgagttcttctaggccgctatgattgtatagatcttgtgcatatcccccaatgaccatgccaacatcatcgtcgctatccttcatctccttggtgctcccctcctcactaatcacatccttagcttttccactcatatcctcaatgttgatttgcccgatgagtgccttctcaataggagcttgtggtcgctatcgtcttccaatattgtcctggaaaggataaaacacagtaccaatacaagatgggatcagttgttagagacatgaaccttgtcacacttgaaaattcactagtaatttctgaactaatttgtgcataaaatccttgtccaggaatcagccgaggtacacaaactgacaatttaatatacaaatccgtcataataataatattacatacttacaaaagaaaagaaaaacaacagcggattaacggtctagcgaagctccggctccactcccataagcagctcaactgaggtataagctaaatgtctgctccttttagatcctttttcttcaactaaggtttgattaattattgcaaggtgagtacatggaatactccgcaagacacacagcaaatatgcaagtgcaaaaatataccaaaggatggcataatataggctcatttgcaaaagcagcatttagcaaacatttaagaattgtaaaacagtagagtaattaatcatcaatattaatcaacactgaatagcacacccatgctgcacaggcccaaccaaaccttgacaaccaaccctggtcgtacagatcaaacctccaaactaggaataagccattccaaaccagaagccaaattaattatcacattattatcattaatgagtagtgtgggactaatcacgaaaaacattgctcaacttgcccatgaccacgggcatagctattcgaatagttttactctggccagagatgtactactgtacccacaagacacaacccattgtcatgtcaccgtgtccgcgcagacacgtcaccatggcgagtgattgtgacaagacccctcgcataactcaactcaaagcaacgcacctttcctggatcataatcacctcctcaataaccagaggcatgaactccccagcgacccccacggacttctcgccgcttcacagtctggtgcaccacggtgagccttgctacacaaagtgtccagccgttgcccatgctagcttgtggttggcacggttaatgtctcacaacagtagctcgcgaaccggtccttgtcatgagcacaaccatcaaaaccatatgcttacaactcaccattaatcaagttttagttgacaagtaattaataaccaatcacgattgaccatcgtgagctaccattaaatatccatcattaagtaatagtgaaacattaatcatcccaatcatgtgctaatgtttctaagcatggctaagcaattatactaatatctagtcgaaccaatatataaagtccaactagtcaaattatagcccaaggtatcaagaaataggataatcaatgaaaattggccatagcaaaggtataagttcacaccacccgatgacattcgaaattaaatgcacagttgaaataaataaagaatttaaatataggatcaacttgccttgcaataatcggtcttcaattagtcttattgaacacttccaacgcactcacgaaccttcgcaacgacggaaacgacaagctaacacgcaaaatgaggaaaaggactaataaaaaccaaataaacagtacataaaaagtaaacaaacatgtagatcatgattttagatgaatttaaagacttgaacggcctcattctgacttcatatgaattagtcataaattttacaggatttaattcaattaaacctatttaaaaaagattaaataaatttataacacaatttatatataattttaatatatagatctttattttatacacttttgcaacttgaaacacattaatctgatttacaatgaattagaaatggattttttaagattaatctgattttaaccttatacagaaaaggatttatgatttatgacacaattaagatttatttttagaagggaaaaggggctttatgacgtcagcatgacatcatcaccggctgcggcttgggacatcatggtcgccagcgaatttggcagagaggcgcagcggctcggactcggccgagcggctggaggaaggagaagaccccgacatgtgggccccatatgtcggcggctgagagagaggaggaggggcggcttggcctgggctgacttgggccgagcgcacgtgaccggggataagagagggaaggctgggccgactttcggcccaaagccaaaagggagattttaaaaaccttttctatttaaatttattcatggaatgcaattccatttattaaaaatacttccttggctcaaataaatcccaaaaaatccagaaactaaagaaacaagagaaatatttaccaaagttttatctagaccatttttacattgagatttattaaactaaacttagagcttttcttttaggattttaagatcatttataataactcaatttataatttaaggatttttaaacaaccaaaacatttaacaaaattacatatagatcatttaatgattagtttattgattaactaattactgaaaaaatctttgtattattaaaattagtaattgagctctgaaaaaatccgagaaaattccagatagtataattaattatggagaatttaataaaaattaaatccagtcatgctttatatttagggaattttatttcccacatttaacttcacttgtaaattaatgaacatttaatataaattctaatgataatttattaaataatttataaatcctaaaacgaaaatcagatgcgacagacccccaacatataaataaagtatttcgatttgtgatgtaaaggtgaatctatcaccgaatcaatcaatgtctaaaatgtagtaaagaccaaagggactgatcatggcaatgatagctaaaaatcagagtacatcagtgtgtgtgtatatatatatatgagtaaattccctgtgtacccctgaaaactcactcagtccctttcgtacccctgaaatttacccgatctcttctatacccctgaaattttaacttgatcccttccatgcccctaccgttacattttccattatttcactattacatttggttgcaaatgtctttttttgcccttgatgctataggtttgaatataagcttaaaagcgattgaaaattttgtttgagtgcacagtacgtgcattttatgaaactaatgagactaaataattagtgcagaaaattttgacataaattttggaaataaaaaaggtaataaattaaaatttttatttgaaattttaataggacaatgattttttttgatcgggagcattcataaaaaaattattatgaaaattggttgtcctatctttgtatgaatgatccttttttttattactttttttaaaaataaatacacaattttttatttcattatctaaaaatattttttgggataaataatgcatcgcacaacaaactcatagctataatagtctcgtgtgagaagcttttacatttttaataatgtaattcataaatttctatgttcatccaaagggtaaaatggtcatttttatagaaattagacggtcaactaacaatcaactgacgggaggggtatgcaagggatcaaaatcaacttttaggggtatataagaaagtaagcaaaattcagaggcatagaagggattagttaaaatttcaagggtagtacaagggattttctctatatatatatatatatatatatatatatatatatatatatatatatatatatatatatatatatatatatatatatgtgtgtgtgtgtgtgtgtgtgtcctagttaatggatcagagccagggacttgtattataaccttcgaaaaagagttgcgctcaataaatgttaagcatccatgctatttctcgtataacaacagcaagattatctagttaattttttttgcggggattatctagttaagaatggcaatatatgaaaaagctactcctaactattcgtgggtgcagttggactgttggagcaagctgaagctgttcagggcaaggtttcagaactccttactgattattctactcttactgttactagtagttttaaaataaacaggtcaagcaagcaacagccgctagctagttagctgcagccagcaggggtcccaaattaatcatgtcatgtcatgcacgagggaacaaaacaagtgtgacaggctgcattcatggacaccagtatactcctgtaaattagtttcagctcaactgaaaaagagagggcaacatggtatagtgacctacaaaaatgaggggtgaagtgaacccaaagaccgcccataggccacaacttaactaatatttgtggacatagagagtattatggattatcgaggtaagctttgtaagttacaatcttcccatgaattctttgcctacaatcagtcattttttttagaaaaaaaaacttatcaatcttctaatattttttcagagacccttctaatatttaactccacctactttctactttcttaatactttctaatatcaattatctcaataaattggtagaaactcaacatatataattaatcgacaccggaaacatagattgctttaaacatatataattaatcccatattaacattgcaggagattatatatactcgtaattatatgcaagataatacaatatttgatggaacatgaatgttgaaataactgctataaagaaagcatgccaaccggcacgctaatgttctagtacttactatacctaacagttattttcatacaaaaaattaggtatgcaaccacccgccgtgcatatgtgctacatccaccattgaaagcaagtttcaatgccattcaaagcagttttcattgcatgaaaagaacgtattggt

SEQ ID NO: 18695 - DNA, 7880 bp, Oryza sativa
tacatggtttaaggtaacatctccaaaggggttggagaataacatctgttatgcttcaacgtcttgtcctaccatggagatgttattctcaacagaagcaggcgctgcggcggtcaggtttgcaggtagcttgggcagcagcaagccagcaacagcaggcaacggtgacgggttgggccgacggtagcagcaagcggttgtgccttgcggcttggatgacagcaacaacaggcggtttgggcggcaatggcggcagcattaacaggctgtttgggcagcagcaacaaagccaacacatactacatcactagcagcaggaactgctaggaagattttgtgacctcgtagcaatgttctgttgtgtagtcagggttgtcaattgcaagattttgaatgaatcatatgatgtgttaatctttcaatttcatgggaaggggtattcttgtcctaattttcataaaaaccaatcttctaatggtgtttatctaaactgtcagtccaatagcaagtatattgaattccaaccattttgatggcaaatatgcaattacactttttacagtggcaaatccacgataccggttcaaactagtggcaaatatgcaattggcccttttttccttccatttccggtaattctggtcagaatatctccttcatcgatatatatcctctacgtctctttgatagatgacatcattggcatcgccataacattcgccgtattcaaaatatataaataccacttattttgttgtgacgtgttttatcattaaataaactttacactttagcatatttatattaattttttaataaaacaaataatcaaatgttactttcgccagtttatattaagaaactagacaacataattgactttcgccagttttaccatttgccgtattcaaaatatttatataaatatctcttattttgttgtgacatattttatcattaaataaacttttaaatatgatttacactttaccgtatttatattttttaataaaacgaacagccaaacattatttttcaaaaccaacgttgtcatctactattaaaataattaatacagagctagtataaggcaaacttcttaccttctttttttaaaaaaaaataaagaacaaattctgaattatgactgtagcgactaaaccgcggacggcttgacacgagcagatgattcacttgagcattatgctttgttcgttcctgggagacctgggagattgagagagaacatctcgttttccacgcacacgtttcccaatatactaaaccgtgtatttttttgaaaaaaaatctataggaaagttactttaaaaaataatattaatctatttttaaaatttaaaatagttaatactcaactaatcatgcgttaatggtctcaatcctcttatctcctctcaaacgctcatatatgggaggaagtgtgaatggaagtgtcatatagttgactcacccactagatctcattgccaatagtgatactacatactactatattacataatacgttaaaacggtcaatgagaataccgaaaatactttaaatcggtctactactatactttattgtggaaaaaatcggatgctacttatactttatgtgttctatttttttctcttcacacctacagcctagtgtgtgcttctgctcacacgtgcaacctaccatgtgccttatgtgtaataaaggataaagttttattaccaagttttaaatactttttttcttttaaattactcatcttttcttgaatctatttataccatcgtactaattacaattaaacttcataacaagatctaacatgattatatcgtcaaaataatatatatgtttcgaccgttcaaattcgatgtttcacgtgtgaaaagaaaagagaatctttcagttggaatccaaatatgttgcacattgaatgttttagttggaatccaaatatgttggacatttttaatttttcatgttataatcaatttttatctattgttgtacgtggtgttatgtggatgtgacttattttgatattttgttgattcatttgttaatgttgcaccttgtattatttggatgtttcagtaaatattaagtgatgtttcaatcgttacaccccgatgtttcatatagtatataaaaatgtttcaattaacaatattatcaattgttctcataatatggtcatgcttataaagatttaaattgaagggtgaaaatgaataaaacggcgtaatcggattgtagattgtatcaatcatttagaaaactagatttaaaaaaaaagtttgcatagaagtgaggcaacccgacccatgagaggagagaaaaatacaagctgcagagaatcataccccgatccgtagttatctcctgagaatactaatgtccacgaaacaacaacccaaattcaacctaacactatttaggaaagacagtcaataagcaacgagatgccatgcagcccaggcaaaaaggcgaagagacgctacggcaaagagatgatatttgacccatgccatttgagatcagatcgtaactccaccactccaccgggctaaggtcgcacaaaaaatatgacatacttttcagcaaagcatttcactgcagattgatagtattaattaatgcagataacaggttcagtagttctgaccacatcagttctttttttcctggatagaacttaaccatttaaccaactaaacgtgcacatgaacccccatcggactccaaaatacttacaaccagcacgacatataaaagcagagcatacgtagatacggagtaaggatctaagcaccaagacatcagaggccttgatgccttctactcaaaagcccactggttctccctgcggatctcctcttcctcctcaggggtgaagtcgttcttgatgttgaaggtcttgcggatctcctcaggagtcttccccttgatcatgtcagcaacagtctggcaagtaaggtccagcaaccccttgatgttgaggtagttcgcggcctgtgggatttgagaatcaaataaacatggtataagaagcagtaatcactatggctaaagcacagatcaacattcagccacaaaaggaatacatagttcaactttggaatataaaagaaagcataaatgtagaaatgagaacactatgaactgaaacaaattactttagcacatgattgtgtagcaaatccaaattaaaatgcagaaatactagaaatgggtacatgacaccgtgggatgagaaacaaacaacaaagttagaaataacagatatatgtaaaaacttcaagaaaaaaggcgagtgtgtagcaaatccaaattgaaatgcagaaatactagaaataggtacgtgacaccgtgggatgagaaacaaacaacaaagttagatccgcaatagtggagtacacaaataaaacagtgcatgtgaacaaatacggcattttacaaaaaagaaaaaaaaaaggaccctccatagaaagaagttggtatacaaacacttgagcaacaagttaaaacatgatacattttgttttgcaataatttaacatgcactgataccccataacccgtctcattgtaaaattgcagtgttgttaatagtccaccaccatcaagcaacttaatttagatagtaaattcttgtgacaatcaaagaaaaaaatgagactgccatcatttctcttagatcaagagaagtgttaacaattcatgaaaaaagagcagaaagaataaatgaacaaaataacagaactgtttacaattcatgaacaagagcagagagaatttatgaccccaaactgtagtatgcaatgaattgatcaagagaagaacgaatttgtgatcacaaactgtagtatgcaatgaatttattactggatatcaaagaaatatcacagtgaagatacagagacacaattactcaatgcctgaaacatcataaattagagatacagaacaagtactaaatcccttaagataatgcttcaccattttagcaatacagtagtcaatcatacataaaagatgcatcacaagactacatcaatgtaagatcattatctgtaacagccctaatttccttatgaacataatcataaggaggctgcatcaatgtaaggacataacaaaagcaattgacttatgaacaggaaagaaaaacattacaatcagaagggagagaatttattacaacatagaactacaaacatatatcatgcttgatatatgaatctcaaattcttaccaacacgaaaggaaataatgtataacaacaaacagaagggaacaaatttaaagcttgacctaatctaccaaattggcaagcatgcatctaaacaatcaatttcatactatatcatgcttgttatatagagaagcacaaaatccttatgaacagggaaggaattgtgtaacagttaacaacaaaacagaaggggacgagtttattacaacatggcactagaaacatatttcatacttcaaatatatacaatcgcaaaactgcatagctctttatgtatttctttaactaaatgttgtatttaataaaaacccatggtagcaatacatcaaccgatcataccaaaaaatctgcagaatatcaattaccacatctacgcagtcctgatttacataattaccagtatgaaacaaacaaatagcagggcacatttatccaatcatatggatacaatcatcgaccatacagatgaggatacagaatcataccgttaccccatctgcacaaagtacacttgttttccctaatgatattcacgcaaccatgatttccacaactgacatgaatgaatgcgtgatgcatggaaaccacatccaacccagtaacaaacataccggatgaaatacatcccaaaaagcttggaacagaatgcacctcgagctattgaccaagaaaacaaatccagatctagcaataaccgcagatctgaatccccatcaagaaaaggtaggggcgcgatgggggagggagaggggggggcttttataccaggatgaggtcgaagagggtggcctggtcgaccttgacgaagtcggcgtcccagttcttgaggtcctcgccggagggcggcggcacggctgcggcggcggacgcggcgtcgtctgcggccttggaggccgcggcggccgcggcgtgcacgtgcttgttgcagtactcgatgaccttggagaggatcttggagttgacgttggggagcgggatgccgttgtcggcgcagtcgtcctcgatcatgtggcggatcgtctgcgactccatcgccaccgcctcctccacctagaactcctccccgtcggagctcttcagggtgatcatcttcttctctccctcagccgccatcgatcgagccctccgaaatcgctcgcggtctcggtcgtcgccgaggaggtgaatcgcacgaaaccctagctttcgcagcggcggcgatggggattgcggcgagattgggggttggattgggggtgggtggggaggtgggggatattattatataggagaaatgggagggcgagggctgcgtggggacacgtggagggcggaggagccgtcggatgcggaggtgtggacggccacgattgggtgtgatggtccgggccgcacgctgggtggggccggccgagcccatagaatccgttgccgaataaaagaagaagaagggaaataataccactctatttgtacttggaataggaataatagactccgtttgatattgtgctttttttttgtacgttttactagggttgggcaaatattccccttttttttaacctctatataggctggagatgggtggaattattgcatgaaaattataccggtaaaattgtgttacggaaatatgggacaatagggccagaaatggtaagtaatagaatttgttttcatattgtttattaattgagtaaataatgaaaattattataattacatattattctctttagtgataataaaatatttgatatttagaataggttagggcgaacttttaaggcttatgttatcaataacttctcaaagtgcatagttcttaaaaaaaatggtataagcatattatattaaaaaatattaaataacattaaaaattattagatgtaatatgaattgatggccaaatttcaaaactttgatgatatcttcgtaccatcaaatatttatgaccatagagagtacaacttaaaagattaagggtttgttcagtttgatgctagaattaacctttcaacaccaaaatttggtaggattgaagtgtgtgggttttacttggtttgctaccaatgccaaatattcttatatattgttatgtgcaaaagtttctagaaaatcaccaattttttaggatggtaagatatggtagattatttggatgtcttcagagtatatagcttagtggatgctacgtaacataaataataagtacttttatagcatagtacttgcaattagaggggaaatttcaaatccatcatccatatagacaattatggtttgttaagatagccaaatctgcattaaataagtgggggaaaagaattattacctgctgcgaagttcagaacaggcttctcttctcccttcatataggtctccttgatcattcattaggcatcgattaaatcacgtactgcgctgttgggctagggcagagaaatgacaggaaatatgctaggttggcgccaatacttcacgcctagcgacgatgcggagagcacagagaagtgcatcctcattgtggaaatagggaatgaggtcatgtaaccggtggcaggaggagagcaaagaaatatgggttgtaggatacaacatgcccccaacggtagggttttatgtaaaaaatgcttagccagtagttttgtgataggtgtgcctatttactcttgagaataagaatatggggattgtgtcaatgaccaattagcacaattttgagtaggtcctctcccaaagatccattttttatgtgtgttaagctaaaacaatataatcacgatattattacaaaattttgctaacatgcttttatcatacaaattgttcatatgttcccgtgcgaggcaagaaaagaagatatggggtcgagcaccacttaaggctgcgttcgagagaaaaggttgggaacttctctttcatacacggaaaatgaggtggctcattagcacatgattaactaagttttaacttaaataaacttgaaaccggattaatataagttttcaaaaacaatttcacttaagtttttattttgcaaaaaagttgcattgttcagtagttcggaaaacgtgctacggaaaatgagatattagaagatggaaacttgtagttccgaacgcaaaccttaggcaatgtctggcattgcattttggtaactaatcctccaagcaaaacagaaggactcattagcacaagtttaattaactaaacaaacttgaaaatagattaatatgattttttaaagcaactttcctaatttttttaatagtttagcaatttgaaaaatgtgcacacgaaaaacgaggaaacataagttaggaaaaggagtatagcacgcaagtatatgacatgtttaaggaaattcagtcatttaaaactcaatatcaaattacatttttaaaaaactcaagaatgaatagttatgttttggttggttcggtccggtctttagtcataaccgaaatgtgtggtagtaaaattgtagcaacttttctctctgcagaacatatatgttgacaattaaatagcacatataacacatcaactcatcaagagcatcaatcatagtaatctagtatacttaaacaattgatccccactaactgtaatcaataccaattctttgttctctggtgt

SEQ ID NO: 18696 - DNA, 1766 bp, Oryza sativa
  unsure (1)..(1766): unsure at all n locations
nnnnnnnnnnnnnnnnnnnnnnnnnnnnnnnnnnnnnnnnnnnnnnnnnnnnnnntgttaatgtttttctccccatttgagattgctcgtgggtgtttttctttggcaaattggttgcttgattttattttgtgcggttactcattttgcttaagtgcaacacactctatcaagtaggtttacattttggtacgaacatttgggtctgtcccatgcaattcattttaattttgaatttactatatttttcaaccattcttacatgtttacaacggtcaacgatattattatggtagtttgccttttaccgcattaatggctaatgcactaaactttgacagggaattttttgtttaatctgtaatgatgtggatatgaaaaggatatatgaaaggacaagaatcagctagccctaacgaagaacatgggttatatagatcacagatttgttatccacaatcaattttgtttctttggtacggagtatgttttttcatttagtgtacaatattgagtgttgtggagcataattaatatttttccatatgttcatcctatagtgccgcagcaacacacatggcttttgactagatttaacttacaacttaacaccgatcaagatacataattaggtctatttcctaatgtcaattaatcgagagtgctaaccgaattataaccaaattaatttcggttggttgaagagcctaacaaaaatttctgtctatgagcaagttttatagaagaggcaaatgccacccctaattttatccatgtaagttaagttgtaactcctactctctcttttcttctcccctccaccttaccatattagtttagatagcatattacttgctctaataagagcatctccaacaaaattggctatttttgtggaagagggtattaacctgtaggctgtaggagtcggtgtggattgggcgacgatggcagggctcttgatgacggtggaaaccggagagacgacggtagcatcgagcgcttgatccggggccaacaactttcagtctggggatggcggcggccacaacagtggacgatggcgcggcgatggacaaggggcgtagcagatagacgccggtggcggcgcgcaatagggtcatgcgttggatctaggaagggggcgatggccgtgcgctcaatcgcacactagatctgggaagggggtggtggcctcgtgctcgatctaggagcgcagggagggtgctcgatctgggatggaaagacaatacatacaggaaaggagaaaggggaaaatgtgtggggcccatgcgtggtaagacaactttgtcattttggttggccaactttagctaacgcatagaggactttggccagtcggatggttttcatccggttggcaagtttgttggattaggattttgattcaaaaatatcaaaatttaatttgaagaatgagatagccactctgttggcttcaagttttaacctttatttttttcacaccgcggccacaccgcgtccgcaatgcctccatttcttcctccaactcaaataacccaataatacatatagtccccagcccagcctgctccatccgaaggcccaaccccgctcgcgccagatccccccaaacccaatcgatccccatcgatcaccgcgctccccccggcgccgccgcggcgagaggtagggtttgctcgacgacgcgagggggagcgaccaccgcccgcgacccgataggagggatggcggcggccgagggcgagaagaagatgaccagt

SEQ ID NO: 18697 - DNA, 18452 bp, Oryza sativa
  unsure (1)..(18452): unsure at all n locations
nnnnnnnnnnnnnnnnnnnnnnnnnnnnnnnnnnnnnnnnnnnnnnnnnnnnnnnttggcttcaagttttaacctttatttttttcacaccgcggccacaccgcgtccgcaatgcctccatttcttcctccaactcaaataacccaataatacatatagtccccagcccagcctgctccatccgaaggcccaaccccgctcgcgccagatccccccaaacccaatcgatccccatcgatcaccgcgctccccccggcgccgccgcggcgagaggtagggtttgctcgacgacgcgagggggagcgaccaccgcccgcgacccgataggagggatggcggcggccgagggcgagaagaagatgaccagttttatcgcgaagagctccggcgccgaggagttcgaggcgggggccatccgccgcgcgatcgaggacgactgcgacgacgacgacagcggcatcctgccccccgacgtcctctccggcgagggcctcgataaccgcgacgccggcttcccggtaaagcctccccccccttccccctccccattcgtgcccttctcctcgaatccgaagggattcggattccctttcccatcccaaattcgtgcctcccttctcgaagggattcacagatcttgctggaatagttgcagtcaggtttacgtaatagctcgaggtgcattctcttcgcagcgcagggatgactagaaagagggtgggggttcggttgagttctgtggaaaccaagaccaatttcagggaactgatataactggatttttccccccattttggatgaaactatgctaattgaattcttcgactgaaagatgccctgttggggggaacactatattgagatggtttacatgtgtcatggattcttgctagttctgaaaattgcagttcaatattctttgtattaaaagaaggtgaaagaagaagcatagaatgggaggatcagctttgaagaactgaccagaaaagagtcaacaaccagaaaaggaaagggagaaaaattaagaacgctgctatacatacgacgctagcgttagactgatgtccgactccgttacggcatcacctgcgcatgtcagattctatcacggagtgagacatttgccgtctgagcctttcattgtggccatggtcgtacacagtagccggacaacaaggtcatacgtatatcattttcaaaaaaggaaaccaggctaaatctcgtgacagtgattactgataagacaacctaagaaacttaatcaagggattacaacatcctgaaacaccactcaggatagatagatttaagagtttagccccatgggcgatttacatgcataatgctagaaaagagtgatctaattctatggattgttgcaatgcattatcatttctgtatctacattttgaagaatatttgctacctacacgttattgttatctcatcacaagtcacatatgcaatactcctgcttgtgtagtgttaggagtaggttaccaaatgcataaaaaacgttattaacaagtgagctgtgcattttaagttcatatcaaagtatcaaacatttatgcctgtttgtatccctgctttgagctatgcatgcttttcaatggtttaattttgtttttgatgaatcttataatgccctgtttatttgattctgaaatctcacagccttcacaaagaagcgcctccaagatcacgggagatcgcgcggcggtgaacccggcagccgctgatccaccaatgcccgttccagggttgccccatcatcctaacatccccgctgcaaaccgccagctccctcctgccgctagactactgatcaactgtggcatcttcctcgtcgccactgccgggtcctccatagttttccacactgctggagacccttccgccatcgacggtcctgcatatgcccttgttgcattcttcttcgtcctcctcggcttgtggtttgtgctgcttggacccgtcgccggccagttccctggagccacgagggtcgccgttgccattgcgaaagcgctcaagggttacctgctcgccggcggcaattgatcaaatatttgattcattctttatataggtatagctttgctagctcacagtagttttctgtttgtttgtatgtcgtgtctataggcgttgtagcccataaactcactgtaaagtgtgaagtgtatatacgtgttcttgtaaggccctgtttctttcagcttaggattattataatctagattattgagttagattactataagctagattgctataatctatagtagaataagcggttagttgtttctttcctagcttattagagcctagattattgggtttttaagtctaaatagggagtggggtggcatggtggataatttttcacccaataatctggaaaaagcttacctaaatgagcttatcagattataataagctgggctctagattataataagctacttcaataagttgtttgtttctttcagcctactctcaataatctagattataataatcctaagttgaaagaaatagggcctaattacatctgtacatgtctgctctgttcaatccgacgttttgataaatattagcttttctgtttctcttttaatgttcggtttcaattatggatacacacagttatttaaaattggtaaagatcgctttaacgtacatgtgtctcgaaagggtaagagtgataactgattatgtcaagaaaaaagttgaaaagagagatgatgctaccaatggtttctctccaaagggtaatactgattatgacagtaacttgatccatctgtagattgcatcaagagctcaggcctgaccttcaattcaatttgtgattggacaatttgaaagggggatcttcggttttaaatcatgaaattctcacaattgttggttcctggttgatttgtgatgtagggcaagaggactaggaatgatggtgttagtccttctcacaagtttattgcaatcataaggaaagttattttcccctcaaaacaaaaaggaaataattttgatttgattggaagaagtataagcccaaaagaagataacccaataagttctttacagcaacacaatatatattcttttttaaaaaattatcgagtctgttgaaattagattaggactggagttttcgtgtgaaatctatcgagtgaggaaaaaagaggaccggtatcgccagtgtgccaccattgatttcaatggatcttaccaggcctaatctaattccaagaatttctttgatttcgatcgccagtcaatagaatataggagtagtaggaatgatcatagtcttgcaagcacaactgttttacccatatcttcacactagtaaaccattgctttaaaatccgaaccactccgctccacacagtaaaataaactatgaaaccaaaagctaacaaactcagcatttttaattctcatctgctacttcttataatatcaagttctcaagttcaccacataggaccaatattattatgaatctactccctccatctttaaatacaattgttttttacaatttaaatttgtccaaagctaccttttaccatctcaaccaatcacaaccatgtaccacttcactatacttgttttcttaatctccatatatacctctaaagatagctatactttgggatggagaaaatagggaaatgtctcctagatcatatatctactaattctttagaggaaaatttgcaaaactcaccccataaaattacttgaagttttacgttcccccacataaatcatttgttgcaaaaacctccctaatatacacatatttaaccgaatcaatttgttttcataaattgtgagcagttaacgtgatcttaatcaaagctaaggctgtgttcggcactacactttcctaaattctactccctcattatccatgcacacgctttccgaactaataaatgatacatttttttaccaaaaaaaatcgtataagaaagttgcttttcaagttttcattaaatcactttttaagttttcaagctaatacttaattaatcatatgctaatctaccactccgtttatgagctggggaaagtttcctaccccaagagaaaacaacctaaatacttttaggtactgtttggctaatgggataaggaaatgatttcccactcaccaaaagacatctttaaatcataaccattcattctctctcttccatttaatcctaacccttcatttattttctaatcccaatctcccctttatttcccattatctaaacacacccttaggagtataatcttgactttatttttttttgagattccataaataaaattgttgatgagagattaaacaatgtcgcacttatttttgctatgtacggtaaaaaaatcgatgaaatataaagaataaatcaaatacaagtacctcgataagattgactcagctagcttagtctgggggtacctctacagtagcaataatagctgatttggttaagccagtgcgcactgggtggttgttacatcaaaactaagtggagtggtgggcatttgaaaaataaataaattacaggatggaatgccaaactgatggtctttataactttccatcattgaaaattttgaaccgtgtgttcaaaccaagtagagtggtgggtatttataacaaagtaagggtgtgtttagttcacgccaaaattagaagtttggttgaaattggaacgatgtgatgaaaaagttagaagtttatatgtgtagaaaagttttgatgtgatataaaagttggaagtttgaagaaaaagtttgtaactaaacaaggcataaattacatggtggaatgtaaaactgatggtttttatagctttttccatccttcaaaaagtttgtgccgtgtgtttggatttctcccacaagggctctcgtgtcaaaatgtgccgtgccagtgtgtgggggcagggggtaggcaggccacacccacaccaccgagtagagcgagtgtacagccaccacgcgtgtccacccctcgcacgagagtctctccaccactcgtcgccgactcgtgcgagcgagagagaagccgctgactgcaccgcaccgcaccgcaccgcacgcaccccaaacgctatccaactcttatccccttcgatcccccctcaaccacggcatgggggccttccgcccccgcgccgccgccgcctccgccgcagtcgcccgcccggtcgccgtacgccgaggcggcgtctcctcctcatcccgctggaagctgcaggtcccccccccccacctcccgcctctctacgttctcggttcctctcttgcccgtgatgtgtaaatccactaggggggatgcgtggagtctcgtggttcctgccttcattgatcgttggtgttcatggcggatgatgattatgatgatgatgacgtggtattttatatttaggggcggtgctttgcataccggagtgattgatttgagatgaggtgtagcaaacgacctcctgcgctgcaattcttcccactcttgtttttggaagttaggagctttggttacgacgtacctgtactgcctaaatgagaggttttacttctcaagtaggctgtttcaaactggattcgagctctttacttaaactgagatgtgtgaaaggagataaatttctaatgtctgtttctattaagttttagtgtttccttgttactgctcaatagtagtcttagtttttatagctttagagtgtatgtttatgtgaagtaaaacttatactttagtttctcttttttttttatttgtcagttgtcgtctttcttctatcagtatcctatccactgcaccgtcaaaattgttttccagacaagatatttcaaaaattcactagtccacagccacaacatgcatctttgattcttaccgaatttagtctgatttattcatgccctctgcattagtttaatctagttgttgcatcattgatttgtgcgtgtgtttcgcctagaatattgtcataacaattgctgccctatcaactttgcaacacagggaagtatgttgaattggaaatctaaatgcagtaccagaagtccacggactacagttgctggtgcaaagcctgatgactctgaatttgaaagtgtcaatgcaccactcgagccccaaacgtgggaatcccgcttcttgtgtggtttgttgaagaaccagccacaagtactcccagttgctgcggcaaagcaacttcaagaactatctaatcaaagaaaggacaccttgatccgctgggaacatagcatcggttctcctgaggactgccttcacaggttagttacaaatgccctttgtcaaaagtgtttagtggtctcaggaggtcgacatgctgctatccttattttttccccattcaagttctctgttatatttcaagcgtaaattgtattaattaattattaaacagacaacgttgcacttttgtgatagaataaaaaacagcattcacttagaatggcattttattttgttgtgctgatgaagaacaaccaattaggtgatacctcttcagtccataagctacctgttatttggacatatatgttggattagaaaatttctcaactaattacagaaataaaatataggttgggttaatgaaatcatgtgaatattgtagattgcaagtgaggcttgaaattataaaagctagcttcaatggttaaatgatgggagacaacctggagctctaacgtcatttctagtctttttaatatgaatcatataggagcgtcacttataatatactagtaaatctacatggaagaatatggagggtcaggtctttctttaatccattctagttgatactgcatcgatatttttgagtcacaagcttcattgttaaaaacttaaaatttaccaaatcatttcatgtagctagcataattgtcactgcaggtgatctatattcggcactaaaaagtctatattgtttgctccttttatctttatattgtatttgcatctgaatattaattgatttgttgggacttctacaaataggaggattgctgaaatgaaggagcatgagtgccagactgctattgaggatatcatgtacactttgattgtttataaatttttcaagattgaagttccattggttccaaatctatcaaagcttatcagcaataaaagactacaaatatggccaccaagggaggcagaactagaatcaattcatggacctgaggtgctaggtttaattagggaacacttgaccagtattatcagatgggtacatagaaatggtcccaagatcaatcgctcaacacttagaatcaaaagaatgcaatttagtcggatttattctgcttcaataatgtacggatactttctgaaatctgtcactacaaggcatcgtttggagctgattcttgctcagtcacaagaattttgcccaccaattcagtttctgaatgcacaatttaatagcacccagaaacaagaacaggaagagtccattggaggttctgcagaaatatcatcttcctcaaaaccgagttctgttgttgatctgcatgacttgaagagttacatgatgggctttgatccaaagaccttggagttatgcgcaaggctgcgctcatgcgaagcttctaatctcattgagaagcacagttgggcactgttcagagaaagcatgaaagatttcctagagcctgatgaggcagtgatactcgatccgtcatccctaaagagattgttgcttgaagccattgcatttggttcctttctttgggatgttgaggattatgttgacgagatttacaagttgcatgatagctgaaaaaagtacatgcaggaaactcctgatgccttgtaaatattcttgaatcttgtatatatgattagatatttagcttcttatgcatgtaaatcttcctgtcaaaattttgctatttctagcatcccagattgccagggtgctgaatgactgccgtaatttgctactcctataaaggttttggtacgatttctggagccaggtacacctcgtacttgtaatttgtgtttttttctccaggaattcctaactgccgctattcattttttacatacggagtatagtttgcagtcttttacataagtactactgtaaaactgaagcttaactcgatgtaatcgtttgaaagcttgaaacatttaatactactaccatgttgtgactctcagagcacctgataacttcagtagtgtttggattggacccagaaaatatggaactgactgaactcatgcccagaattacaccaagcagcatcactgctggcaattggacaattttctcatttgtgaccacatgagcgacagagactcgtgatggcgtatgagagaaggatgctctgctgctcccctggtaaccactgattagcaaatggatggtccagatctgagccaccatgaaccccaccacccctatggttcaatcattcaacaaaattgcacaaaaccaagaatctcaaatgagtttccaaacatgttcagagctccccaaagtccaaattaatgtgtcaaatgagcttcacaataaagaaagaaagaaatcgaccatgaatttttccaaacatgttcagaactccccaagatccaaaaccaatggtaaatctgaacttatttaggctgcgttcgtttctccaacaagagttggatgaaattttggatactcatggcacgttttttaaattgctaaatggtgcgtttcgtgggaaaattatatatatataaaaattgctctaaaatattagattaatatatttttcaagtttgtaataattaaaacttaattaatcacacgttattatcacctcgttttgcgtaaaacacttaatctttatctttatctacagagattcaaacaccaccttaggtgatgttcttttctcctgaagatgaagattaagttttttacgcaaaacgatgtggtattaacgtatgattgattgaattttaattatcacaaactttaaaaatagattaatataatattttagagcaacttttaatataaagctttcgtatgaaacgcaccatttaatagtttttaaaaatatgtcacaaaaatcttaattttcatccaattgaagaaaagaacgggacctggtaaacctgggccactctccttcgatatttgctcctccattgaacagctccagaaaggacacaatggcaggtgcctacaactggctgtctggcactgcattgaatgcacctcctcactcactctcacacacacacacacacaagagaggctctgcctctgcctcctcctccatcaaggaaggagtacatcacaggatacagatccagactccagagccccatagagagagaaaattcagctactcctagatgagaccctgagtgagagaagaagcaaagaaacaacaacaagaagaaagagagatctccctcttccatcaacaatgccaccaccatcaatcaccaccaccaccaccaagctgttcttgctcctcctcctcctccatggaggccactgcctgaagagcttggacatggccatggagatggagatggattcagaggctcacagcaggatgctgtgggagtccagcagcagcaacggcaggaggtacatcagctacgacgccctgaggagcgacgtggtgccgtgctcgaggcagggtgtcccttactataactgcaggatcatgaccaccgccaacccttacacccggggatgcgagaccatcaccaggtgcagggatgtggatccgtgattactactgcactgcctgcttgttttgctggatgatcttgccatgagaggaattgcaggagtggctacctgagatgcaaatcttggtttttattttttttttgtttttcttttaccctctcttctgttctttcttcttctttatgttctgcatttgctgaatcattgtaggtgattcatggatgatttacatgttcaaagatcttatgagtatgtatatgtaagatctggttgcaagctataatattataaggaagcttggatcaggggaggtgtgctgctttgtgcttgaaattgtcggcattgataagatttgatgccatcaattgacatggaaattgctccttttcttcgtttgtacaattgtactggtatgttaaagttggtatacgcaattgagcacgttgaatcttttcggatgctcatcgtttcttcaattttttttaatagctagtcgtgtgatgaaacctggttcgttcttgtttaataaagatattgctttgcagtgttttcaggggaaaaagactcaaatttcaccaattcattattcatggtgtgattcctcctcttttttcttggtgaggaaatcatcagtttgtgtatcaacttccgaacatactgaattgtacagaagagaagggtataagtctgaataaattcagaaagcactcttaatagattatgactggcactgttgcttcataaattcacacatctacttgagtgtctcagtaacaaaacaatgagcattactccgaagtgctactatgttagatattgtaactacagacaagagatatcacatgaatttggatttttttttcgagggagattctttaaagaacagagattttggtgagttaaaaaaaaaaagaagaagaccacatgctgacctgtagtcagccaccaatccttaatgcagagatcacatggatgcaccgacacaatcacacaaatgtcatctacccacatttctcccaccggcctgcgctgcactccccaaatagtgccctactgccctgacaagaaattgactgttgcacagtgtgtttgtatcgcaggtcaatgacgttggcatcgccatggctaaagtgatccacatagatagacccacgtaaagagattttaactatagcaatctccacaatgtatataaatacaaggtagcattaggccatcagcaatgggcacctcctcaacccgtgtctctcctcacggccgtccgcctcccgtcgctttttgaggctgatctgttccctagcaggggagcgcggcgcctcgcaggggacgcggctccctccgcgccttgcctactttttcgtggggggtctgagccaggcactgcattgaagcgtggggagctcgtggacatggcgccctaccccgatatttccccttgtaccctcgccctcatccacagccggcggccggcgacctcctcgtctcatctgccgccgctgtcgccaccggtggctcgccgttgacaccctcgatgggagagagggagagggatagggagaggcaaatgaccgcagtgagagggagagaagaagaccagatctggccacatctcgctgttgaccaccgcatcggcatgccagatccgcgcgtggctccccgtcggtgacaggcagaggaagaggggtggcggcgcggcacacagcctccagcgatgaccccacgacgagagagagagagagagagagagatggatccggtggtggagtaggcggccctcctcgtcgccctcgccgattaagctccggcggtagcggcggcctttctaatctccctcgcactccggccacatctggcgaggaagagtggatggcgagcggcggcggcgggagagagaggagagagaggcgagcatcggcgggggaaagaggagggaggtggtggtggcggcgagatgggcgacgacgaagcgaaaagaagcgagaagagagggcggaagaaaagagaaggaaaaggagagtaggctggcaggaaggggtatttggggatttttcatctagggatactttgggccaagacacccattgtgggctatagtatcctcaccgggttgcttcagattttgaggagcccatccaggggtatctcccagtgtgagctgagttcccctacgagtgttcatagttagtgacactctaggagtggctcacattgtggatgctcttaggagatgagagagaaatagagatagatagtattatttatttatgggtagtccatatgcttaatggatatcttttgttgttttctctatatggactagttacataatgttaataggtagctgaataaaatataatattatctatggactatatttgcatcacattgtggatgcctaactgtcgaaggtttcgctggatttttgtttcccagttcatatgaaagttgaaccaattttcatgaaaactgttggaagaagttaggagtattgttcttttcagctatttcactggattaattttgtggattatcgtattgcttagttctcttgttttaagctatttgttaagtatattcatcaaaatatttaatttatacatataatcatctagataatcaactgcaataaaaccggtcttggctggagatgtaaatgagcaacatgaattagaattacaagaacatttcaatggggtaaaatattttttatgtgaatatctgtaaaatcaaaggtgtttttttggttattattctatgatgaacaattgggcattggagattattggttttgttatttggaatttattcacgaagtggtttttggaaatatttagattcacaggtgatcgcaggatttattatttcatgtgaccggtcagaccgggctgtgcatgccggtcagaccggcggtggtcgagcggtcggaccggccagctcacggtctgaccgaccgacgctgtgtcggtttcggtttcgggttgtttgtttggatatccgtgattatttcatgattatggcttctagatggatactatacgtatgtaatactgttgtttgctaactcgatgcctcgggagagtatttgcggtgatggaccgggagtcggcttggggataagacgacgtctgtggtggtcagagatcatgcgagatacttaggctagagttaatgcacgtggttgatggagattccatatggcatacgatggaggtattgtgtgcgtatgagatgcggagtcgaatttggaaggactccaaatttggtacgattggttatgtaaagtttttttcttgtactagagggtttcctaaggtgtttaggactcttagtatgagtttggttcgtgggctttaggctgcctacctcgggtatatatagagagggagtgtgaggcttcccggtatcgctttagagagcaattgagttgagttttgagttatggtttcgagtttagtcgaaatttttgtaaggagtgctgttggtgcactttgtaaacacagagagaatcaataaagtcgtcatctactttaagagttcttcgatttgtgtttcatcgggtttcggcggtctaaccggcgatctaccggcggtcagaccggcggcatacgggcggtcagaccggtggcagcgacaggggcggcaggcttctcggcggttcgaccgatcgatctacatcggtcagaccgacgttcatcaggcggtcagaccggcgcaataccttcggtcagaccgcaatccatcaacttcgaggataacttttatttccgctaaaagttttcggtttttgggtataccaaccattcacccccctctggttggcttagttcttgtgattcgatcctacaatatcatcactatatggccataaatttgtgattagtaataaaattacttcaggttcaaccgttcaatggtagcagaagtgactaaacaagtttgttaaagagtcgcaaaactgtcgcctgtcggacactggcgcggcatgagctggggagccgtctacacgctttgaaggattttcaaagagaaatggaaatgaagtgacagtaatatttgtttaggatgtgtttggaactacatgttttcaacttctattttcttattttacacgtacacgtttcccgaccgtttaattgagtgtattttttaaaaatattctataggcaagttgctttaaaaatcgtatttataaaatttctcaagcttttatagctaatacttaaataatcatgtactaatgagtcatcacgttttacgtgtgcaggagagaaattcccaaccttctctctagaaagcacccttaatccttctcccaatagtctcgaccaatgaagatctaatctcaaagaaaacaacatgaattctacgtggttatttgaaagtacagtgtacccctacaaaagatgacacaagcaggttcgacatcgctagaatatctattatgttgtgatgagaaagcaagtttgattgcctatgtgagtgctcagattctaatcttggtaggtatctggtatatttggtgggagaaaattggttcatggtgagaaggtgcaagaaccaacgagggcggcaatggctattggtgtactcccctaaactattgaaaagccaacccgaggaatataggcattgctagatcgggatggtgtcaaccataagagggaatggttaaattgaatgtagatgccattgccaggagatgttctttgggatgataaagtagagtacatagcattggcaaatgatcgcatggagtattactgcggagattcatgccttgaggaatggaattttactagctagaggtcaacaagttgatcgaatcatcactaagttagattgtatcgaagtcatcacaatgatgcaaaatggagggttctcgacgacagcagctgcggcgatctataatgaatgtgtggttctttctgaagcttctacattggtaactcttggttactgtcctagagaggctaatttagtttctcacgagcttgctagagcagcctggcttaatccaccatctatttggttggaggagccagtagcttcaattaagcggttagtgagcgatgtaactgctctttgatctaataaagttatgagagttttccttttctaaaaaaggacggcacgtaaggtaaaaaggttacgtgaaaagcacatcaatgttgttgtggttgcagcagcggtgccacacgctcctcacagcatgtgtgggcaccggcaggccagaccgtcctgtacagctagtgtaatggctttctccctttcccttccatggcgagacctaacgccgcacagagatccctacacaattaaacgctagtagccgccaacgcgcgacgcgtaccgtcacgttgcaatctacagcagtcggcgtattggcaatgcgctgcacgacagtggcacatccatgtacccaactctgaaaaattccagcatttctttttttcgtagcttcgcacagtttgatagtttagcaatcccacagaaaacacaaggtaggcagaaatcaaacggattgattattggcaaatacttgacattccatgattccaaaaggcacagctgctagaaattagaaacaagaggaggaaaaaaaccgatgggggatgaggttggcaaccaaaccagaggcagcagcagggtgggggagagagcgttttatgaaacctatcatctcgatgggcagacaaaatccgtaacacagggccagcttgtgccgaggaagaagatgacgacgacggcggtccacgagagcacagctggtcgacgattagcggcggtaggaccatggtttgtgtgtgtttttgttttcctactccttgtacttcatgctgtcgagggtgaagccgggcatgtcgaaggaggtggcgaacttctcgacctccagcttgaggttctcgatgtccttgttgttcaccaggcccttggagaagtccttgaggagcttgccgtgctccttctggatgttgaggcagatggtcacggcctggtggaggaactcgccgatctgctcaaagtccttctcgacaagacccctggatgtcatcgcaggagtacctgaaaaccagccagaatccgtctgagatacttgcttgtgcaaagaaaggtccagtagtagcacttgtgttcgatataactatcatctatggacagaggctctgtagtgaaacatggagcgaagcaattcgcatcagattaattcatgattttgcagagttgtgttttgtaaccatgaatcaattccatagcaatcagcaagatccggactataagatgttactacattagcatgataatattttctgtgaaggggaatgcactcaccaatgcggacaccgccaggagccaatgcactgctgtcaccaaagacagcattcttgttaagtgtaatgctgcaaaggtcacacatcttctcaaccttgttgcctacatgagtaaaccaacattaggacaagtttaatagcactaattaaaaattaacagcaattatactgaagaatgcaaaaacagtctgcataccagtcaagccaagagggcgaagatcccagagaacaaggtggttctcagttccatcagtcaccattttgtagcccttgctcataagatacttgccaatggcgacagcgttggccttgacctgctttgcgtaggccttgaatccaggtgtcatggtttgctgcagagcaacagcaagggctgcaatctggtggttgtgaggaccaccttgcagtgacgggaacactgcgaagttgatcttgtcctcgtagtcatagacagcaccctcaggctggcccttcttgggaggcttagggcccttcctgtagaagatcatgccagctcttggtcctcggagggacttgtgcgtggtggtggtaaccacatcacagtactcaaaaggatttgcagcttcctaaataaatgaaacaagcatattttagagactataggactaaaattaacattaatacatcatcatacagttcagacatgccagacaccaaagaaaaacaacctgaatgaacagtatatcttatgattttgccctttatatcccagcatcggtgcacgtaataagaaattgaggaatatgtcaaacatgtattcttatggctaacaggaatatccactcagataattctttagagatctgttaccactcagcaaaaaagctattgtttcataacaatgtttataaatatataagatgaagcaaaacacaacttgtcacaaatgaatatattgtgccctataacacccaaaacaaacaaattagatgggcgagcgcaaaatagcaaattgattgaagacaactaggattccattgtgtatccactatcagagtgctcggcaagttgcatgaccgaacacaggaaaacaaatcctctaccacagactaccagatctatcatatttaaagaattgcactaaagcacactgaaagactcaaattttgtatcgaattgctaataaacaaaacaagctagaagacaaagagacatacatccttccaagatttgcctattccaaacaaccccaacacccctcacccaatttaggtccttatagatatatgtgtataaagctaaagttaccacatagtttaatcacatacaaccaccaaacccaactaacccagtccttccatccgaaaatagggcaaagatatgtccagattcatagtattagaatgtttctcggccgatactagattgctatatttcgggaccaaggtgtagatccaatcaaccaaaccccccagatcgggcatccaattcactctaaaacccaactcgggattactcaccatccagatccccaaatccaacctttacagcagacagcaacgaagcaaatgccggcggacagaattttaccccatttcatttttcatttctgaaatgcaacaactaatcgagacgagttgggggtgggaggattggactggataggatttttatacctgcgcggcgacgaggccgctgatgtgcgccatgtcgcagaggagcagcgccccgaccttgtcggcgacggccctgagcttggcgtagtcccagtccctcgggtacgcgctgccgccgcagatgatgagcttggggcggaagtcgagcgccttctcctccagcttctcgtagtcgatgtaccccgtggcggcgctcaccttgtaggggaggctctcgaagtatatcgacgtcgcggagatcttcttcccgcccgcggtgtagtagccatgggtgaggtggccaccggaggggaggtcgagccccatgatgcggtcgtgcgggttgaggnnnnnnnnnnnnnnnnnnnnnnnnnnnnnnnnnnnnnagtagggctgcacgttgacgccccacgacgcggcgtcgaggcggaacgcggcgagggcgcggtcgcggcacaggttctcgatctcgtcgatgacgtcgttcccgccgtagtagcgcgccccgggcatcccctcggagtacttgttggtgagcgcggagccgagggcctccatgacggcgaaggaggtgaagttctccgaggcgatgagctcgatgccgctccgctgccgccgcttctcccgctcgaggaggtcgtggacgagcgggtcggccgcggcgagcggggtcagcccccacgacgcgacggagtccatggcggcggcggcggcggctgcgggtgatgctgcggcgaggcggcggtggttgcggcggc

SEQ ID NO: 18698 - DNA, 13296 bp, Oryza sativa
  unsure (1)..(13296): unsure at all n locations
nnnnnnnnnnnnnnnnnnnnnnnnnnnnnnnnnnnnnnnnnnnnnnnnnnnnnnnnnnnnnntttatggagggagtacattttgaggcgtttttttttcttcttttaatttgtgtgtgtgtgtgtgtgtgtggtggctaacggagcaaacaacgctacacaggagttggagcaatgtatagggcatatgaaaagaatgtagtaatgttgttttctaaagaaaagaaatgtaatgtatgtgcaagtgtacgtctcttttgaacttggcatgttagcatgtggattttcttcttttttttttcgaggacatgaaatcacgtggttcttactctaaaatatactcactctgtttcacgatgtaagtcatgctagcatttctcacattcatatagttgttaataattctagatttattaacaactatatgatttatgtctaaatttattaacaactatatgaatatagaaaatgatagaatgacttacattgtgaaacggaggaagtagttgatatgaaagcgagggtgaaaaaggtttgcataactttctctctacgtatattgaggataactttcatttacccctctctcattaagcttttcaagagctgaactatttgttagtcattttaaatgatgtgaatctgtctcatgatagagatgtctgggaatacatttggggtaatttgaagtattcttctcagaaatcctatgctttgaactttaattagagctatgcagccaccttcttattttctctgattatggtagtgcaaggcaatttcgaaagttaaagtctttgggtggttgctattgatgaatagactaaatacaaaatatatgttgggtcataagcattgtgctcctcctgactgtgatctaagttatgtgctctttccagttaattctatggaagacttgatccatctcttttttcaatgctcgtttacacagaattgttggaatgttcttggtatttattgggatacttcaatgagcatggaaagtatgtcgcgccatgcaaattaatccctttatcagggacagtgcttcatggacaaatttttatatggtacttggaatatttggaaataaaggaatggttttatttttgagcaaaaaattccttccttgaattcttggacgcaactcttaaagggtgacatcctccttctgctgtttagaattaaggagagagataaggatgtaatcttgaattggatcaatttttttgtaattttcttttttatttatttttaatcaaatctttctaccagcgggggcctcccgtgttgtgctcctttcaaaaaaaaaacagagattgtttcagcaattgagcatatacaagcaaaaatacctagtactacctctgtcccaactagctacacacggatacagatggatcaacaattttaagatatggaagtacaaatatgatagcccaatagagacaaccgtgtagatacattatctttcaagataacgaagcaagggggtagagtctcgtggtactagctatcggtctcaatgtttcgaagattgtttaaggcagatgtgcattctttaaattttttttataaaaataatatgtgacaggtttataatgagcgatatagaccatcaataattatgtatatcatggttttctaagattatatactttttcatagagaataaaaaaaagtatgaataactaacttaacgtgtgtagatgtgtaaaactagactaaagccagccatgccaatgctactatacattagttgttttttttaacctatggacagtcagccatcgaggtaggcacgagcatgagccacagtgtcacgagccatggagaggtaataggtgtgagagtatatatcaagggtagagctaaagtgtaattattaacgggtctaatgacccagtgaacttctataaactttatggtaaatcatttagtcacgggtaagaaaacaaggatgactctatggtacaacgtatacaacacaagtgaccctggtgattttttccccaagatccaactttgggtggtatggtgtacaaatattaaggtgcatgggagcggcaacggataaggtagatctagaagatgacgaactcacgcatacttgttggcggtaccctttattgatatccggccttcaacaaattcaatatctacatcacatctagaccacattatggtttaccctcaccttcaccccctgtgttttgtcgtaccatgcaagctcatatttagatgtgctagattgtatgctatgttactttgaaactcacgattataaaaatagaggtatacgtatgggaaaagagcaatgcactagaatttagcacacatgaatttgaaagatggatcatagaaaagtgaactggaacattagtggattatatacagatgtgagagataaagacagaagatgcatattggacttctcaaaggaaaaataaaataaggtttgagctcacatgtaaatttcctttggaattgagatataggattgtaatccaaaagaatttttcaaactacagcaagttaggaagaaaattcacaaggacgaatcctcctttgatatattcctatagactcatttgttgatcctcagtgagctttgagcaatggtctcaacgtgaatatatagaagtaccagtgtaccactaaaaatgctgcattcagttcacctaaaaaaaaagctgcattcagtgtgtgctatgtgtgctagcggctgctctgagctgcataccaatttcatggaacattttgaaagggtaccgactcacaaaagtcctctctttatatatttaacccctaaatcattttagctcgatgattagacaaaagcttggaggttcaattagtggcctccttgttctgcctttttcctttcctatctatattaagagactttgttaatgaccccttctctaatcaaaattagcggactgtttccagcttaaactacaaaaaaatgtggacttcttttaacacctaacagaagcacttggtatatatctttctcccttgtgatggttgttgaggttggtgagcgaaaaggacccttcataattggcacggtaagtagagcctgtagaggttgttcgtgtggtcaccgtgtcatgctaccaagatcattggatccaagttgcttcttagtttttgttgatatcaatattagtctctgtccgtgaagacatatccatgcaaggaactgatttgtgtgacatgtaaaaaactaatttcgaatcctaatacaagataagcccccgagctgcataagggagagttcgcagacgaagaaaatgaagacccaattctgtttgctaaaaccctaaacctaatcgtccgatcgacttgaaccgagaagaggtttgtgtagctatctcatgcctggtgaagactcgaaggctatcgacatcaagctaaaagcagacaattagatcttgatagggccggtgtcctatttcccttatgacacaaccaaaagaaaaactataagagaaataagaagaaagaagagaggaagaaccgcaaatagaatatatcaaacagacggcgaagacgtgtcctaggagttgattatttgaagattatgcacgaagcttatattttttctttctgttctatgccgctaaaaagaaagataatacctatatgctaatgagtttgtttctccatcctcaccaagataataagtggcaaatagcaatctggtagcccctaatgaattagtgtaggtagcaaattgcagattgcatatgctatgatagatttaattttatggcaataatacataccaaaccattatccgccacccaaaacgaatctaaccccggtcaaggtttacaaaatgacatatatattatcaagataaaagaacacatgacattatgttttttctatcatgcataaggaaacctatatatctaaggctccattcggtagtacaggttcccaactcctcctcctcgttttccacgcgcacgcttttcaaactactaaacggtgctttttttgcaaaaagtttctatacgaaagtcgcttaaaaaaatcatattaatctattttaaaaaaaataaactaaaatttaattagtcacgtactaaaacgctgcttcgttttgtgtgccggggagtgagccctcactcccaaacagagcctaagtatagttaatgctaattctctctcctctcatgaagccacatcgcatcaattgctttaagcctttggagattcatcaagggtgtaaattgcatctcttcatatcacctcaattgtgtttaaccttttgacgatttatcaagggtataaattacatctattcccccaaaaggcacaccatacaacccaatcatttataaactatagataattaataaaggtacaaaaatatatataaacacataaaaaaaatcgtatagtaggtaagaaaaaaaatagaactcatatatattattatcacacaattctcccttagcaacacgcggggtacccatcttgtattatttaagcgcagtaagtcaatagcggttgtaacagtagttgctaagtgctgtagcttccactaagtttgaatacactatttttgttcccctactgctaaccttggtcaacaggtcctaaaatggttattaatcagcttaggttgagtttttatcagcatgacttcctcgtttatcacgagcatgttcttaactgttaaacgacatattttgtgaaaaaaaattatttaaaagtattttaaaatattaaataaatctattttccaacatatagttaatacttaattattcacgcccaaataatccgtcccattttatgtacaattaaaaagttgaaggtaacatttgttttgaacacaaccttactctgagtttcaattagctttataaactttttcaaaaaaaaactttttatatgaaatttattttttaaatttgtaatagataatattcaatcaatcatatgctaatagttttcttattttacgtgtcattaaaaagctcaaacgttgagcctattcgaataaggttgcattctgacacttggtttttgaaagtcgaaatggggtgattagtgtcaatgtttgatgtcgcgattccagtatttgcatagtatggggatcattggtaccaggatatatgcgagattgtagtaaaagagacggggacgaggaattttatacaggttcggacccctgaattgtcaggtaatagccctaaatcctgttggccgaagccggtattgatcttattcaccataatcacacctgtacaatatttggggtagcctatctaactgttgtcgatatggcggtctgaagctctgactcgtagtcgacaacagggtagtcttcctccttgagttcgtgtccggcgagatcagagacaatgctagatccttacggccggcctctgtaggtattgaatagggtcgatccaggcatatctttgatgtcgatatccggcagctcgtcttggcgtatgttggcttgtattggcttctggctttgtggcgtctatgttgattgtccgtctcccctctcctcctatagggccttgtatttatacccataggtgtccccttgtccaagtagaactagggaaaccaatatggatacaatccgagtagtccttgtcgttttcatgtagaactctattcatccttccttatgcggaactcctcctatatccgaaggttgtatccgtataagacatggtatgtggtgggtcctgctgagatttagtcaactactattaggtatgtggtatccataaccctgacaattagtgtgattaattcggtattaactaacataaactttaaggtggtagcactgtggcagggagcaggagctagagccaaagaggaaacctctatgccatgagttaggacatctacaccttcccaccaccgtctcgccctcctgcccacggccatcttcatcatcgcaggctcatctgtgcgcttagatctgactcgactgcttgacctcaacgggcagccacatccaatgcctcccttcatgcggacaagtgggcgagatcgacctcgacagggctcgccgggtgccactgccacaaccccttcccgcagagctcgaactcaatggggtggtgccagcatgtgcgtggtactcaagctcgagcaaggcgtgttccaaatctgctaccgcctaggcttcggtggaatggtggatgcggtagctcaaggttgagttcgatggggctcactgaccaccgttgtcatgttccctccatcacgccacactggagccaggagtcaccatcaactcgctgtgcactaccggtacctcgacccaatggtagatgtggtgtagaggcaagggtggttgtcatcctgctaccctcattgcactatagtccatccatgctgctgcctattgctgccaccatcgctcagcggctagtattagcagtcatcgagctcaacatcctcgtcactatggagaatagggggggagggctagctagccaggggaggaaagggtgaagagggaggggagagagaaaagaggaagagaacggatgacatgtgggccctatgctgggactaacatgtgggctccacatattttttattttttattgaaatcgataatgcatgtgggtcccatttattttatttttacttttttgttgattgtgacttcacataagtgccacgttagccgttacataggataaatactgtgtcaacgtgccacatcatcgaaaacgaccgttaatactgccgagggagttattttgcacatgttttaatagttggaggagtagttgtgtggtttggagatatagggataagattcgagctatagttgagggagtcaagttggctatagttgagggagtcaagttggactttttcctatctctggtatagttcaacttccacctgaaatgaaggctcaaattagagctgaaagccacattctttgctggcctatgggccgcactctcagcactcgtggatcttagcccatcatacccttggagatgcacttaaaaatccacgggaatttattattggaaatcatctccaaccaagaaaggtagtgtgaagaccatatgcaagtttcagtttggcaaaaaaatgacagcgaagtgttggaatatccgggcacctttcactgtcccaactcggtaggcgtactgcatattcctgtggttggtgaagaacagatccaaggcagcgtatatatataaaaatttcttcacaaaaagaaaagattcagtgatctgactgaaccaaccaaccaaatgagagagacatgctttgccagtagaaaggaaaagaggagaaaaactgagccgtcagagcagaatccaccaaccccccatggtgtgcatgcctgaactaatggcgacttaatttggtggtagctcagctagctgcaaccaggttgactgatctgcagatcttgccaaccaatactatacttgatggcaactaatttctactaattagtaaagtgagagtgagtgagttagtgagaggagcaaggaaagatggacgatggatggcaagggaaaatggaagaatatatataatatcattgccgacgacatgctttctacgcgtgatctcatcgatcgatcggtcggtcagtcggtgggccgagcaaaatgatcgagttgatgtgtgcctgcctgcctccgcctccatgtggtcggtggttaatttgggatcagaaatgctatggtgtaaattaaatactccctccgtttcgttttatttgacaccgttaactttttagcacatgttttaccgttcgtcttattcaaaaacttttgtgaaatatgtaaaattatatgtatgcataaaagtatatttaacaatgaatcaaatgttaggaaaagaattaataattatttgaaatttttaataagacgagcagtcaaacatgtactaaaaagttaacggtatcaaataaaacgaaacgaagggagtatgtctatatttccatctcatcgaatcgatcaggttacattccattgacttgaatgaagtttgcttttctacccgattgaacagcaatttgataggtgctggccgttcctgacgttttggagcctggactgtattgatacacacatgagttcactttccattgctactataaccaattcttcacttactgattagcatattcttcatgtaggtttcgggctctatctcttttgattttgtgtgcaagagtgctttagagatcggcaagatttatttccaacaaactaggtttcacgcgttaatgactcacaaacaaagagaacaacgaaactctacctaatttaaatgttatatgaaattataacaagctgtctattcaaatgatttgatcgtattacaaataaacatcggctttcttatctccaattttcctctaagtcaatttgattatcaatcattacccgtatttgacactggcacactgccaacagctatctatctataatgtactctttccatcctaatattctaggattttagctgaatgagatatctgttctctagatttatattattagaatatggcattgttcttttgtccaataaaagttggattaaattttggatactcgtggcacgtttttcaaactgctaaacactacgtttcgtgcgaaaactttctatatgaaagttgttctaaaatattatattaatctattttttaaatctggaataattaaaactcaattaatcacacgttattacaacctcgttttgcgtgaaacactttgggtgtgtttgaggagaaggggattgaggagattgggaagatacgcaaaacgaggtgagccattagctcatgattaattaagtattaactattttaaatttcaaaaatggattaatatgatttttaaagcaactttcctatagaaattttttataaaaaatacaccgtttagtagtttaaaaagcgtgcgcgtggaaaacgagactcaatcccccctatctccccagaactaacagagccttaatcttcattagacattcaaacaccacctatatatctcattcaaacataatctcttctgttttgataggcccgcttttaggccaataacttggcctagcccaagcccaccagacccaagcctaggtctaggcttcctagctacaaaccatcttatcattagtaaaaccttctacctccgtccaaaatataaaatataagaagttttaaagttgaacacggttaataaaaaaaatagatataatcaaatggtgaaaagttgttattggttaagaagtaaatttatgtgagaaaaaagtaaatagtggagagttgcgattggttagaaagagaatgttaccgaagaagttatattttaggatggatgaagaattaattattctaccttttcatcccaaactaaattcctatacttaattagctcttgctagtccagagcaaaacgatttatcctcctgacaaagtgtagctaaaacaaaaatgcccatgtttggcacgccctaatcaacgagttaacatgtgatagtgctagtgctagcttagcctttaaaagatgatgggggccccactctcactgtcccagttgaatcggtaggtgtacactctcgtgtggttggtgaagaaatatgctttgtatctttgcgaggccaaacaatatatctgcatttttaatgtgagaccaaattaagtggactagcctctattttttttcttaagattataatttagaagtggacaagtaccggggagtttggctgcatgcaccaaccatgaaccgacggcgacgttgcccccacgactccataaaaagagaaagggaaagatgggcagccaccggcgggtgggcgcttctccaccaccaaccccacaaattatcgtggaaattatccgtgaaatcggactcaatggcttaagaaaaaaaattatgacggacgatgagcctggtgtacgtgtggtgtggatcgtgtgatcctacgtgcgccgtcggcgtcaatcaatggcggctaggctccgtcccataaaaaaacaatctaatacggtatgtgacaaatcttagtactgattagaagatttatggtattaaaatgtgttgcatcttttattggatttgtttttttatgggatggagagaatagttgagcagccttatatatacgtgccgtgcaatatttgttttctgtcaaaaacaaacttgtgcaatgtttcatatagacataagatacgggataaagtagagaagatattactatctttgtcctaaaatattataatctagaatgaaatttgattcatcctagggttttgttttaggagcttaagattctgagaaacaactggttagaagctaattggtgagaatttggagaagctgagtttagcttctgacttctaactaattttctaagattttacaactgcagcttcataggaattgtatgaaaatctatattgtttgaaggagtttctagcagctaaagattctagaaaaaactgtagttatcagaaactcccctaagcaaatcctataatggacataaatgacaatgtttatgtaccatacacatctccatgtttttttacggatcttagttgacatggcgacagctgcgtcgattcccgtaaacttatttagtcaaaacattccattaagatcttaatcccggagtaagtgctaagcaaggctatgcttgtttggtctttacacacttcaaagaaagatgttctctctttcttaattcctttgctcctactgccactaccttttactacgataccattcgcacctcaacaattttgcacatagtttaagtttatcgataactaataaaccatgtgagctgatcaaataagcaagatcatcatgacggtatcttcgatgaagtagtgtataaataataattgaaccccccaagtatgtagtgctatactccctctgtactcataaagtaagtcgtttaggacagcgacacggtctccaaaacacaactttaacttattgtaagctataattcagtacgtgctccattattatgtggtttaattagtgttttggtttagtggtaggtgtttgatttggcaacgatgcgttaacacgagttacatgcagctgattaatgattaattgttgtttggggtgcagtggtcgtatgtcactttctggacattgagttttttctacaggcttggtgtaggaaaagaacaattaattaataatactagtggaaacagctcggagaaatctgctgccattgcacctaaactgcaagtggaactttggtgtggtgacactgaatttcgtgcggtttggtcactgtcaccaaaagtttggtattcatgcttggactactggttggcataaaagtctgtcttggacaaaaatatagttcatacacctcttgttttcttgaaaataccccctcctttcctaaatgattaacaccgttgacttttttaaacatgtttgagcgcttgtcttattcaaaaacttctgtgaaatatgtaaaactatatatatacataaaagtatatttaacaatgaatcaaataatagaaaaagaattaataattacttaaattttttgaataagacgaatggtcaaacatgtttaaaaaagtcaacggtgtcaaatatttagggatggagggagtagtataacaacacttgtcccaaaatgtttatcagtattatactccctccatattcgtaaagtaagtcgttttggacagggacacagtctccaaaacacaattttgacttcttatttctataaaaaatatctatttaaaaatgatatatgtatacttttatgaaagtatttttgaagacaaatctattcatataatttttacattttcaaactcaacaacttaagagttatttatgatttatattttcaaggttagacttaacattgacctaaatgactttcgtcaatgactttctttacgagtacagagggagtatttcattttgataccctcaacaaatggttcgctttttctttaatggaattacaattgaattcacataaccttcacataccaagcacataaacataaaaacatgcagtaatgcacaactacgccaactgaccaacagccaccagagcatgtaatcgcaaaatctagcttcttgtcaaaaatggcttgggtaccatgtcttttcttgttttttttttaaacaccgtctttgtacacatataaagatagaagatgattggtgagctcacaaaatagcatgttgtcttttccccgacacatttgggtgcttaggaaatgaaaacataccggctacatattataactataataattaagtgctataacatttacaggagagtggctggtcttataagtatgatattatgcgagactatgtgccaagtagactaaagctacaatcaacgacgacatcccttcttaatacacaataggatgaatataatggtgaaaaaactactacaataaatactacattactcgcacacaactaggttctcgagattgctctcctctctggattgatgtgttcgtttggccattcctaacccaagacactaaatataatttccaaaaacttcacatcaccaagaaactagtactaagacacaacttttccaatgcaaacatcattattctatacttaaatttaatgctacttatttcacatgatgtcttggatgttgtgtagaaattctctttcctcatttattcatttgctatatcattttttattctagatggcaatttatttaatactatggataccatcttagtcattgggttgggaatggcctaagatcactcaccatgtcattaagcaagctctctagggctccgcgtcccctgtctcagcaaatttcactaaatttaaaagacttttttgagtaaaattcaactcaaacatatctgagtggcaagtgcgtgggtccgccatgatctacaccaacaagctccccggtttggatcgtgtgtgcatgacggtgcagccgccgacgcggcgcgccgacgcgatctgaaacccatccccctctctctctctctgtgtgtccgaaggagatatttttcgcatcgaatggagcagnnnnnnnnnnnnnnnnnnnnnnnnnnnnnnnnnnnnngtggattcttcagatctcgatgtcctcctcctcagatgggccatgatgggccggcccccgcaaccaacggcccggatcacctctttcccccacccccatcacaaaaccccaaacccatcaccaactttccaatctcacccaccccaccaatccccaccagatccaacgggccagatct

SEQ ID NO: 18699 - DNA, 1903 bp, Oryza sativa
ctcatccacgagggcgtcaagcccgaggaggagttcgagaagtcaggcaaggtccccgacccggagtccaccgacaacgccgagttcaagatcgtgctcaccatcatccgcgacggcctcaagtccgaccccagcaagtaccgcaagatgaaggagaggctcgtcggagtctccgaggagaccaccaccggtgtcaagaggctctaccagatgcaggagaccggcgccctcctcttccccgccatcaacgtcaacgactccgtcaccaagagcaaggtgaagcatcccctccctccctttctaatcccattatatttcagatctgaagctgtttgcgttagcctagcctgctgcttgtactgttcttaccttagtactacttgattttgccgttattatggatttgattatgctactactgtggatctggatctggtttatctgcttcggttgattcagtagatctggtgggctattacgcataaaaaaagtttatgctataggagtggtggttaggtggattatacatgtgtctttaacattttagattcctgatgtttgtggcatgttgaatatggatctgtcatctagatctccttttgtgacacaaactaaaaagacagggttaaaaaggtttagttgattttacctaagcaacactaacaattgggggaaatttgcacctgatgtagtgcgcgaattttgcttttcgtgatcgtttggttgcttgatttagacgggatgcttgtagttcctttatttagtgtctcctgtgttataggagtaggagcgtcgaatttaagtcttaggttactgcggttggatctaaatcttggtctaattgttgcgtagctgtcaaagatgtctagttttgttgttagcttgcatgttttgcggatctgatgacagaatatggaataaaatattggtaccaaactgcttgccatttgttttattttactcgttattgtgcacttgtgtagcttgattgtttaatggcattttactggactccttagtacacccttcatctgtagtgaaatattactgaatgctgggaattacaatctgttatattttgcaatgattttatcatttttgcttgagatatattaactctgtgtttcttctgaacagtttgacaacctgtatggttgccgccactctctccctgatggtctcatgagggctaccgatgttatgatcgctggcaaggttgccgtggtctgcggttatggtgatgttggcaagggctgtgctgctgctctcaagcaggctggtgcccgtgtcattgttactgagattgaccccatctgtgccctccaggcccttatggagggtctccaggtcctcaccttggaggatgttgtctcggaggctgacatctttgtgaccaccactggcaacaaggacatcataatggttgaccacatgaggaagatgaagaacaatgccatcgtttgcaacattggtcactttgacaatgagattgacatgctcggccttgagacctaccctggtgtcaagcgcatcaccatcaagcctcagaccgaccgctgggtcttccctgagaccaacactggcatcattgtccttgctgagggtcgtctcatgaaccttgggtgcgctactggccaccccagttttgtcatgtcctgctcattcactaaccaggtaaaatatgatgaccagtatctattgtctcactaaacatgctgagtatagctgtaagttacatgattgaatcaattctgtgcttgttgcaggtcattgctcagcttgagctgtggaaggagaagagcactggcaagtacgagaagaaggtgtacgttcttcccaagcacctcgacgagaaggtggccgccctccacttgggcaagcttgagtattctatagtgtcacc

SEQ ID NO: 18700 - DNA, 717 bp, Oryza sativa
  unsure (1)..(717): unsure at all n locations
cgcaacggtccgactgagatcagctagatcgtgcttgnaagcaaacaatgatcacatccctggaccttctgacatttggtctgaagcttggtggcgaagtcggtgggtttgagaatgggttgtttgtggatgaagagatcttctgacaccatggtcttggagcttggttgttacgagctccggtgtatgatctaatggggtaggagtgagtaatcggtgtctgaggtttcggcaacttaattagaagatcggcgacccgtggtagtggcacagaagaagagatgagaaaccagagaaagagatgggaaccaaagtggaatcttgcaagctgatttcaatcccaaatgccctgtaaataggcttacaaatctaacttaatgcctaacaaataatgaggaaaatgtggagataacaatccaatctcaattaaacttatcattggctaggagtgtagctgtccgacacggccgctgttaggcgcccgtgctcgcgtcgcctgctcctgtgcgcgctacaccttccgcgtcgcgtgtcttcctccttcggttgcagacgatgtgtcacgcccagaaattgctaacctgaattttaagcagaatgtgtattaaatatctgtccagggccagccacgtcttacaaaagtaataaaataaatctaaaaaatgcaacggaaaaagcaaataaacaagacttaatcttcacgaccaaaagtatagc

SEQ ID NO: 18701 - DNA, 650 bp, Oryza sativa
  unsure (1)..(650): unsure at all n locations
nnnnnnnnnnnnnnnnnnnnnnnnnnnnnnnnnnnnnnnnnnnnnnnnnnnnnnntaccctttggagagaaaccattggtagcatcatctctcttttcaacttttttcttgacataatcagttatcactcttaccctttcgagacacatgtacgttaaagcgatctttaccaattttaaataactgtgtgtatccataattgaaaccgaacattaaaagagaaacagaaaagctaatatttatcaaaacgtcggattgaacagagcagacatgtacagatgtaattaggccctatttctttcaacttaggattattataatctagattattgagagtaggctgaaagaaacaaacaacttattgaagtagcttattataatctagagcccagcttattataatctgataagctcatttaggtaagctttttccagattattgggtgaaaaattatccaccatgccaccccactccctatttagacttaaaaacccaataatctaggctctaataagctaggaaagaaacaactaaccgcttattctactatagattatagcaatctagcttatagtaatctaactcaataatctagattataataatcctaagctgaaagaaacagggccttacaagaacacgtatatac

SEQ ID NO: 18702 - DNA, 650 bp, Oryza sativa
tttttttttcttttttttgctttctccatatttgtatcggatgagactagatggcgcattgccaccgtgctgctttgttccaaggataacaaatatgggctctttagcctgggaaagagagaataatttggttcaaggataacaaatttgtagagaatatctgaatttgatttaaggatttgtgaactgaagttggcatttaaacttgagaaaaattaaggctcagattatgggctaagaatttgaatttaggattgagcagatccaaatggagtccaatccctattaggatggatgttgattatttgtggatatgtttccctgtaaatctggaatgttccccattaggtatattgataaaatgatgatgagaagaaaaggttggaagagggaaacttgtgtcgtgtgcatagatgagaactgtgtcagtaaccccggataaggtaagcaactgttttctacttttatctctggatgtaatgcacaagtcaatgtgtggtagaataggtggttttggccatctcaagccatagcttcgatgcaggagcagatgcaagtgtcacttggtcctcattcgatcttggtctgggccggtccaaagtggtggcagagatgtgcagctgcaacgcgcacggggttagcaatagaaa

SEQ ID NO: 18703 - DNA, 696 bp, Oryza sativa
tgttgtgtcttgctggaattgttgggttacattccctgtttgaacagtgactctggaattgttgggttacattccctgtttgaacagtgactctggaattgttgggttacattcccagtttcaacagtgactagtcatgaactggatatcctagtcggtaaggaggtcttatagtgactcaacttgaatttatgactgcaccttcactgggctgctggaatttcctcaacctttgtgcttgttgcaggaaccgaattaccagattgatgttatctacggagtgatggaatccaagtatccaacaggaacaggtcctattaccatcaggacccagaattataacatgcataataaacacgaaacaggagaggaggcagtatagtcaagcagtataattatattcttgagattgattaattatcggcaactagctggcttaattacttgcactcatccaagtccatacaaaagatatacagtaccatttcagctttttagcccatcattcgcttcaactcaaccggcaactgggcttaatttacggcccaaagactggtccaatcaaaagtgaactatgacgaatgggaataagtatatttttcatccctcatctcttgcccctggtcgaatcgcctccttcaatagcaaaaccgggtataatgactccctcatctttgaaaaccggtgcaaatcgac

SEQ ID NO: 18704 - DNA, 540 bp, Oryza sativa
gatatccaggtcatcgtggtgactgcccacgtcgcggatgaaggtgttgaggctctgtggaggctgtcatcggtggtgggtgaggaggaaggcgcggtcggaggtgacgtcccgccaggccttgcagacggcacggcactgtgggatggattttggcggcagcaggagcagaatctccgacataatttcttcagggaggctggcaatggtgagaggcctgcgacgctgctgttcgggcagcctcaccgtctccgccattgccattgatcccccagctgacaatttggactaggaccctagtgctgctgcatccttggctccttgccgctctgaaactgaaatgcccaaaaattttccatggaaagagaacacattaggattccagaccgtcaagaactctaaagaaaatacagctcaagatgggtgcttggatctcacatgaatcaatcatctcgttttgtgatccgctattcatcctccctccgaatcgtcagagcaagtgactgatcataactgataaacaaacaagcaattaggact

SEQ ID NO: 18705 - DNA, 3835 bp, Oryza sativa
  unsure (1)..(3835): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnncccatgcatgacatactcatatttgtcagccagagttttcctgccagcctgaaaaggagatacttcagtgttaacttgcctaccgggagttttatctatgtgcctcacttttgtaattctacaagcaacagtggatacaaattatgcatccataactagcagcattcgatattacacagaatttcaaggcctacttgtactattgagtgtcgtacatgaaattactagcaaggggaaccacctgtgtaaagaaggcgctatctggggtaccatctaagttcaaagtaggaaccaagaccatggtaaatctgtcacctggatgcataggatagacatctgtggcaacatctaactgcatgtacatatcgaactggtcactgcgagcttcgatacgagaaactgtacccacaaaagaggacaaagaagcatgaagttatatttgaaataaatagcaacacattctaggaaaggttgtcatatataatttacagcatgtactgactgaaacatcagcgaacgcatatacaaatgatatggtgcggcaatcctagagtacagaacccctttttttaccttaattaaccacatgattctgcaagaacatgatttggttgacaacatagtaagtttgaaaggggaaaaaatatgaagtggttctttcttttcagttaggtatgcatcaataggtaaataagcttacaatatctaaatcatgagctgcaaagatacaattacaaagctcctcgattgccagataaacaactacgtgacgataccgcggtgcatcaattcatcgaagaaataaaaagaaaatcgtttaggggcatcctagcatctaacacagcatttatcgcacataacaagcagcgcaaggttttgaaaccattctcccgaaagtgagaaaaaaagagaatccagggattagtcacctctgtcaaacttcttgccatcagggtcgagcctggtgacagtgaagatgtcctcgaagagaaactcggccatcccaccctgacgtccctacatcagaggaagtgatcagtcagtgtaaaccctacgccatcgatccccccacaaaccactactaccgaagtgaccggaaaagaaaattcgattcgctccggcggagcaggcggactacttcgcagagatgggtggattgaatatcaaccggagatagcggaggaggttttatatgctgcgagctcaccggaagagcgggattcttcgtcagttcgtccgccctaggtcagggctatcgcaggcaggacggcggcgagacggcgaaggcggagcagtgctactcgggttgggtataaagccagaaaaggcaaggcccaattgggatttggctagcaggtccagcccaacttctgagtccccgcgaattttaggaggaataagttcatccgagatccctaaacttatcaacgaatccgattttttcgtccttcaaccgaaaaaacagatacaagacacaataggtccctcaactatcgaaaccggtgcaacataagtctcaaggctgtttggatgacgtggtgcctacacataactttaaaaatgtcatgttagaaaaaaaaatatttcaataatgtgtaattgagctttaattcaattaatgttgtacatcaaatccatctgagctctgcacagagcatttgttttttccattgtataataaaaaaagataggacatataaaccatttaaagtatattcatactacacatcgaacaaattaaatttaaaccaatatatatgcttgtcgtgccaattgaaaaaacaattgtactccaaaaatccattgtataaatatatattcttttccatcaaaacaagaacattgattgtttgcttcatgaacagtgattatttgatcaaataaaacacatatttccaaaagggataaatttgttttttttttacaaaagtggctatgtttaaattgccgatatcttaaattgtacgtcattgcagtgcgatttgttcagagtgaatgaaaagtgcattcataagccattccatttatcttgtttccaaaagtccatgatatgttagaaatcaatagggcataatatgtaagatattcctacaaactggccactggaattaacctgaaaaaggggggaaaaagaagcattggattatgctatcaggatgtgcaaatccgttcagaagaaaattgagaaccagtaaggcttgccaagtgcatcctacatggtcaagctcttatcttatactaccatttcagcacactttgtttttcagatcgatcattgaggatattatgataaacttttgctgccattgcgctgctgcatgcgccgcacatctacataatcctttgctctagggccagtgctccctcagcaaaaagatctatcagaataaacaaaatatcatcagaaaacacataggatatcattagaaaacagtcaggaatttcagtacagctcatcgcatatgcaatgtaagttgcagattgtttaaaacaaagatgaccctctttgcaatgcacaataatttacatttggtaacataataaatcgacaaacaaccatgtagttacctgaaacagatcaatacaaacatgatcaacaaagcaacatgatttataatacgaacccctagggaacatatcaaccatcgacaaactgctcttgatcaaatcaaagaacaacaaattggaacgcaacaaacacatatacacaggtaaaaagaaaagtagatcgagcgatgcttaggccttgctgtcaggcgggatcgatggcctgcgggagcagggatgaggagtcttgcgtttgacataagagaactttctttccagtctatataattaacaattggatagaattaatatactccaacaagcaggtatatagggtcattgatacactgcaaactcatttttattaaaaaaccaaagacattcctttgatcgcaggatgtgcattataccttcttggaacttgactctgtaaactgagcaatgagacgagggtatgtcgtgtcgaggcctcggatgatcccgcagcaattccaaccttgacaaatgatctgaaattgagcaatgatctgaaatccgagtattggaattgattcgggttaaaatactgtgatcatccgaggcaccaatttcaggttaaataccactaaccgctaagcaattccatcatatatattcagccaagtaaaagtaataggagaaattattgtaatgtcctaattttccaacccaaattaaactatttttaagtggagcatatcatcatgaaatttttgtgcctgagcttcaaagatatcatcaccatgcagtttattttaccaaaattagcagctgagctctatctcatcacgatcaaggaaaagggagaaatataattcaatgttctatcaataaaaactaaccttgccctggcaagttgcagcccaactgctcacgctgcacacatgtgctcgcaagtcacaattgatccaatatttgatgggatctatgatgtacaactataatgcagtgacaaccaatgattctcaagtatgctatatacactccacgttgcagaacagcaaattcaaggatccagtaaaactgttttattgactatatagacagaaggtttacgattgcatctgtgtaccatccgctgtcataatgagaacctggaaacaaaattcatataaatagatgtaaacagtagttgcatgatggaatcccaaaaatatttggtgaaatatcagtttttaataact

SEQ ID NO: 18706 - DNA, 533 bp, Oryza sativa
tttggcccggtcccaagcacagcccggaccgtgcctgggctgccccctcggcccggtgggccggcccggcaaggcccggtcaaataaaataaaagaattttgctgatttatttattgctatatccaatttatggaattgataccccgtttaattgatactatcatttagcaaaatgaaacatagcatatgcatccatctttcggctcgagaatttcacgggatagagatatggtataagaaataggctattaagtaactctaaatgaattgttttagctccggttcgtgaagaaccagagaagctttctagttatgaatcgggtatagaaccccctttatagcttcatgctgtttgaatagttccaattaatggaatcgaagtcattacacgagtgagtttagcaagtggaatatctgactttgaaggagctgctgcaagttctcgaattgtagttgtcaattctggaatactttaattaactatttgattgaattttcccttccttttatcctcccgtcttatatgggggat

SEQ ID NO: 18707 - DNA, 662 bp, Oryza sativa
cataaaaaaaaggaaaaccctacaataacttataattctccaggtaaggaccttctgaccccttccccccctctttttttttgtttcttttttgcaagtagcagggcagaatgtgatagaagagaaaaacagtaataggatcatagtaccagtggctgacttgcaagaaaccaaactttttgcaggcacaataaatccatctaaaattcaggagcctaatctttgggactagaaccgatgagtgagtattcctaaaaaagatggagttgtacagtttttattactcgaccatggaagatcacaaagacacagaagttagtatggttcaagggcgcatctgctataatgtgagagtccaagattttgctacccctgggctaacagtacagtgttctaggcttaattttggcaaaaaaaaaaaaggaaagaaaagaaaaaaaaacacagatagcagcctctgagatttgacgaatattgtcaatttacagtgcttagattacttttagtttttccgatgacggtgcttagactacaagccggctgtacaatggagtcatacaagattatgggttcagtcttaatagtaactcttcaactctgaggctaaaaacctaaacaagcaaatgctcaacataataaacataaaaataaaggatcgaact

SEQ ID NO: 18708 - DNA, 684 bp, Oryza sativa
ttaacaaccaaaccgtactgcctgtactacaagcaacatgtcactctttttttttgtagtagaatttagagttgagaatattaatatttctgcatcatggaccactatatggtacataaacctagtgttaattgttgtgattgcatgtctgtctgctgaggaatgtgaacaagctggacggacatcatggtggtgacagaagacgtcagtcggtctaatcgacagtcagtcaggttgggccgaaaagaaatttttttttgagtgtcacatcggacgtttgatcagatgtcggaagggattttagacacgaatgaaaaaactaatttcataacttatctagaaaccgtgagaagaatattttgagcctaattaatcaatcattagcaaatgtgggttactgtagcacttatggctaatcatggactaattaggcaccaaagattcgtctcgcggtttctccctaactgtgcaattagtttttaaatttatctatatttaatattacatgtatatgtcaagattcgattggatggttttaggaaaaagtttttagaaactaaacatggcctaattatctgggcaactaccgtcttgcagcagactgtctagacaaaaatgtggtcagaaaacagactcgtgataaaccattttggtgagtatgatctactacaaaacaaataattt

SEQ ID NO: 18709 - DNA, 724 bp, Oryza sativa
aaatacagtcctgaactataagtcaaaaatggagaagggcagagagacaaagaacggacctgactgcacaggaggattttcaaatcctgggtacagcagaatttcctgcatgatatgatagcgaacttcaggataacacccattccactctcatgcaaatatatgttcccacgtcatgcaaataaaatctcacctcttttgtatgctctggaacattgttagaaaaatctacaagcagaaaaggaaatataagccaataaaacaaaagataataaccggaaggaatttcaaaggaaaaattatgttaggcacctgttccaggaaaacttggctttagactcagagttaaatcaaggtagttgtcctcaggttctgtaccaaaatcccacaggttcagttccaaccttggattcggtcctacaaaaataaaaggagttcaataggagaaacaacaacaaatcaccaaaacagaatacataaattatcatttcctgaaagaaaaaggggagaaactcactagtttcaattgtctttgtgtgagaggcatggagtggccttggtacccagttgcccacctagacaactcaaaagtcttaggtacataaagaaaagcgaagtatagttcccatgaataactcaatgtgtaaattagtacattaaagaacggatgctgtagtgattgctcagcagttggccttcttcgtggatcccaggaacaaagttg

SEQ ID NO: 18710 - DNA, 677 bp, Oryza sativa
aaaagatggggccgaaagaaacaagcaacatagaggataaaaacagcatgcatgaaactagcatcaccaagcaagagagctattcaaacagttaactgggctgtcacaagcaggcttgctttgccaaatgaaagcattaagcttctaatacgttctaagagttagtaacaagagcatcataaagctatatattcctctccaactagaagttgcaattttgcctgccacttcaaaaggattacctactgctactgtctgtacatgacaaaaggaacctgcatatatcactagcaagcacaaatcaatctcattagttctttcttttttagatgccctggttgactgccaaggtagtgctgcagatggcacctctttatcagccacaactgcttccgctttagagcttctcaaactcctccttgtcatcctcgctgatgggcgtgctctttcattttcttccaccagttcagatttgactcctctgcgtctagtcctcgaatgctggttggctgatgggacctgatcttcctcaggttcgttaacatcctcagcaaggtcatcttcaccctccaaccaaggccattcagtaccacaaccacaagctagctaggcatacatacacaaacaatttagaaagccactcctgttcatatgtgtaaagtggaattaaaaatagg

SEQ ID NO: 18711 - DNA, 272 bp, Oryza sativa
actaccatatactttaacatccccccgcagtccaagcgtgagcagcgcggacacttggactggagaagaaaccggcgagagtgctcaatatcgatgatagccctttgtgccgtagacgatgtagccgagatgaagttgtcgtagtcgtagtagcctgtcgtcgctgatattgatgcagcacaagtcacccaatagtgtgcggttgtggttcgtggcaaggatcacggcgccaagcatgagagtgtgcgggtgtaggcgaaaagccaacaaac

SEQ ID NO: 18712 - DNA, 257 bp, Oryza sativa
tttctggcatcccgccaacagtaagtttctacatcaaaagacaaaacaacaaaaatatctctatcaaattcatgacaatatactgcatccatccttagcacaagaaaatattttttagcaggtcaagatctggcaacttactcttgttactgtaccagaatctttccgcgcagctttggaaactgaagaggggttagggcttggatttgagctattgacattgttacccattgtatgagtgctaccaccaagaatgt

SEQ ID NO: 18713 - DNA, 1759 bp, Oryza sativa
  unsure (1)..(1759): unsure at all n locations
aattccattgtattttgtgttggtatcattaaggtttttattttggctgcagaaatagtataaccatactttcatctatatattcaagctcttatagcagctgatggcaatgtgtatcattttgtactgcttttctctatgatgatatttgtatggataaattccttctgtgctactggaaggaaatcaattcctttgcacatttcgttgagagaatagttaccgctccctctattggtcagaccgtgctcatcatgactggtcagactgcgccctacctcggccagatcatgcctcttgtggccggtctaaccatctcactaactgtcggtcagaccaagtaccaggctggttagatcgggctacctatagccgtcggtcagaccaagtacctggctggttagatcgggctacctatagccggtcagaccaacaccctggagccttttcctgattttgtatgccacaactaatggtaccgatgttaattgttatttgattttgtatgccacaactaatggtaccgatgttaattgttatttgccacctataatactgttggtcatgttattccatatacacatggtatttgcaccgataattgctataagctaaaccaaaatcatcaagaagatggattggctcaagacgcgtagattactttcaaaactctgttgcgcctttacattttaggccataaatataagaggatgatcaattaagccctaaaggctagtaataattcaatgtcatataataaatgttgatacttgtttgtgatcgttgcgaaactttgtaaagcttgactgcatgcacgcattagtcaattttataaagatgtgcattaaggggacataaatgtttaacaattagccgggtcctataaccttatttcttaaaaaaaagaactatttagacttcattaatatgtcaaccattgtattacaataaggaccaatgtttacttgtataagtatagagttcgtattaatgcaatcaaaatcagctagtaaattaatttcgaatggaagttcccacaaccagattaaaatagggcttttaaattttttttacttacatattgtagtgtgattntgaacatnnttcatatttngtgcatcacatagcattttgaacgagcaagatataatcgtctttttgtttcatttcatccatcatattgaattgggacnattttattcttgctgctactttgattccgatattgtttttccctattttttggttttcattatttcttttcaaatattttttatagaagttagtgggtccaggattgctaaactaaaaagtaacaaaacaagaaataatattatttcaacttaacagttaacctttctacccgtggagattttgccatatgcaaacaatacccttgagtcattttcctatcccaaatccaaattcatgcccccaaacctaaggcaatagcagctcagccaggcggcgaagaggaggtgatgacagcggcagttccgtgtaggaaggaggcccagccaggcagctgctccttgtagggaggaggcgacagtggtggcccaaccaggcaatggcagtggcagctcctcacagggaggaggaatcggtgatagcctggctaggcggcggcggctccttgtagggaggggtgacggtggtgacgactctgcataaggaggagtcagtggcctagctagagttcaacgcaggaagacggcaggtcagtgcgatgagatggcggcggcttggtgtggggagg

SEQ ID NO: 18714 - DNA, 662 bp, Oryza sativa
gtattcaaatccaattctgtttgatatgctaagttcctaattttaaaaaggcatctagaagctgggtaaaaaatacccttctctagaaaaaatggttcttcttactgacaggttagaaaatacacttctctaaaaaaaattggttattcttactgaccgaaaatacccttctcagaaaaaaaaaggtttttcttactgaccgtgcaaaatccgattatagctgatattatgatgactcatgtgttataccttatgcagcagacaacaattttggaaaatcaatttgggttaccttcacttgttgataaggccacagctaacacaacaaatcttgtggcatctgcgtcatcttccatgacacccgatgaaataggagaggggaaaaacaatccagatgaggtaatgccattggcatccatcgcttgtttattttagaaatcctatgtaatgtgagtgctttgtgttatctgctgcttgcatagcttgaatgtagttttgtgaatttcacaggtgtttgtatgtatatgtggagagaagcttttattccatacaaacttcaatacaacggcagtaaaagaacttgtcgtatttgctctccagaggaggaacatcaagtattgtgatatttatgtaacatggtgcggaaaagttctgaaaggaga

SEQ ID NO: 18715 - DNA, 651 bp, Oryza sativa
actagacaatttcttgttgtagattgttaaacacaaactccgacagaagtaacgggcaaatctcctaatatcaagggataagaggccacgacaaattgtttatcagagcgagtacaataacaggctacaaattagctatatgcacatgtggagaagataagataagagagagaataaaagcggtctatagatttggagccaactgtaacatagactccaaagcgttatgtgtgtatgagaggtgggaccatattttaattgtgtagtatatatttatatataactattgtttagatgagttattaaatgggctatatatgatttgggtaatagttggccatactattaaacttgctctcaggtgcaacgagacacatgctttagtaattaatcgtttaattgcaagtacagtgatgtgagttaagcagggatgcagtcagcatcaatatgggttcattgggcattttttttctgtattgataatgcatagtgcccatattaccaaatttattacgctttgatacttgtggtgttaacagcacgtaccattttgctgctatcttgctttctgaggtggaagaggacggtaggtacaacagcattaaagagaaggccacatcatatggatctggaataaaaactttccggaca

SEQ ID NO: 18716 - DNA, 910 bp, Oryza sativa
aagtactcagttggcgccggcgatccaatcaggatttataccaaactaaacgaaattgaagttatacaaaaaaaaaataaagtcaatcgaaatggttggcgacatagcaaggattagccgtaccttctgatgtgctcccatatttcaaaattagtgtgcaatcaatttgacaatggagacgggattcgacggcggcgcaacgcggtcggagcgagggggcaccggcagtgtcggaacgcggtcgaggaggaggggcgctttcgtgccggcggagtcgatttggatgaggggaggaggggagttggcggggaggggcgccggcggcgtcgcgcgcgaaggcgggccgtcagaatcgtctgtggcggcggcgggggagggaaggatcggagcggcgatggttagggttaggcggcagccggcgctgagaaatttgtgatcttgctatcgcaatttaaaatgttatcctaaactaacggaggttcactaaagcgcccttcactgaaatgctattttggatttttttgttgctagaaatgatttcgctctattttaatttttgttctgactaaaatacccttgtctcttttatctgttttaccggatcgaatcgatctcatccagcgtcatcccgtggcttcggcgttgtgaggaggagcctgggagcggcatcggcagcggcgacacccgtcgcgcctgcgcattggctccggctccagcgccggcgccggcccccaccactccttcacctgctcggctgctcctccttgttcaagatctcctgcatctgctttctggaatggagagggcaagggtacatgcactgatgcacacgaactccagctgaccatccctgatagagtcgaacaatccaatggacgggccgacgccatgcacaggggcgcaacacacg

SEQ ID NO: 18717 - DNA, 2806 bp, Oryza sativa
  unsure (1)..(2806): unsure at all n locations
atagcattttagtgaacaccccttagttaaggatagtattttaatgaatcactttgaagggatagtattctagcgaaaccatccgtttgagatagcaaaatcacaaatttctcgccggcgctgcgtgcgagagaaagagaggagaggggtcgtgcgcggggtgggggtgggtggggagcgtgcgtggggagagaggggagggtaagggatccgtgccgttggattgtatgactatgatttgagaatccttggatttgatgaatgaagtatgaaggatgtaagcagtagttgatgaatctatctatctattattatattattaaatgaatagaaaaagaagcctccacgtttgttctcatggcctataaattctcacattaatcggagaaaaagaaaattagagtccatatagaaatacaatttagaaatagctgaaattcggaattaaaaaataaggaatattagaataggggactagagtccatatagaaatacaatttagaaataattgaaattcagaattaaaaaataagaaatattagaagaggagactagagtccatatagaaatacaattaggaaataactgaaattcggaattaaaaataaggaatattagaagtagggtatagagtccatatagaaatacaattagtaaataactgaaattcggaattaaaaataaggaatattagaagtagagtatagagtccatatcgaaatacaattaagaaaaaaatataaattcggaattaaaaaataaggaatattagaagtagagtatagagtccatataggatttttaaaactaactaaaattgggaataaccataataaaattaaaagtagagtttagagtccgtataaaaatacaatttacaaataactaaaattcgaaattaagaaaaacatgggaagaagagtttaaaatcaatataggaatacaatttagaagtaactgaaattcgaaattaaaaattaaagaatattgaaagatgagtttagagtccacatagaaatacaattagaaataataaaaattcagaaataaaaataaataatattggaagaagagcaaagagtatatagaaatacaatttacagaaaattcagaattaaaaaaagaaaatattaaaatacgagtctagagtccatataggaatatatataatttacaaataactaaaatttgatattaaaaataattaataactaacacgtatataaaatacaatatggatattacacattagtagttttgtaaagttattgcaaaattttaaattatgttgtcattttaatatattcgaataatataatgagaaaacatatatacttttatatgagagataatataacgatgctatccgcataatctgtgcgggccaccatgctagttatagggtagaagaagaataatcacctatttaatctcatctctcctagctaaggaagagcaaggaccatcggcgagtggccgcgagcccgacctagctgaccgtcgcgccggcgccgcacgtcctgctcatgcagctcatcccgtacccagcgcgaggccacatgcagcctctgctccacctcgccaccgccgccctccacatgcccgccgcactccacgtgtgcgggcgcgctccggcggcaacggcagggtggtggccgtgctgtcggatttcttcagtggacgcagtcgctcgccgccgaggcgggcgccccgcggttcgtctttgcgccgtccggcgtgttcgccacggccgccacgcactccctcttttgtcgcatgccaaggctgccgtcgccaacggcggatgcccggtcatgcgaaggagggatcgcagcacgagctgccacggcacggcagggaaggggtgccacgacgcggtcgtgcagctctcggcaccgcgccgcgcgagctccagctcatcggagacgggtggcgccgcggccccgaactcctccacgagccaccgcgcggggtccgcgtcgacgccacgggcgaagacgaggagcgctcctgccgccaacgccgtgtcgttctcccgcgtcgccgccggacctcctcgtgacccctggaggatggagagaggagagggaagagagatggagagaggagtaagaagggtgagaatgacatgtgggcccacgtgggccgcaccattttttaattcattcttttggtgtaactgacatgtggggtcaaagtttttattattttctaaatcaaattgccacgtcaatgccacatcaatgccacgtcagatgaagaccgaatcaatttagccacgtaggcgccacgtcagctaaaaccaccgtgcaaaccgccatgggacctatattgcattggtttgacagttgagggactcgttatatctggttttctggttgaaggacaaaaatcggattcgttgacaaattattccagaataagttcactagaggttcctcaannnnnnnnnnnnnnnnnnnnnnnncccttcaacgcaaaaccagaaatgtgtacccctaaactcacacaaaacgttcaaaagaagtcccatggcagtatcgactcaatttttgcccggttttactgacttggcgctctatgggccccacatgtgcgccgttgaggcgttaatagacgggggcgacggtgggcgagcgcggcgggctgtgagcagagcagcggtgcacgagtgcggtagcggagcggcgacgggctgcactcttcttcaacgagcttgggaggccggcgacaggcgagcgcatcaacggtcgggagcagcggatggagtagtggttaccgattccctttcatgggcccaccaact

SEQ ID NO: 18718 - DNA, 9757 bp, Oryza sativa
atcctggcacattgagtggggttccccatcgatctcctcggctgtgcctccctatgtcgcctctggctcggtctctgccagttcctagacacagtcggccttcctccagcctttgttaacctacaggagatcgttgttgtccactcctccatgcaggaccacgagcttcacgccgtgctcccccgctaccccgggctcgagagtctcgcacttgtgctaacacatgactacccgagatgcgtccatatctggtcggggaaggatggctcggacgacgacgcgacgggcggagtaggccggccgtgctcacccaccgccgccacgctctttgtctagccacctccgccggtgcggcccccttctccgcccaccacctgttccgcccaccacctgtttgtcgcgttcgcccagcaccactccgctaccgtgctcacccaccaacgctccatccgccgccggcctcccaggctcgctgaagaagagcactgcccgctgccagcctcccaggcccactaccgcgctcacccgccgccgctccgtccccgtctattaacgcctcaatggcgcatatgtggggcccatagagcgccacgtcagcaaaaccaaacaaaatttgagtcggtattgccatgggacctcattcgaacgatttgtttgagtttagggtacatattttttgttttgtagttaagggatctcagaaaatctcataagttgagggacctccagtgaacttatccgaagcaaaatgggctattaatagtagagtatatgattttttttaaaaaaaacagtaaatttcataaaaccacgccaattgtttggaatgcttttgaattatggaggagttatttttttggagtactccatatgaaatgttgcgcattgtccaacaaatagtatgaaatgttgccaacaagttccctatgaaaacatgttgaatcatttctttggaattttttttgaattatggaagaaaacaaataatgaacaataaaaagacaaaagtgaaaaactctatatataaaaatggagataatttaggtgactaaatatttgatacaaagtttcatatctatttttataaaatctcgtgcctatgattcaaaacgacctcccatagagataaagttgtagagctcaatagaatctactactttatagaatttatatttgaaattatttgaagcgtaaaacaaatattatgaattttaaagaggtgacaaaaaatgaataacaacttcaacatagacaaactgcgcaggtgctgggaggaaggtatgacgccatgagacgctaattttggactatttatcaagaaatgtccacaaacatagttgtactaatatattttaggctgcatagatcctgagttacgcgtaacgcatcaatggttaagaatcctaatacatgtaggagtaagttcactcagagacagatacacacaaactaagtcaacagcacgagcactgattagacaggcagacagatatagataggtggagtgtactgctaactagcagagtaacccatcccgaacaccacctaaactagcaataatatgagatacactgtcgttgtttcaatccgccaaatactcccgagtcatccatcttgcggtgaaagcgtatgcgactctagagcctgttgcttcgtagatgttgcaaggcatgctggactccctatcatccgataagataaagtgaggaaccttatgacttactgcaaaatactgaattgagctcatcagacaatgcatcacctgaaactgtcttccctgggttcgctcaattgcgcgtgcaattgagatactgcttatagcagtaaggtacagccttccgtaaccagtagacatgccaatcaattcgaaactgttgttaagaagaggagccccaaattcggagtcctcagatatacaaggattacactgaaatgctatatcgctggtagttccgctgattaaaagaaaacgacagaaatgaattagaatatattcaattaacataataaaaacgaagggattggaaaagcaatcaattgccttgacttacataatgttcccagaagtaaccctgcaatattcaggactgaagagatggatattctcatgcaggctgggaagcgtttcacacagaggaatctcttctacatcggtaatatcaaaaccttccggtatggaaacagggatcatggcgatatcagcattaaatagaatgtgatctgtgtcaacaagaattttttcatactcaaaagtcaccccgatccctaaaacttcctcataaaagtaatgcccgcatgttattacgatggcattttttgaactcaggccaataactatgccgaatatgtctttatcgccaggtgggtatgtgacggtaacacaaacaacacttctgctaatgctgcgtggaatctgggattgaacctgtgcataacgcaaaaggaggtttttggattcgaaaagaacccaaaaaaaaaattgtaagactaaaaaatgctacaagtaatatgagaaattcgcaccggctctgccatatagggcagctctggatggcggggagtgtcgtcttctaggactaggaggccggagtagagatggcaacgggcttgtacgaaaccacccccgatggccaccgtagccgttcactgatccgatgggatcttttcaccaagacggggaagagctccagggcccaggcaatgcgagcaagacggcggccggcggcgttgctcccagatctggatgaaaaagcgaaggagcggtgagcgctggcagatctggagagagcggctctgggagatgagatctggagagcaaggaatagaagagagcgagaaaacgtacccgcttgcgctgccgccgctgctgttgcctgctcgcgccgtcgcctgctcgcgccagcccgcgccgccgccacccgcttgcgctgccgccgccgttgtgtgattggggtaggagaagggagcggggaattagagtagggtttctagttggatatataatggcctgtttggcacagctccagctccaaccacacctctcctgaagctagagctcagccaaacagtttcagctccacctaaaatgggagcagagctgggtggagctctctctcaaaatgaagggcctgtttggcacagctccagctccacccctcctggagctggagctcagccaaacagtctcagctccaccaaaactgggaatggagctctctcacaaaatgaactagagttgtggagctgggtttaggcagctctacaactccactccagactcaactcctggagttaaatttaggagttggagttctaccaaatagacccgaactagagaggtggagctgggtttaggcaactccacaactccactacatacccaactcctggagctaaatttaggagctggagctctaccaaacaggccctatatatacaaaggcggctccatgaatttttcactgggtgctcctactccacgatccaaaactttttgacaccacgaactcaatttatacatatccaaattttgctcagacacaaatatgacaataatatctctaacatcataagtccgataaaataggcatttgagtcaaaaaaattgcaaaaatataacagtaatagtccaaatataaaaaatattacataagtagaggattacagtactacttcttttctactctatgagctctcgtacccatggaagtgttaattatgtcatctctttcaatgaaagtattaaacaatcattcaacaatttgtcacacgtacaatttctcggcttattcttcactagacataatgcagaaaacaatctctcaacacttgttgttgccaccggtaggatcaataccaatttaaggagcaaataggccaaatcatagaggacattgtttgtctcgacaagtttaacagagagctcaccaagattttgtaggcttttgaatctttcattttgtctcatgtcttcaataaaattcgctgcttggaattattgtcttattatatccatgcttgaaatgtccttaggataaaacttggcaagcttaagtactttttgtgcatcataagaagcaaatgaattagaagggtttaatgcagccatgcaaatcaacaactccatattaacctcatcaaacctattgttaagctcttggctaatcttgtcaataacaccaatataaacttctcttctgaaatgatcatcatttgtttggtccagataaaatcttggagatctcccatgaggcacatatttctcatctaagagtggaactttaatgctatgcttagtgcaaaatgaaagaacagtcccttcatagaattcttcccaaccatcatttcttaatttttgcattcttccctttgccaaagttactagtgtcattgcattcacaatatcttggtctctcttttgcaaagacatagacaactcatttgtatatccaagaatggcaagcatcaaatgagcactaaaaacaaagtcaaatgattcaaaagccccaaccatagcatgtttttttggccaatcgtctctttgtgtgagatctttaccaagagttataagtacatcctgaattgtgctatacataccaataatatgcaatatagttttaaaatgagaaccccatcgagtgtcaccaggcctagctaatcccatatcttgatttaatccaatcccactttctatttcacccaattcaagtgcttccacaagtttttgagctctaacatctctaagcatgtcatgacacttacaagaggagccaataatattcagcaagtgagagacttgagtgaaaaaccatacacaatcatcatttcccttggcaaaagaaacaagaaccaattgaagttgatgtgcaaatcaatggatgtaataggcagaaggagactctttcaaaatcaatgtcttcagcccattaatctttcctttcatgttgctagccccatcatatccttgaccacggatttgagtaagagtcaagtggtgatcagttagttaagtctgaattgctttcttaagtgaagcggaggtggtactagctacatgaactactccaaaaaaccgctcgcatacccttccaaatttgtcaacataatgcaaacaaagagctagctgttctttatgtgaaatatcactacattcattagctagaattgaataatgatcatcaccaagttcttcaatgagccgcctagtagtttccccgtcacaacattagataatttgcctttgtatgctagaacaagtcaagatgcaatttctaggagcatttttcaagaccaaccgatcaacttcttcattatttttagcaagccatttcaaaagttcaataaaattccctctattgttagactcttcactttcatcatgcccacgaaatgccaacccttggttcaaaagaaatctcagtcatctaagtgaataagttagcctagccttataacaaatgatcaattaatatagtagctcaattagagagcagattttcatggatgccaaattttgtggactgaaagtaaagttgtaatcaactaaacatctataagcattgctgaagtgtaaacaataacttcaggactgatcattttaggagcatagtgacaaagtgaacttaataactaggttagaaacaacttctataataagagagaagcatcttcatggcttattgaactatgctgccttgcatgtgaataaacctcaagatacaaaagggtgataatttccttacacctaggaattttaattttaatttacaacatgtatacttatcgccttgaaattgtatgctgccggagacctgcgcaactaggggcaaattgtcaaattatagaatttgagtgtttgtcaattgcaaaaaaaaatttaatattaattgttcccgttgcagcgcacgtgcacccaactagttgctaaaagaggagcatgccattttttcccctactttcgaaatgaattcatgtctgaaatgtgtttcatgggggctgcttacgtccttctatcgtggatgaggactgagaacagtgaaacaagcttttgaattttcttcttgttgagattataggcatataatgatttaatctattccataaataaatcatgacattacagatgaaaactagcatgaacgcatcattagatctacacatataaactacacagtataacatgaacagatcaaatatgcgcaacatattgaacacgtaccgaggtggtagaaagaccggctactcggcaggaacttttcgcgattgcaagcgtctacgaaggcacgcagcacgcgagcgaagaggaagacgagccgtcgcggacgaacagggagcagtcgcgcaaagcgcttcccaaaaaacttattgccgccttctcccggtgcagaacgtcgaaggcagaggttccagagacctgctctcccgatcgcaggtgcacgccgacgagcgggatggagtaatctacgagcgacggcgcagcacagagtcggaggcaaaccctagattgatttcgcgtgtgttgcgtgaagacggcgggtcgatttatatagagaagggtcacttgatcagggcgcccgcacgatctccactgcgcgtaaccgaactggataagtcgcgcgtaacttatccggactccacgtcgttttgcacgcaacggatttttcggaacgtttccaaaacaaaaatgaatccaaatttgcggcaaaacaaaactgcaaaaggaggctgcatctgcgcaagggtgaggagccaattttgcggaccattcgacgcgtatgtcgtgcacgcgcgccgcctgccctgccctgccaggcaagcgagcgcgcgcgtgtttcccctcttctctccactacacatgcttcaagtggctaggagggcatcctcccttttaaggaggtccccctctcctagaataagcaaggtggtactaaactccacattcatgccatcccatgaggtgggctccacgcatttaacaggtcaagaagcttcaatcaggttgaaggcagctagctggctgaagctaggaacatgttaggatttgtttgacagcaaagaggttcttatgaaccgttgataaccacatgataaagttcttatgaaccattgataaacatgtcggggagaagattagcttgacagcaaaaaggttcttatgaactgttgataaacatgttactttgtttcgctgtttatgaacttttggccctttttccctccctacatttcatgtgtttgtttgttcttgtgtctagagatggagagagaaaaagccagataattgtcatggatttctttttctcttttcttttaagtccgaattgtcatcatcatgaatttcattgataagttccttttcttgtttcaagtggctcttttgatagaaacgctagtgaacactcatgaagcaataagcatgttctgaacttttttttgtctagatttgttaagatcttgttcatgtttatttggaatatatacatgcaagttttcattggatcaagatgagacaagaaatgttcttttcgttcccctctttgcctccacggtcagataattaaaagttcagttcttgtggcatcactatttccccttttttttttcacagttgcttcctgtatgtatttttccacttttctggctagctccaaatgtgatgggttagtcggcctggattcgaagcttcacctcttctatttatttgatattaggtcattccctaatatttacgttttttaatcaccattgtaacttgtaactgcatttgttcaatgattcgtttgtaagtgaaacaataatgtaagtgacctcctgcttacatgtacaaaaacatgaactggaatatcttacgatatgatatttgatgaggacagcagcacacaccttgtccaatgtccattaattgctcactaatttttagataatggaatataacatccagaaaagtgtgtagttcagataaaataaaacacaccaaacaaaagcagaggaaaccaagccaaaataaggagaactcatttattcaagtctatttgtgaatctcaatccataattagtaaaaagttacataaccactgtctccaacttgtgacatgcaacttttagtaatggaaatacttactacttattaatggaaattcaatagagtccaaggaaagtaattaaggaaaaagggagaaacaaatggtgtatccactatccagaatattgatgcttcaacacagccaccatctaaagccgtacaaaagcaagttatttttttgaacgaaacaaaagcaagttattgtcctagtcaaattcaactaagttcaaatccatcatctctctctactcaaaccagcaaaaacaacttttgatacattttcatatgcaactttcgagtttttaaatgaaccaagaaatgtgaagcacttgttttggtaagcctttgaacaactttcaactgtgcacatctattgtttcctatccccgaataaaatgtaccccactcatagaaatgttttttacacacaagtgcctttacagcagccacagtgtgtccaacgcactttacaaaagtacggagtagtagttcacgctataattagaagtttgattgaaattggaacaatgtgatagaaaagttagaagtttgtgtatgtatgaaagttttgatgtgacagaaaaggtaaaagtttgaaaaaaaagttgggaactaaaccaggccgtactactactacgaagtgaaaggaaagggtttactgcgtgctgaccctcaagagctatgtaagtatgcaaccaagaaaacactccagactgcaagtttaagcaaagcaacagtagctgtttgcaattgcttgttcaatcatcataactatcgctaaacaaaagaatttatttcactgtattatccaccaatgcgcaagccgcaagcaccaatttttacaaaatgcaacagaagttatcaaacaaaacaaaataaatgctttagacaagatcagccaagcacaaaagagaactcaatttattcctctttttccgtccctcttctgtgactgactgactgctcgagtgctcggggatcaatcttctagagaagggaataaatagaaacagctttgatagaatttatttcaaataaaatcaaaattagcaattagtaaagggcggctaaaattattttattgcaaacttaatagattggtatatactacgtactgtgcctgtcgaggtggacgataatgatgaattgggagaggcttaattaggtggagattggagatcaataagtggaattaaggatgacctctgatcttcacattagtgattagtgatgacgtttttttgtgcgcaattcctcttttaagtggctttcatgatgcgactggatttagtaacgggccgacgacggaaacctgtttatttgggcctgattggcacagatggtagtgccatgtgcactcttgaaacgttgatttaagatctaacggtttcagctaattggggtgatgtggctaattctcaaagcagttttatagctagtggataccaactataccaactatacagaaagaagggattcctccgtccaaaaaactggacgtttcactgccccggcgctgtaaaaaaaagtgttattttagcaatttacattcatggaaccagaacgtgccgagttttgatttttttccctaccgtgatggcatctcgcgcagggttccccttaccttttatggcgcgattaccgccaccccctccccccccccccgcggtaaggcgg

SEQ ID NO: 18719 - DNA, 5729 bp, Oryza sativa
aaaccgcgtggtaaccacgagacatacccgtggttttaaaaactgaaaaggttaccgtgcatggtaaccgcgcggttttgtaaaccctggtctctcgtcaatttagtcggtatggatggataagagccacatgcgtccgttctctctctctctctatctctttcttctcctcttctcccctcctccccttggctctctctctccatctccaccgcgcaggagagcgcaaccctagctacagcgcatgcaggggcttgtcgtctcctctctttcttcttctcttctcccctcggctctctcgcaccctcccctcgcctttctcgcgcgtcggcggcggcaccctccataggaagggaggcgggggcggcagcggcggcgtctgcgcctcccctccgccagatttggccgggagcggcggcccggcaggaggggaggcggggacggagggaaggcgacggcccggcggcggcgaacgggagcagaagcaaaaatcttgtgttcatgttgggttcttgaagtgaaagtgaaattgctcgatgcatcggctcgatgcgtaatggatttgtgtgaattttattccttttctttttctggggttatcagtcggtgtagttcttatatttgaaagtgatgattgctcgattgggcttttaatccatctttgattttgtgatttgcccgccgtaagcgattaggattttgaatcgatctctgattcttttgtgaattggccagcgtacgcaatgaactcatacggatacggacacaatcagtgacgacgcgcaaaatttgtggcaaaaacatcttaaacttttataatagataaagaataatggtataaaataatagatccaccaatttaaatgaaaatcgacggtaagattatagaatgccacgtggcaatctgggagtgcttgtagaaacgccacatgacggcttagaaacatttatagaaagattaatggacttttagtagataatagatatgattaagtggagccaggtcttatatatttctagtttcttgatccaatagttataattctagttccagatattggctccaggatggctacggttcttgccgtgatgctgtcggcctgtcgcaggccgctgccctcctcatccacgcacaagcagtcaagcacctctcgtagaagctaaacctgacctggtgcagtagcatgcagagcatgcgtggactaagctacgatttgctgcacagttgaagcatgaataaagggctattatgtcttttcaaaagaactaacggtgcagtagctgatggcagtgataaatcgtaaccataacaaacttagggcgtgtttggatagtgccctgacctgatcgctctcattcagacgggtgcatccaaccacagaccaccaaaatcggacgcctgagaatcgtgcctgacttaggcgtgattctcagggtgtgaagcaaacaaacccttaatgacatataatatattttctccacaaaagcaaccaacgaccagtcgttgctgaaacttcaacaatagttgcaaatagataatatccaaaggcgccaaaataagagcggcagatattaaaatgtcaatagttccaagcatgtaggagtacttgagttgatcctaaaggataggctaacaccgctctaaagaatagtgctgcatctcgatgcttacagataatacagacgcatgtgtagaaatgcttaagttgatcttatctccatgctaacagattagcctaagtacggtactgatataacatctggatcaagtcttcaacagggatcgtaccttcgtccacctgaaaaagattaaaataaataaacaatttactttagcctacaattaaacaaatagttcttttagcctacaatttagagaaggataactcacaccaagcctcgtttccaaaaaggtgatcaaattttcagtgcaaactgcaagtgatgcttggtatgcgccacgccctagtattccaataaccttttcttcatgcaggaggggacttccagagtaacctgctttgtttgggcatgtaaattgaatctctcttcttgttatatgaggaccatattccactttgcatggtgcactgcagatcaattaaagaaaaaaaacacgatttttttgtttattagtacacagctcaacgaagataagtttaattctcctaacaaaataactgaggtacaaaatataccttattccacctggggatacagtaggtattgttggcataattgcagtttgaatattgcagcctgggagttgctccagaaagcagtttcctaggaggaagacaggagtgccgactggcaaatccactcccggggcaaaacgcaacgccggcagcataattggcatgttactaactaagatgaaggcaatgtctaaaaatggatcttctaatattaattgaccttgcatgtcctcttcaacaccctgcagaaacctaatacgcagcaaatccgtagctgggtcaaagcccttgcttcctttgaccacatggcgacatgtgagtacaatgcacttgccatctgctgtagaactgatgataaatccagagcccgcaccatgcataacgactcgacggccatcaatcactttgacagggtaaacgataacaatgctgggccgatgttgacgagcacgctccacatcgacttgaggtggattggtattcaaattgagacctaaaaagaaaatgaactactaatttggttaaaataaggaacccaagagtaatcgaaagggaactgacacattggatggaactgaggaaactgcgatcgagcggcacacgcccgcaacccgcgcaatgtcgccgaccagaggtacttccctctcgcgcggcacctagctagtccacgcgatagatcgatcgaggcgcgcggctgctacaagtcggggtcgggcgcgaggcagacgtcgccacgaccaccaagcatatgctgcggccgcagtgaggaaaaaaaaacatatgtatagtagagagagagaaaaaatacattaagcaaagaaaaatctttcttgaaaagaaaaaaacaatgcgaaatatatactctgttgctcatacgaatcaaaccaggtaagaaaaacatacactattgctcatacgaatcaagccagcaagatataatatacaaagatgatgtatgcggagagggagaggtggcgtaccacggcggcgatgcctttgacggtctgcgcccctccgccctcgagtacgtagacatagcaggcgtgccaggtgtttcatgaatggtttcatggttgatgagaggagtggaaatgagaggagaggggaggaagaacaagctagaggaaggggaagctaaagtggagtagaactgcattaaaaactgtgagagttctcttccgtcaccatggtcacgagctgctcagctctgctctctcctctctgcgtggtttccacttacgttcataacattcatatgcagcagattttgaaaaaggtgttgacctcccttttttcctatttggtgaagaagctccgctgtggcgctggagttctttcttttcgtttgcacaaaacccctcctacttgtttagaaatattatgttctatagttcacaagtgcactttttggcccaaggtactctaaaaacatccttttcatatgacaaatgtcttcggatcttttacatgcatttcatagatttttgttcttgcaaattgagcagatccaaccttgacgaaccagattgagttcttggcgtccgtgtttgttccattgccgccgcacttcacttctcaacttcggtactcggtagctgctgctactacttactggactacctctgtatataaaaaatggcttcatcatattcaaagctaatttccttttgggaccgaggtagtaactattactaaacggcataccaatactctacaacatacttctttcataccaaaataaacatatgtaatggtatacaaatactctacaacatacttcttccatcccataataaatatatctaacggtatacagcaaataccgtattccttccatatcaaaataaacatatctagaattagatggaatattatctggtgcaaagaatctggacatgtttttatctagattcgttatactaggtaatattctattatatcttaggttgacttattctgaaacgggggagtaagtaattaggcaaattttacaataagacaatgcgactttacgattttagctcctaaacacgtaaaagacaatctttggaaaaaaaaatacactgtcaaaacactgatgcttgctgctagaaatcgcatccattaaaatatacctttttatcaataggaaagaaaaacaacgtggtaggtcaaaaaaaaaaactcatgtcagtccttccatctctctttctccctatccccatgcatcgctccctcaccacgcctagtgtcagttaggcagcaccattagcagcgcgtcgtgcatgtcctgccggtcatgcccgcgccgcacgtccctcctctctatctcaatctctctccctctcttcctccctaaattaatgtggattcttctcaatacattcaattttgccataattttatctttacatttgatacctcaaacaaatcaaccaaagcagtcaaacaatggattatttctaaaaccctaattggcaaaaacattgcatcactcaaatatgtattaactcacatgaatgtgtacaggtaacataatttattcaaatattagtttatttatcatacaacaatatatttttccagaatttatttcatcagtttaaaccttaaaataaattcaaacagtgctccaacaagcctcttttctttattttcctgagaataatataccctgaatttttttagtgcaacttggaaaaatggaaactagacacttaactatcatcacaaaaatccacactattttatcagccccctaacttaaactattgaattacaaagaagtgaggacgaaaataaatgaagaaaatcctgaaaatcactcaaacagtatgttcagtgatttgcttacccatccttctcacgccctggacccacttggcagtcaccttggtccttgggtcgtttcccttgtgtgcaccatctccagccgaccaaaagacacagaaagaaagatagtagagcgagaaggaagcggtgccgacgcgtagcctcatcgtgcccaacgccgaacacgtggcctggtttagttcgcgaaaaaaaattttttggtgtcatatcggatatttgatcggatatcggaaagagtttttggacatgaatgaaaaaactaatttcataactcccctgaaaatatcgagactaatattttgagcataattaatccattattagcacatgtgggttactatagcacttatggctaatcatgaaacaattagactcaaaatattcgtcttgggaattcccttttaactgtgcaattagtttttatttttatctatattttatgctgcatgtatgtgtccaaaattcgatgtgacttttttggagaaaaaatttgggaactaaaccggtcctttatatcctcctagctgcctcgccttccctttcatgttcgctcctgagttgaagaaactgagggggagaacttcagcccccctcttccatctcaacctcgtcgccggccgtgaagacgacgaccgtcaccagcgccgatgagccacgattgccctctcttttcttgtgttcctcaatctactctcaatg

SEQ ID NO: 18720 - DNA, 30186 bp, Oryza sativa
gaagagagaagggagggaaggaaatgggctagggtttcagcggccgaggagagagagagagggggggtttgtttcctcgatctcgacgctcggccgtccgatcaaaaccctagagatcggacggccagagtcggccgggtcgaaatcggcccaagagggatcgagagcgaggccacttttctggcccaagcctaggttgcggcctggggagggaaagcgcgcccgcgcgagcgcaaaaggccatgggctgaccggcaagggccggaaagaagtctatttttggtccctcgggccgaagaaaaagagaagaagttcatttttagtactttatttttttagaagcatttacaattatattacaattatagttattaaatgtatttatttctaagcaaacctgcaaacctaaaaggaaggattttctttctttttctgattaaataattgttaaatgatgtttgtattattaaaattagcaattaagctttgaaattttcaataaaattccaaagagcgtaactaatcatggagaatttaataaaaataaatttaaccatgacattttatttctcacacttgctttacttgtaaattttgtttaattatacacatacctacttaaaaataccaaatattgcagcaaatttgtattttaactaattgcatatttttctgatctgtacgtttcctgttgcaacgcatgggcacttttgctagtactcccttcattttataacgtaagactttctagcattgcccacatacatatagatgttaatgaatcaaacacatgcatatgtctagattaattaacatcaaaataaatatggccaatactagaaagtcttacaatgtgaaacgaatgaaatacttaattaatcatagaaaattgcgttttccatgccgagaggatgagttccccaactcaaccaaatgaaaacagccggtggtggacttggtaaagtaaagatagcaagccaaccaaaccggtgatagacttgtactagttatagatggccaaaaggtccgaggcccgacggcccggcccatggcactccattttggcccggcccaagcacggcatggcccgatagaggtcgggcccatgccggcccggcccaaccatctgaccgtgcctaggcctctccacaagcacgttgggctggcccggcacaatgggccggtagctaggcccgatacacaaaaaaaataggagagtaaaaatagacatattatatgccataaacaaaaaaatatgtacctataatagactttttttatctatacatatgtcagcccaaagaggagggacgaaaaatagacttattttagctatacatatgtcagcccaaagaggagggaagaaagatagacttattttagctatacatatgtaagtccaaagaggaggaactaaaaatagacttattttaaaaaagacccgatgggccacccatgcctacgggccggtacggcacagcccgacagctggtgggccgtggctgggctggaagtgcagcccatgggccggatcggcccggcacgaagtgccgatcgggccgtgcccggcccgatggctgctgggccgtgtctgggccgggccgtgccgggcgggccttttggccatctataactagtactaggactagtagtactccaaatcagtactactagtaatcaccttgagtccttgacgccgcgtctagggtttcttcgatccacttgacgccgcgtcgcaggcactcctcgtcttcctcggtcgaagaaaagcggcggcggcggcggcggcggcggaagctgccgccttccttcaccccaaggcccaacagatcgaggacgctgacattatgttgcagctacctttctcccccaaagagagttggagttcaccaggcaagctgttcttttttactttcgtctccccttgttcctcgatcgatctaacagtcgcccatcgccgcctccgcctcgtctcccctatcgcttgtcctccacctaacccagcccgacggtgaaccggggaaactggggctggccttggatgacgtcgtttggttcgtcgcagaaggagacccgtctccttcttggtgtagtcgtcgtgccttgccggggcggggccagcagatgggcaggcctagggctgaattcatcaattttagttattattaggcatcatatgtttcaaaattttcatagaatttgaagccaaggcctctaaactaattaccctatgtctggagttcttgcatgtacgattacgattaggagggtggagtgggaggggaaaaggataaagcggggtggagtgggaggggaaaagaataaagcccccaaaactacaactaagcaatctgcacccatacaagcatccagatccattctaatgctcagatataaaactcactacacaagtggatctaccttaatacttataagccacaggctgaacatttaatttacttcatactagttagtttcacggatgaacatgaaccagatgtatgttcagctgtcgaccagccttcttttcgccacggaatctgcctggcactttctttgctctccgctgtgctgctctgtacactcctatgtgaccactgattgcacgtccttctgtttcactgcaaagccacagggattaatgtctgaaaaagcttgctcaactatgggcatggtggagtgctagcctcaacttttttttttagaaatgagatcattatatatcggagaaagcctaacacaatcagaaacccaacttacacacgcacccgcacactggggacactccagcttacaaccaagttctgaaacatttcactaacatctaaggccctgtttgtttcagcttaagattattgtaatctagattattaaatcagattactctaagctagattattataagctgacataaaataagctacgagttggttggttctctagattattagaggcatctaagggtagtgggtctttatccactcaataatctgttaaaagctcctctagaggagattattggaatatagtaatctggcttatagattataataatttagcataataatctacttgtttgtttcagcttactcctaataatccagattataataatcctaagctgaatcaaacagggcctaactccagcaccactcctggaaacagagagagacagcaaacttctagctcctacagaccacccaaagctagcctgaaatagcagccaactgttttaccctggttgcctggccgatccaagtttgtaccaactagcctattattacctccgtcttgtccaactatatgcagggactaaggaactggcaacttcaccggaccatcaaccttgacattaatccacctgtattattacccgctaccattcctttcgttagagctctgatgcatggttttgcagtgtttctttactgtttatgacaccacacttttttttattttgcttaattcagtcaattcagccattgggcacgtgcggaaaattaggaggagggctggtcattttctctcaagaagctccaagaataaggctgctcacagtaaggggggacagacaaccaagtcattgatctcaggtccgctggcttcccttatatgcatatcttcttttcacctctatttgagaactaacacgtgttttatagtgttttaaaccaggcgacttacattcgggctctattcaagatgtctgggctactctcagcgctgaagttgcatcaaaattgtctaaaagcgttgtttctctggctttgtctgatggtgatatatgttaccgttatacatacattcacaaatttatattttaatagtgtccccggttataaatggtttaacctgcaatcttgtgtaggaaacataccgatatatgcatgctcaggcacagctatcagttgccaggaggggtctggtacaatttttctgacttcggctagtttggttagagctttctatgatactgaagaaatttatgataacttaaaggttggtgctgctagtcatcctttactaattttcgcttgtttgcttaggatatttgtgacttgtttcttgctttgtcattatagattgaagtgcgccatgaaggcaatgaagtgtacaagggttatttggcaaaatatgatttagacaagaactttgctgttgtctacaccatggagtctcttgatgttcatgttgtactttccgaacatttgaaggataggtatgccaaaaagaagctagtagctgtatcgcgtaacaagtatggcggattaattaccaaaagtgtgatggtgggtagtcatcataattcaaacagatctgaagtttgccatgacatttcggtgatggctgaggtacactcgcattaatacaagcacattttgacacttttctgttaccatatgcgctaaactttatcagagcctataaaaatggtctttttttttctatgcaactcttgttcaatatcactttgttttgttgaaatgtaacccttgttgaccatcactttatatttgtgttaggactgggaaggtggacctctctttgactttgatgggaaatttgttggcatgaataagtttttggctatggatacaacctttatcctgtcatggatgtcaattctcattatctttaagcattatttgccaaccctgcaaaacaggattcttaaacggttacaaaatttgaaaagagtcaggtatgccttactgatgtttgcctctcgctggttcacccacttttttctatcctcttaccctacatgagtttatatacagtaggctgatttgcatgcaaacacatatgagctcttatatgttctgcaatgatctggatcaatagctgttggttcttagccacctgtaccaaggcagttgacgtccatttgtgtgtatcacagtcagtgcagtcaaaagtgttaaacaagccctcctccccttttaggtcttaagtgcaactgtgcaaggtgctagggcacacaagtgctcactctagaggaaaaacagtgaggaagaaaaaaaaaaggatgaataggctaagctgagcttctcatcctgcctcctttggccaccttcctcgcctgtcagtgagcttggtccaaaagctactgctttgccctcctaggaagcactgtgagctcggtctggcagctgtgcgagcttggtctggctaggttagagggaaaggagaagggataggggcatgcatggttgtcattatcgtgctgagggaatagtagaggggcaatgtgtggcacacaacgagagaaccgtgctgctgaacagaggataacgccttgatgcgtccttgtctgatttatggtttttgaagaagcaaacggaggtgaatgagcactgtgggctgtttggttgattgagaggtaggactagtgggctagttcatatttgtcagatgcacgcctgttttccccatttgctcttttcgcctaaggtgacaagatgacagcgtgcattcgtttttcacttgaaccaataataattttgctgtataaattagtcatatttcttgtttccattggtgaagcctgttttgtctaatttaaaggaaatgtgcacactaaagggattatgatatttcacagttctggtgatcttttgatgctcaacttaccccttgttttcttgaaatgtgggtacaaacccacacaacttgggatcctcttttctctctctgttttacccttgcctatgatgctaccgtggtaggtttttgtactgtgttgcatattaatgcactggtatgacctgttttacctttgggttgttgttcttctgcagggatggagagggaccgggtgagctatctgactgtcatccagaaggtgagcatagtgccataccttgcatatattgtggttatctgtaatgtatctatttttaaggttctcactggtggtgcgggattagcttttacatttgaagtttctattttatatgaacttatcacatctaatagtagtgtatttcagtgctaatcagtaatcatttggccttgtgcagcaccagttcatagaggtggtctcgataaggaacacgttgagtatctaaactccttgggttatcccaagccaccagtaaacgtgttagatggtgagtcgatgtttgtaaatttgctaacttattgcgcaccacaccttttgtacactattgactattctaccatgtatcttcttccagatggcttgatattggcttattcttttgaggagaattttggctttgtatatggtgaagtcattaaaaagtttccttgtgacatacatcaaagtgttgttgcacttgcttcattcaaaggtgattttacactaaataatataatgtgctattcatatttgcatttggtcctcactaataaacaataatcaaaactatgcatgtgtgcaggagaaaggagatttttcgcatgcacgggtttttttatagaatggaagggatgtacaattattctgacatcagcgagcttggttgcagagtctggtgacagaaacaagattgatgaaaacttgagggtgggtgctaattaattagctcctcctacttattctgctctttgtttaagtctcactcacttcattaatttatttgcagattgaagtgttgcttccaaacgaacaacgcagacaaggaacattacagcattatagtttacactacaatgttgctctagtcagtgtcaacgacatggatttccatgctcgtccagcaaatatgaagcttgacaatgagtgtccacctcaagtagcagctctagggcgttgcttcgaatcaggcaaaataatggctgtatgtggggatttggttgactggactggcacacttgattgcaatttccttatacgttcctcatgcaaaactactaaggtatgtaccgctagctagctgttgatttaaaatttcttgtctatttatacacggtgattgattacaaatgacaatttgtccatgtcactcaacgtaggctggaatcggaggacctcttattggtttggatgggaaagttattggcatgaacttttatgataaaaaaataggaaccccttacatgccatgggatgtaattcttaaaattctggcatgttttgagaatgaaaggtatttgcggatttcttctctcttttggttattcaagtgcttgccatctgatgtcttcatgttatttttttttttaaaaaaagacttggctgtaagatttgctaaatataattcaatggtgtgcttggcagtagtgctgctgaagttggcaatggtagtgatccatctgatgcgcctggctggaaaatccctggagatggcagtgtcaagctaaacaggttttctgatattatatatatatatatatatatatatatatatatataacagtgccaagttacgtctcaaaatcctcatcacattgcgtatattgaactacatacaggtggcctgtgcccttgccatattggcgtcctcatgacgatgtggaagagcaagaacccccagagggctgtgaataccagtgcacatacagaaatggtgaaagatggtgctaccggtagaatatgttcgttctactcctctctctctctctctctctctctctctctagtagccctgtaatgttactacatgtcccttgccgtgttttgttttggtgtgtatcgcactgggagttgaagaacattcagctatggtgatgctgagatgttaaatacaatgttaagtaaaagtagcgtgtctatcttggatatatcctatttgttttttaaaaaaatcccaaagtatttggcaggacgggaagtgccaaagcttccaacttgaaacgtattgaatttcgctttgtggatgctgcacgagtaaaaccgatattgtgcattatgtgtttgtgtggaaatataaggggtgggtggcaggggatgctcatgagatggtcgtctagcaatgtgtacttgaaattgctacgggttttattaaaactcagataattgctgtgggcctcatggttcagtccatggacagatttcattaaatattggctcattattactacttgtaatcgtaatcgtgcatgcgcattgtactccctcattttcatactacaagtcgttacttactttttttttgggtcaaatttcttgactaagtttaaaaaaaaatatatattagtatttttaccaaaaacaaacatattgttaaaatatattcaatgtgagattaaatgaaagtactccctctgttttaggttataagacgttttgactttggttaaagttaaacaagtttatagataaatatagtaatatttataatacaaaattagtttcattaaatcaataattgaatatatttttataataaatttgtcttgggttgaaaatgatattgtttttttctacaaacttaatcaaactggaagcagtttgattttgactaaagttaaaacatctgataacctgaaacggaggtaatttgctactccttccgctccaaaatataaggcacatgcatacaactacccttaacccaaagacaagaaacaaattaccctaataaatataatgcatgcatccaataaaattagagatgttaagggtgaaggatttaaaaaagtaataatttaatggggaagatgttctagttaattatatgcatacatgcatgtcttatattacggaacatctaaaaaaaagtagttgtgtcttatattatggaatggatgaagtaatttttatataaactttgtcaaatttaacaaagtttgactaagaaaaaaagtcaaataacttataatatgaaacggtgagagtatgtcttaagcatattacacgtagacaatagtttattttcttttttagtcaacttgtattatctatttttaggcttgagttcatttctatgtgttcccaacccatttctctcgtattccatgtgcatgcttttcaaacggttaaacaatgcgtttttgcaaaaaagtttctatacgaaagttgcttaaaaaatcatatggattcatttttgataaaaaaattagctaatacttaattattttatgcattatcggacctctatgtttttccgtgcgcagcagctgcattcccaacttatggaaactaacacagccttagtattaactacttggatttcatataaaaagtgcaatagaaaaaaaaaactggcataattttatgtgaaccaattatggtcaaccaaccaacagatagtgttgctaggagtttgggggcttgctagggacgcgcggcgttttttttttctttttgcgccactttttttttgctttttcctttttttttcgtgcccctcccctcacgcgttttcctgattttttgtttttttttcattaattagccggcacagcgctagagagggagaggagcgcgatagagaccgtcacctcagtggagggagagcagcaagcgtgccgggagcccgggaggagttcaatggaaataaattgctaatcgggcggagcttacggttgttactcttacttgttagtttaagtgtgttggcttaatgagcatgtgcttaagaaggagagaacaagcaggagcggtaggatgaaatagacggcagatatggcagaactgcacgcccgtgacgtttctttggtaagtcagacgatccgagttcatccaaagctggtatgagtctgaccgtctatgcatataatccattgcaaacttccaatatttccatcacatcaaaaattttctacacacacaaacttctaatttttccgtcacatcgttttaattttaaccaaattttcaattttagcgtgaactaaacacaccctaatacactaatgtcaattgaaatgctgaaaaaaatcctagccactttactaatgtgccaataattcatcaattacagctacatgcttggcaatattattatttagagaagaaaatatttgcaataataaggttgtgtttgacttcagatccaaaattttataaagttgtatgttcctagcttcacgaattcacggaactgaatatgtgataccgtaacaattagatggattatttaacatgcaaattttaaatttagtgtggatctgagatctggagtagccaaacggatctaaggttgatgcattgacaactctaagctgcgatgcctaatgtcgacgtatggctacaaaattaacaattaaacatgcttgttttcgtgctaaatgccaacactatcaagattaaccgcctagagcaatggatcaaaataagttggagttggaagtactaccttcccattttttttcttccatttcaatatttcccgagataatatttgcgagaaaaaaatattactccctccatttttttcattttatgctggttttcataaaataaaacaaaatgtaaactaattaatgacttaacatacaaacagggataatataataccctattatgattccagtttatatctatttgtcacataaattttcgttcgttgtccccgtgcacaatcatcgagcccacacatcaatagcatcattacacaaacatatctttgtgatcaaacttatccacaataacattaactggtgcaatacacgggcaatgtgtcttttaaaaacatggaaacaaaatatgccataattagaactccaaaccatatataagtcgataataataattattactatgattgatttcgaaatttttttaattttagaaaatatagagtgactataaatattagaactgcttaggagtatatattgcttgtatagtccatccgtttcaatcaaacatttttaactttgattattaataaaaaagatcaatcatgtaaaattaatgttcctagatttatcattaaacaaattatcgtaatatacaactctttttatttaaaatattttattttatagatattattagttaaagtagtatctcggagactgtgtcaagatctaaaaaacaattatatattttaagacagagaaagtacgtactcactcagatcaataagagcaggtataatagtaggctaagccagctgtaaacaattatatattttaagtcagagaaagtacgactcagattaataatgcccgatattttcctcgggactgcctatacatttgtcgggtgattttttaacaagaaatcacccagattttttttacacttagatttatatccaacggactacaaaataaaataacaaatacaaatttacttattcaacatttttatcaaaattatagtgcacttatatgtcatatcaactaaatttacatatgtagttttagttatataggactgtaattttatattttaaatccttacatgtcatatcaactgaatttacaaatgtaattttagttatataggactgaaactttatacaattatagtgtaattacattgtaacttacatataattacagtataattatagtgtaacttacatgtaacttcaatgtaacttttaaaacaccgctagtcatacgaaatagtcatcacgggagatctctcacccgtattaaagtagtattatcgttcaatcactttcgttctatacagtggcaaagctaaaaaattaaagatgcgtacaataccctcacttagttatcagtgccttgccctaatcagatgctaatcggtaggttgaaaaaacgtcaaattttaagtaaaaaatttgacgacagatttataggaaaactgttttcctcgggcttcggacgccgacgggaaggattctcgataacttccctcctttcctcaattccgctctgcacggacggatttttcatatccttggactcttccgaagttccaaaacaaaacaaaaaaaaaagaaaaaaacagaaacaaacaaacaaatccgtaaatccccgaaattccctacgaaaaacccagtcattacctacatcaggactccaccgaacgcaagacaagagtaaaacggaagcaactcccagcaacagatcgtcacggacatggacagtacacgaagactatagctgtgtttgcaatcccattttcccaacccctctccctcgttttccgcgcgcacgctttttaaactattaaacggtgtattttttgcaaaatgtttctatacgaaatttgtttaaaaaaattatattgatctattttttttaaaaaatagtaaatacttaattaatcacgcggtaatgaatcactccgttttcaatgcagggagtttagttcccagcatcctatatccgaacacagccggtaccagatgtgtcgatgccgtcttccatcaggacctgatctggctcgccccatatcgcacctttggttgctaagagcatctctaacagtctttttaaatcggactctccaaaacacgtatataaccagctttctaattgaattgtaagccaaactcatttatcactccaacagcctctccatctacgccttccattctgaatctatgacactgggacccacgcgtcagcatcaactccctcgtccctccttcctctttctccctcctccaatcctcttcctcttttcccccaacgtagatggctacagcgagcatggcgtcggaagaggaggacgtcgacggcgacggcgacgatggaggcgaggcggccggcgccgaagaggggtccggccccttcttccccatcctgctcttccctcgtcgccgtatgcagctatgcatcagctacgttctgaattcacaaaactgaaatgatacaagaaagatatcagcacaatgccatgctagaaaagaatgaaaagcatgaacaaatgcactcaggttgagaagaaagaagaatataccgatctcgatttcaacaagcttaacagagacaagaaaaacatgaacaaaaaaagaagttcacctttctgccatctaccagatggaaagaaccgggaagccataaatcctattcagtaccctttttctaatccgaattcccaattgctaatcgagacaaacaagcagcgcagaacagacggctacagagattaaggtcgtacctttgcaaatctgcagagcgcggatgcgcagattgcggaagcccccggcgacgacgtcaaaggttgtcgtcgatgacgccggagtagaacaagagggacggcgactgggagaggtccagctcgaggatcccggggaagcgcgcggcgaggcagcgtagcatggccgggtcggggcgcgcgcgcaggcgccaccgatcggagctctagacccgtagccagtggagcacgtcgtcggtgagcacatcgttgatgagcgcgccgccggatacgatgcccggagacgatggcagtggtgctcgaaactgatgggagaggaagagagtgcgggaggagagagagagaggagggagagagtggggccacgattggcaagccaatttggactggccaaatttagccattgaggagccagtttggccagccatatggcttagctatccatttagtaaaattgttggagtttgtttttgtctataattattaaattttaatttgaaaagtgaaatagtcaatctgttggagatgctctaatctggcttagctcggctcgccatcgacgccagactgaaggtgcaaaaggttggcgccggtgccggctgcctccattttagcggctcctttttccgtggaccatttctttcgtcggaactacgggatccagccgcgtgttgccgcgtgaaaacgagagaggagaaacgggaaaatagaatgaccacagtgggtcccaccgtatgtgtatgtgtcttgtatttttccttttaataaatccaccgcacttttgcacatcttaaagcatgcttctacacatctgggtacagtgccatttacgatgatgttgcaaactactcataattacaatttatagtaaatggtcatatatacttccaaaatacatcatatacacgtacaggctacaaatttacaccatactaagtcacaatataagaacttctatagcccgcccaaccacttatccaatcttgtccccagccatttcattcatttactgagcatcaccaacagattggctaaatcattcacgataccagaagtttaggaatttttttaaaaaaaaacatgctccatcagtatccctgaacgtcattcaaaatttagccactcccatccccgcgtttctcgctctcgtcttgtagttgtagggggcagggctcgctaccaaaatctattcacgcgcttcttcccgcaaagctcgtgaaatggtcgaggtcgtccgccgatgccaccatccaatctccactgcagcttaccggaatgaaagggcaaattccataagcaccgcagctgcatcgagctgctccgctgctgaccacatcttcccagaaaaccggacggaaatcatagccccgagggcttgattcgtcacgccgacgactcccctcatggcatagatggccatatggcccaagacccacggcccggcccgaagcccgcaattttggcccggtccaagcacagcccgggccgtgcctgggctgcaccctcggcacggtgggccggcccggcaaggcccgatcaaataaaataaaagaattttgctgatttatttattgctatatccaatttatggaattgatacaccgtttaattgatactatcatttagcaaaatgaaacatagcatatgcatccatctttcggctcgagaatttcacgggatagagatatggtataagaaataggctattaagtaactctaaatgaattgttttagctccggttcgtgaaggaccagagaagctttctagttatgaatcgggtatagaaccccctttatagcttcatgctgtttgaatagttccaattaatggaatcgaagtcattacacgagtgagtttagcaagtggaatatctgactttgaaggagctgctgcaagttctcgaattgtagttgtcaattctggaatactttaattaactatttgattgaattttcccttccttttatcctcccgtcttatatgggggataggcccccataccttatatctgtatatggagagtatacttgaaatataaattgatttaaatagaaaacctttgtatatattctatattattaaaacaaagtctaaaaaatatatataatatgttaaaaaactcttgtcttatcgcgaaatgtttcaaaagagcataaaatttattttaagaactaagaataagaaaagagtataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctattctactatatagaaatagaaagaattatatagaaatagaaagaatagaaagactctttcttacaagagtttcttacaggagtgaaacaaaattaaagaaagatcggttcaaatccgatagtcgtcttttttctctatcaatgttccatgaacaaaaatacctctttttctccgaactcactaacctctagaaacatctcaaatacaaatcccttttcgatatatttctatatactgtatccatgtatacaggatccgctatatctgctttggcactggaatgctcacttcgtgcctatcgcgctatttctacataattgtcccttatcttatattgttttcttctcgtcctctgtgtaaatagcctaatatgggttcacaatcaataacatcttcaccatcgagagtaacgatcagtcgaagaacaccatgcattgatgggtgctgagggcccatattgactatcatgagatcttttcttgtaagcagtagactcatatcctttattccttaattcattattccatgaaaatggattattccatgaattcctcaaaacgaggctcatcaaaatgcaaaatctaatactactataagactactaataaaataagaaaaaaattcgaacgattcttattccatatcctttataaacgaatttccctaaaaagtaggggatgatccgtgaattaacctaaccatcaactaaaaaaaatcctacaaaagcataatggaaaagtaggaaggactcaaaatagaaaaaactcacattgggtttagggataattaggctcgaactgatgacttccaccacgtcaaggtgacactctaccgctgagttatatcccttcccttttatccactagttcccctctctttagtttaacaggatagaacagtttgattgctgacaaggctcataaccgtggggttgcgggtttactgattactagaatttttttgttagaatccaaaagttctttactaactagaaagaaaaacgaatacctactgcttattgcaaattattcctgattttaaaccagagtagattttcgtgatgtgattcccgctaaaagcatacatgtactgtaatgcgcttccccatgggtatctggtaaccacgtatgtaggggtataatcggcaatttgacaacataagcaataaggaagccaaaataaaatagtatttccaatgttgcagtgagccctctcccccttccattagaagaggtttttgtccctccaccttcgttgaaggctgtttatcggaagaacccgtactttcctctgggcatcgtatcaaaaatcgccattcctgagattaaccacccgccgggggagtttataaacaaaaaaatattgctaattccatcttctatactgagatataccaaaaaagtatagtgatgccaaatagacttatataatcgtataaggcaaggtccaagacaagaggtatacaaaatagacttattttccagccatttaaacacagctcacagagttgagggaccaaaaatagactttttctgttatacctgaacatccgtcgcctctccccaaagctcatacgcatcctcgatttgtcccgccgccatcccgattcaaccatttggccgctgtccggacgacgccacaccgccgcctgacatattgtctgctcgacgcctccctgtaccggccgctcgccgtcgtccgagaacacacaggcgacaacagggtgaggcgaccgcccagaaccatcagagacgaccaggcgactggtcacggtgtctacgattcagcggatttaatttgtcgatggagagttcctccatcaaatcaatttagctattctgaaattgttcctgctactgctggtgctgaataatctactggatgttgctgctaaatgtgctgctactgtatgctggtgtttctgttgctaaatgctgatagttcgttgctgctgataaatgcagctggaaatgttgttgatgatgcttgctggtttttgttggtgcttaactgatgttgatattgctaatctgatgatgttgatctggaagctagctgctgatgatgctaatgatgttattgatctgatcatctgaatgctgctgctacctgctcatcttatttatgctgcttgtccttgtatatgctactgctgagcaacgggtggacgccgggaggagcgcccggccgatcaagatcacgcgggacaaaaaaaataaaactgatttatcttgattagttcatatgcggcccacttttttatgttttgggagtcatttttaggtattctcttggatagatcaatatattcacccctcaaattttatttaggaatcctaataactaaattttagggatagaattttcatagtctcttggtgatgctctaattctttttttttcactctatctttaatccctcaaagaaacaacagaaaaacagaaagttaaataaattttcttcgttatattttaggagagccatggaggagtccctactaaaaagttaaatcgatttcattcattatctcatcttttgtcaattgtcatcgttagcctcgcagcgactcgtgatgctacaaacaatctcactacattggtggcgaccgaatcaatccaaaaatctctgtattccctatggcgagcaaattaggaatgcaccaaacatcttgggaagaatgacttctcttatagccagaggcgttcgagaaggtaaagactaatttgaaaaaaagaaagaaagaaagcaatggccaacatgtactcccctcttccagatggagagaagagggaaacactagacgacttgagcaatatgagatagaaatggaggattaccatgtaagtctctttgtatctgtttagtcagtacattatttctgcataaagtgcaggcagctgtctttgggagactgggaaaatatcaagaaagaaaggcgaaggcttcttgttgaaaaagctgaggataaacagcagggatggtttgtggtagatgagaaaaagggttatacaaatcttaataactcgcaacataggggccacagaatgtcttatcaaccacacgaggagattccactttcaagagttaaatagaactaagttgaatacttgtatttagagaacatatttgttaggaagaaaatacttcatggctcatgatagagccgacaagaaagttggagtgacaatctcagaactacacatgatagtgatctgatctatgcctattgttgctgcttctcaaaaataccgatgctcaagtaaaccaccaaaaaagaacttacttgagtctatgaatggtgctaatcagcagtaaaggtcaccaaaaatcttacttgagcctatgattgctactaatctgcggtgaaaatcaccaaaatgttgctgctggcctgctgtttctcaagccacaaaaaagggaacttgtaacatttgctttgctccttcttaggatgggcgttgctgcctatgggaacttccctcccttcttccttgaagcaatcttcttcttggctgcatctgacttcggcagcatcgcattcagcataccatccatatgagatgttaacagtgccaccttgatctcatagccaccaaggtacaaattgagctctttcacacaagtcccagcgattagtcccataacttttccttttaggctgaagaccggagaacccactaatctgcaatgcccattgaaacccttctcggcatagtggcacgttcccaggaagtagcactcagaaccattgatatggttgcgtcgaaggtcgagtgcagcggttgattctgatatgacaaagcctgggatgtggtatgcagaggttgctgaagaaggggcaaaaacgacaataggttcgggcataacctgaccacgcatcttcttgattggtctgcagtctgtgtgccttttcgtcctaagagacagaacgtatccccagaagcaaaagccgaggcttcccgttcgatctgatcaaagaaacagatcttgagggtatcctctctgcctgatgcaaatgacgattgggtcaacacgtaagtgtactttccctttgatttcaacacgcatccgctgcaatattcaccattggcgtcacggactacgaccatcgatttccttgctctcttctctaccggaatgtccatgagttctacagattgcgagaggaagtaacataaggacaagtactaaagtaggtctaccggaatgtccatgagttctacagattgcgagaggaagtaatgtaaggagaagtactaaagtaggtactagatatggggcaagatgcaacacggggaagcagcacacgcaccttcaccttcaaggagtggaggagcagcaggtgaccgggccatttctcctccggcggcgacggcgaaaggataaggcggcgcaactctttggtgcgggagcgggaggaggggggattagagagagcgaggcagccgcagaaaagaaaacctagtggccaatatggacaaagggaacatgggatgggccgggatcgccaatcgaaggccgcaatgggtaaccagagcaggacggataaggcgcacggggatgaataagtttatccaaggtccctgaacttgtcaacaaaatctgattttcgctcttcaaacgaaaaaaaatacaacggtgcctcaaccatcaaaaccggtgcaatataggtcccataacgatgtggatggcagttttaactggcatggtgcctaaatggttaattcgattcggttttaatctgatttggcattgacgtggcatatgaagcaaaatttaacaattttaaaaataaaataaaatatatgggcacacatgtcagttgaacgaataaatctaaaataatgggttatttaacttttgaccacttttaagatatgacaattaattattttccactcgctgtctatgacatgtgggttctatggcaaatcatttatcactatccataagagtagcaaataattaattgttccaaaaaaaataatgggcaccacttcctccacgtcatctcctctcttttctgtcttctgctcgccaacgccgctggagaacgggagagtggtggaggtcaggggccagatcaccaggtttcatgcgccttcttcttcatctactcggcggcggcgcttgcattcctcagctcgaatgcagcgcacaacgcgcacccgtcggcgagcgcgcgcggagaaggacaagggcggcggccaccggccggcggggagaagggcagggggcggcagccatcgggcggggagggtggcgagcgtgtgcggagagggaggaggccggcgagtgcgcgcgggccacgccccgtcctccgagttggatagtatagagaggtatactgcgtaacgtgggacgattgtattgagcctcaggggaccggtatatataggagtacatgtgaaggagataaggaaagattatagataaggaagtaatccacacaaatcaatcatatcctaatacatttctaactaccatatactttaacatccccccgcagtccaagcgtgagcagcgcggacacttggactggagaagaaaccggcgagagtgctcaatatcgatgatagccctttgtgccgtagacgatgtagccgagatgaagttgtcgtagtcgtagtagcctgtcgtcgctgatattgatgcagcacaagtcacccaatagtgtgcggttgtggttcgtggcaaggatcacggcgccaagcatgagagtgtgcgggtgtaggcgaaaagccaacaaacacgatgaccaaaaggaaaaaaaaataaagaaaaagtgaaagtgcatctacgacccctcatttattttggtgttaatgacaacacaattagaggttcactaatgctctttgttgagatagatgcaaggataaaaaggaatggaacttgagtttaaaagcattgcggcatcttttgtggtaattgtcttctaatccatgtatatcttgtgttcttgagtatcaggatgccgaactattaagagggataccacatgcatataattggtagaacactagtgctcaaaatcctgcttttgaagtgttcttgttcttctcctgtcggactatccgatataaggtcggattgtctgatacattggactatctgaaatttctcagaactttactctctgtgttgaattgctttttattcctcttgagtgattttttttatgtcaaatcagactatccgatgtgatcggactatccgatgatacagagactccgaaattcaatggaacttgagtctctgtgagaggatgaaattcatgattcaaaaataacggactatccgatatggcatcggactatccaatcgatcggattgtccgaaattctccagaatttcgttctctgtctctggcttgcttggggtcaaaaacatcagactatccgatgtcacctcaaaaatattctctcccaacggccacattttggggatctataaataccccccacctaacccttttctagggttacccaactcattcatttacattcactttgggttgagcttggtgctaaggtgctttgaatctttgagctctttctccctcaatcaaatccctcctcattctttgtgtggtggatctttgtggttgtggatttggtgtttgagggcctagtgtgtgtttcactcgatcttgagcactagggtttgaccaagagttatgtggtgtttgttactcttggaggttgaggactcctagacggctaggtgtcactcccgagccaccgatctacgtgtggttggccgggagaagtttgtgaatgccggatctcgcctccgcaaggaaagagataccccttagtggaaggaggagtgcttagtgcaacctcttgaggaaagggttagcaaagacccggctcttagtgagctcctcaacagagagtagaatcccctcaaggatttgaactccgggaacaactcggtgaacttcatcgttggtgatatctcttctccccctatttagctttgctttttgtgccgctatagatctagtcgctgtttacgccatactcttgtttgtgcactagatctacttgttctgtttctttagtggatcagacagtctgatccaacatcagactatctgatattgactgtggatcagactttccgaccctaactcaattttagcttccgcataaagttttaaattagcctattcacccccctctaggcctaattgaccctttcaaaaagaaatttaaaaaaaaacactatggtaatcacggtgtgaagacgttggtgatgacgggcagacggtgatgtcgacaatgttgttgtaggctggggcagcaaaacaacaacatccttgatctcggtgaaacgacggcgtgggcgacgcaaaccgatctctgatcgaaaaaaaaacagcagcagcggctcagctctttcgtgtctcctgacgcactaaccggatgcagccatgcatgcatgccatggaggcacacaaattagaaccatgcatcttcgttacccatcgttgcatgcaccaaccagttacacctaaaagcctaaactgataaggaaagacggacaattcactttatacactccaacactccccctcacgcgagatcccctcaagtctcaagcgtggaatattggagtgggctacaattattttatttaattacgtgccagtcaggattcgaactcgagatatctggctctgataccatgttagatagtatagagaggtatactgcgtaatgtgggacgattgtattgagcctcaggaggccggtatatatagaagtacatgtagagaagataaggaagtaatccagacgaatcaatcctattctagtacgtttctaacatcatatgctctaacactccgctgccgctgcaggccacgccggctcctctcccccgcgacgccacccaaagttgctgcaggcgttgtcgccgcagccgttgcgagaaacttcggtcgccaccgccaccgaaagctcctgcagacgttgtcatcgtcgtcgccgcagccgtctcgcgaagctgctgcagtcgttaccaccatcgttttcatgtgaatcaatcgccttctccttcctggattcgccgatgaggatgtacggactcgccggattccttcatcctgctgctcctgcttcgcttccttgtagccgccgcccgccgtcgacatgaagcatgtgaatgaagcatgctgcagccacgcctgatgtaccaagacactgatgaaggcttccacggattgtttgattgaatcaattcgctactagttgggagtagtagttgaaggttctgacagattcgtcgatttggtgattatttttttcttgtatttttctgttcttttttccttctgtatgtatgcagttgtttataaaaactgggtactacattaatttctttggaggagtaataaaattgtgccaagatttgtcatccgaccagtgtgagttagcagcttccatctaaatcctaatatatcatattttttcatctcaggcagagatgcacaagtgcacaaccaaacatgtaagatgtgaggctgccaattcagatgaagaccgactcaaattagtcacgtaggcgccacgtcagctaaaatcgtcatccaaacaactaggggatatatattgcaccagttttaacagttgagggatccgttgtatctggttttccggttgaaggacgtatattgaattccttgacaagttaagggacctcagatgaacttacgccgcacggagatgctccagtccgtgtgaaggaataagtctactttgcctccctccactcctttccctgttgaatcacatccctcaacatgcaaaaccaagtataacccgtcctccaactcataaaaccgttgcaaatcgactcctccaacagtttcgtcctacgtggcatgttcaaccctgttgactggctgagtcagcacgtggaccccacatgtcagtgtcatgtagagaaccctaaaagtgagggtaaaattgcaaaccctaaaaagtaggggtaaaacagctgttggaattaaaagtgggggtatggatgcaattgccccctacttcttctatttgcactataaaaaatatacatttgatagaactattaatttttattttattttttaggtgacctataatagatattatttattagaagatttacattgccatatatttctatgcaacaaaacttatatatatacatgtttatgttttcacgtttcactcatatttgtattatattccatgttcttatttgaaacatatattttatttgtatttcccaaacatagtaacataaatatttgcatgtattaaatatttgacttattttttttctcatcaactaaaatacattcaagtaattatttgtttgatacagtcatcctatgagttgcatataattgactgaagtctgaaggtattgttatgaactttaaaaaaactagaggtaccactttgttaattaacataatatctaggtctgtacacattcgagaattgcggtcgtacttgttcgcttgtcacaagtacttggcaatgcatatggaaaccaagacagtactagcccgcccggaaatcaaccaaatattatgtaccgtcccaatctaagtataaagcattttaaccagattgtaagcaaggataagcaaagctaaattatctgggtttctatagttgaattatgcctacataaaatgggatatttgaatagaagggttataaataaataatttgtaaagtataggcttaaaatgatcaagaggtggacaataacttgccttgcttgatgtactgagatggattgatattatctagtaagtcagaagaatcctcaagacctagggttaaatataaaattcaaattcaaaagaaattcaaatgaaatccaaaaatagggcaaaataacataaaatgagaatagcaaaaaaaaagctttagaaggtagagaatgattttagaagaattttggtctaagtttcattagaattgggtttatatttaaaagatatgggcttctaaagtttcgaattcaaattaaaccgggaaattactaaagagtactgtgcgtgggtcccactggccagtctctctctttcttctcttcttctaccgccagccgttccccaattgcgaccggcggcgctagggttgcggattgcggcggcaatagaggggaaaagtgggtacgggcggagaggggaggctgctagggttctccggcgatggtgagcggcagcggagggttcaatttcatctgtggacggcatagcggctagggtggcggcggtataatggtgtcgtgaaggtgatcttagatttggttgttagacacaataggacatgggtgctggaagcttcactagggttcatgggatgggttgatggctatgccgaccgtcggcaaggtgtggagggcatgcggccgtgagcgccatcatcgggggcgatcgagttcggccgatagccgtgtaggtgatgcaatggtgcaatgcgactggaaaaatggaacctaggtggtatgtagatgctagaaaacggaagaactcaccgagttggcttgaaatggcgagatgcggtcgagaaaactcctcggcggcaaaaacagggcatagagggacgacggagctcggtcggacgcgacgaggtgaaagtccacgcagggctccggctaagcttcggatttgtagaacatgactcaacgaatgtgtttggttgattggataggacggaggttgggcggagtggtggggaagtagtcgcgcacaaggtgctcaaccggcggacagtggtggttgatggggcaaatggagaggcagggctttgggggtagtgtggtaatggttgatgttagagcatcaccaacagattatctataattttctcctaaaaatttgcttttgggtttcctaaactgaaaataggaagtgaaaaaactcctctctccaacagataacctaaattcaatccccaaaacttaaaagtgggcccgtctgttaaactaccaagaaaaattccatcttttttttctttcacgcgcagaaagatcgctatctcccacgcgcgggaatgaaggagagagaggcgggattgcgtgattggaagcgactttcacgcccgcatataaacggagcgaggaaccggtggaagggaactccaaaacttaggtaggagagcaagggatctgttggagctgatttttggactaaaatccctcaaaattagttttgggaatcatataggtagactgttggtgatactcttaatcgatgatggatgagtgagggcttggggtcctatttatagggcttgggcgagcagatgagctcgagcgccatcaacgcaattgatgagctcggtgttcgggcatggcaggggtggcagagggctgagagagggaagggaagagcaaattgagtggcgggacatcatgttcaaacatttactgacgacagtggggtttaatcgggggcgaagacaagcggcggcgagctggcgtcctcccgggctcgacgcacggcggcggcgaggggtaaaacagtcggcttggcggcgttcggttcgagttgagagaaggaaaagtgactgtcgacttttaccccaaacgcgtggcagaatttggtcgttttatccccggtagaagcaaactcagtcttggcgtcagcatcgggtgggcacgcacggcggcaggcggtgttaagctgcggcggcggccgtcccggtttctcctccgacgagattagtgcagcggtatatggttgaggctcactggacggcggatggcatgcacggggcgccaaggcagcgcggctaggggtggccacggttgtgacaggacacgtgtcgcacaagagattaagtctttcgcaggagcgtaagacttcagtcttaccaaattttcttccggaaaattgatggggaggccacggttttagagggttgtggtccccaaggacctaacttagactttgccaaagtttaggtggaggttgggctgctgttgtcgggctgaccattttatcgaacacctagagtgtgatgaacagtaaattcagaaattttgaatattttgcctaaaaggaatagaaattatctaaggcctttggatgggttttgctaagtttttgcactatagcaatgtctcactagaattagggtaatctaaggaaattttctaagttttgaattttgaaagaaatttgctaaaaaaattagggtttttgggtaggatggtataaagttggttttaaaggaattctaaaggggtattacttgaaccaaagaccaaggttaaaaaggaacttttaaaaaaaactttgattaattcaagtaaaaaaccaacataatgcagttaaattttagattaaaatttgaggatgttacaatgatgcatacctgcttgatatcctggagaagagattgcaccttgccaccgccatttgcacctgcatctgtaactccaacagtgcttacctgaacataagagttagcaacaagccccatcgtacatctagttcgctatcatcaaacaaatccttgagatttgataataacatatttccagcagtgaactgtgattacaagcattcagtttatatttagaacgtttaggtttttaaggtgcaaaattactaactggccatcaggaatcttaattggtgaaagcagcaagctttctggatggaggatgagccacatcatccagaatagaagaaccgttggatggatctagtaaaagaaaatacaccgttgaatctatacatatgtaatatatgttggacctatcaagaccctcatttatgagaatagaaatccattggaccaatcaagaagcttctggacaaaaaagttgacactatgtttggttaattaatctctagattaaataaagaaaaaaaaataaggctcagctataaattcatactgaatttattaacctctatgattatcctccataagtgatttgtagcaaattagcattagatcacgttccatttctccatatgcaatgactcagcatctatgatgcactgatacttcactttcttgccgtaccggtatccgatacgtccgatactccgtcgatacatatgcttgggatgttttttgaattatagagaaaaacaaagaaaaaacaattgctaacaagttccctttaaaaacatgtcaaaacgtatgtttggaatgtttttgaattaaacgtatgtttataatgtttttgtaaaggacgtaactacagagctagtgctaaaccagataccaagaggcaccatccacctatactttaaatacaattttttcttcaattactcatccgatctacaatccgattacaccgttgtgttcgtaacaattaaatctttacaacaagatctcacatgattatattttgataaaaaatcacaaattacttttatgatatgtctaaattacttttagatttcactaagttacttcttagatatataaaactaaattcagtaaaacctaaaattaatttacatatattataatagtaacttagaacaaaacgaagataactttagcatgtcatttgaagtaaatccgttgtatagataaaaacacacacacacacacacacacacacacacacacatatatatatatatatatatatatatatatatatatatatatatgtatatatactggatttttcacattttggtccttttgaaaaacttatttcgcaagtagacccctagaaaaacttatcccaaaaatggtcctttttggggcgccagcctctttggcgccgtccccctgccgacgtggcggggcgatgctgaggtggctagggggagtgcgccagagtggctggtgcccccccccccccgaatttttttatttttgttttatttgtttgatatttttttcacgcttagggacacacaagaaccaaccatagaaaaattgaactcaaatgaatgtaatatgtgacatgtagaatttttcctctcctctcctctctccgaacgagtgcagaggagagagatgtgcaacttttttatttttattttatttttttgatatttttttcacacttaggaactcacaggaaccaaccatgtaaaaaataaactcaaacggacgaaatatgtggcatatggaattttccaaagctccaccgaaaaacttctttcctcaaaaacacaatcttgcaagcggaatttggaggttttaatatcgccgaacccggcaaagcgggggagaatcggatgtaactttttctgtagatgtccgtgcatatattatttgcctgattccgagtccgtatgagaaagttatgcctattttaatagatgacatattttgtccatttcgatagagttttggaaaattctacatgtcacatattttgtccgtttgagtttattttttatacggttggttcctatgttctcctaagtgtgaaaaaaatatcaaaaaaataaaataaaaataaaaaaattgcatctctatgtactttttaacttatatatgtcatttcatgtggttatattttgaattagattaagtaatttcatatagtggtagagtgcattatgtttaacatgctgatcaaagggttttactaaaagagttatggtctaattttagtgaaagtgcaaagtagactaagtggtatgctagatattttcagacttagctaagtggtagttcgagtttaaatttttttttgtggttggttgtatcgtgatcctgagtgtgaaaaaacatccgaaaaaataaaataaaaatgacactgttgcaactccatacagagaaacaggaatggaggcggcggcgccagccatgctggcgccctccttcctggggcgg

SEQ ID NO: 18721 - DNA, 21362 bp, Oryza sativa
gtgatatatatatatatatatatatatatatatatatatatatatatatatatatatatatatatatatagagagagagagagagagagagagagacacacacacggtcacgctacgtgacgcgagtcacaggcgatgcacgccagctaagccgtagcgccactcagagcgagagcccgcattcccagcgtacagacccgccacctcatccccatcctgcaggtgcaaacagagtaaaaaaattaccgtggggcaaatcagttacagtggttggtttatgagagaaacacgtgattatcgaccaccctgctcccctcccccgcaacagacaactgagtaaaaaaattactcattacaaaatttgtcttggagcgggcgtaattgaagttaaaaaattactcataggggttgactactgtggtacgtttcaatgaaatatacacgtgacaggcgatccttccagcgaaaaaatcttcttgccgtcggtgaaatttttactaatgggtatttttgttcggtatatgatagtaaatttttaactaatcaatatttcttctataaacgtaatatccagagcaatttattaactcagggattcttgtgctgctcagtttgcgagtaaaattttaactcatattgacatagatgaatattgggcgtccatttttcgatccaacggtagtttctacgtttgcattacatataaggtttgcactacatattttttccctataatacttattagggttagtaatgtttttacttctatatattttaaacatcactctcagtatgttcatagtaatatacttactcaatctgtccgtaaaaaagtgagtgaaaatttttaagccatcaacatactagtatcattatccttttatggggcatattttgacacatacagtcaatattagattatggagtattacgtttaatcatatgcatatcaatcgtacaaaaaatcacccgtgcgtaacaaactacagaaccaacaaagagaaaaaaaggaaacggaacccccgtccacgggaggatagaaacagcagagatacggatgacccgagaagcacgccgtacgtggtggtgctgcatgcgctaggctccctccagatccagcgcagcaaccagcgtctacatcggcctcttgccctatacgcatcgacgctggcctggaagctaatcgccgggcctgaagaccgtcgccgccgcacaaggtggaaagcaacctttccctccattccagcttgaacgttgtttcagggccaccactgccactggccgcctactcgtgtgctccctgaaccgtgctccctgaaccgaccatgaggcacgccatggacgacgtagccggccgccgccaccctcacgggctccgaagaatgaccaccggcgccggccttcagatcgggcaccttcaagagggaggcagcccgacgccaccaatcgccctctcctacctggatgcatgacgacaccacccctcaccgatggatctcctcgccaccactcggggctcggcctccacgccatcgccccaacgagcagaccggtcacccgtcgccgctctatccccaatttctcagatccgaaaaaaatgaaagaggacgggagtatgaatgggggtttggatacggtgagatggttatggatgatataaatagaattattggcgtgagtaaaaaaattactattgtttgggctggagcgttgacagggtgggttgggggtggctcttggtggtgcgcgagtttattggagtgggggtaggggtacaggggtgggattgagattgatcgtcgatgagttaaattttaactatatatagaactactaagaagttggataacatcaagttaaaaatttactcgaactacgagagtgaggggagggggcgcaggggtgggataagactgatcgtcggtaagttaaattttaactgtgtactacggacctggtgggagcgtggatgggtggggctggaggctgtttcaggtgctgtttaatatgtagcaccttagggtgttgtatagtagttatatatatatatatatataaaagttgttcaatgaaaaaaagcattaattaaagttactttctttttttataacttacttctataatatatgtaaattacttttaggctttactgaatttacttttatatgtctaagaagtaacttagtgaaatctaaaagtaatttgtgatttttcatcaaaatataatcatgtgagatcttgttgtaaagatttaattattacgaatacaacggtgaaatcggatgaataatttaagagaaaattttatttaaagcatagatgatagtaatatttcccttacttgctcaatggattaatagcaaccaaaactcctaaagtactagcgcatgggtgtctctagttaaagactagatttacggttttgtaaacgtatgcttgggatgttttttgaattattataaaaaacgtatgtttggaatgtttttttgaattatagagaaaaacaaagaaaaaacaagaaaaattgtctaagcccaggttcgaactgggacctctaattaggaaacctataaaggctggcgggctggggcgacgctggggtgtgccacgttggattttaccgtgacgaagttaccgtgcacgcggtgaaattttgtaaaaaagccctccagtttgtgcgtaattcaatcgaggtcccccacgaaaagttcatttgaagagtcagttcacggataggcccttaaaaaagtcggatattgcatgcgaaagagagaaaattcacgaattaggaccgcgctctaaaacgtggaagcccaagggttttttcgaaaaacgacgccctaacccactcacccctaaccctagcctataggtgtccaaacgggcggcacggcccggctggcacgggcacgggtccggcacggcccgtttcggcacggcccgttaggcacggctgatgaaacgggccgtgccgtgcccggccacatgccgagccgccggcccaagcacggcccgtgaatgaccggaccgtgcccgtgccggcacggcacgcctgcggcccacgggccgttcggggcacggcggcccgtgaaggcaggccggcaggcggcagctgagctgcactggccgccaggccgccagccgccaggccgccagtgcacagtgtttttttttaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagtttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacttttattgatgtttatatcattacaggatacaatgatacatgctgcctcgttaaaaactttgtcatgtaaaaactcataggggaaaatgagaaaaccatgacaaagaaaagagtacaactcaaaggtcagaactacttctaacaaaattctactggggttggtctggatctaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaaaagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtgaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattactccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagttttgccacacaccggaggttctcaatctcttcgagccggtgtgtgtcgaaacacttccgctcgcggttccggaaaatccttccgaagctgtcgccgcctgaaccggtacctcctcaacgacagccgtatgaaccggtacctcctccacagatggtggagttggagccgatccgaggtatcgtcaaacctcgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaataaaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgccgccctgtccctgctttcggcctggcgcgtgcgccgctggcccgctttcgggctgacgggccgccggcgaaacggcccgtcccgtgccggggcccgtcccgtccgtgccgctacagtagccgtgccggaccgtgcccggccgcgggctcggccagcgggccaagcacggcacggctactcgtgccgtgccggcacggcccgttactgtagcaggccgtgccgggccgtgcctgctacagggtcggccgtgccccgggccgcccgtttggcccggcccgtttggccacctctaccttagccgctgctcacgctctttcctctctctcgtcttttcctctccctctccagctcccgctgccgccggctcgtgccgcctccgcctccccctcgtgccgccctggacgacgcccgtgggcccctctcgacgaccatagtaaaaaaacccgtaccggtggtcgacccggtgatctcgttggttcactggttcaccggtcgggaccactgggtcagccggttcaatgctgaaccgaaggcatatgactattatatgttttctattagccaggatgagttagccagctaaatggtaagcatgataaggtctcgacgcacaggttatgggttcaaatcccttcccacgcatgttttctctcctattttgcataaaatgtaaatgggccgtggggtagtatgatgggccttacaagtccagccccaagtgttagcccaacttgcaatgaaccacctgttcttatgagcccggttcaccggttttcaacaaaaaccggccagttcacccggttcttaccgggtcaaatgcacgaccggtctttttattgaaccgaccggtgagagacctggttccggtttttgccggttcaaccgccgggcccgtccgcttttttacactatgggttccacctggttcacacgcgcgggggcggcggacgaaggaagggacggcgccgctcgggagagggaccgggagcgcgtgcgtcgccggtggccgagccgagccgagctgcgtcgcggtggtgctctccgcgggcggcgagattcagccctgacccgaggaaggtgaggggaattcttcctcgggggtgggtttggtgcattccgtggtgtgagatgcgggggatgaacaaggctttcggggtttgggatgtcgcggggatttgggggcggtgggtggttttcggctgggaatttgcggatttcgtggctgctagtggtgttcccgtggctttacgaacagatgtatatgcttgatctcgtgcggctttcccttctatccctctctccatggtttgctcgcgttggggggtttcgaaaaattttccctactgttagtcctcgattctggtcgtcggcatggtggcggtcgcctccgcctccccgctcaccgccgcggcggcgccctccatgtgctgctcgccgcccgccttcctccctctccgtgcgcaccgcaggaggattttccgcgcggaggcgatgaagacgcagcaggagaagaagcagaccgaggtggccgtcgaggagtccttccccttcagggagacggctcctcctgatgagccgctggtcaccgccgaggagagctgggtggttaagctcgaacagtctgtgaacattttcctcacggtgatttccacgagtcaaatcggattaacatcaaatttgaggcagattttgttcaaattcagattttcattgctgtaaccacacacatattcctgttctattcgcaggagtcagtcatcacgatacttgatggattgtaccgtgaccgcaactacgctagatttttcgtcttggagacgattgctagggtgccgtattttggtgaggatctcgtcgtacatgctcgctatagcctgcaggtctctgaatttcacaatatacaagtatggttcctacacagtaatgtttcggttactgtttcactgactgcctgactattgaacagcgtttatctctatgcttcacatgtatgaaacatttggctggtggaggagagctgattatataaaggtgcactttgctgagagctggaatgagttccatcacctcttaatcatggaagtacgtctctagctctttctgtctgcacatcagtgcatttatatatgctgtttcttcctgttttgatgtccttttagattatgttagctgttagcatatcccgttttctttaactgaatataatctttaaaggaattcaacctactgcttattgacacattatctgtttttttttaatattttggttatggtctttgatgttctgactttattcctcatcttggttcatattaggaattgggtggcaactctttatgagttgatcgttttcttgcatggtttgctgcatttttttactacttcatgactgttgcgatgtcacgagccccggcgtaagaacgtatgggatatgaatgtgtgattggcggtggacgagggggtttggtggaacgacgacccgtgatgaacagcaagggatgagcaaatagagaataggagatgagagaactagagattgaatctgcttaattaaacgccaccgaaactgtgcctctaaataggcgtacacgaattaaccaatgtgctaaaaacaagctaacaaactgataaacagactaacaatctgaactcatccaatcgccgcactgtagtcatccggcacgcagcttccgcgcgctactccgccgttccgcccggcgacgcttgcggaaccacacgccctctgcgacgatacgtaatcccgaccatgacatgcgatgtacatggtgagcccaagaatggcatgtaagtgtgcacctatgccaattatgaagtaaaacacttcatttttatttccatgccttttatgtaatgataacgcttggaattgtttatcttatatacataccgcttttctgaatgtgttgagaggcatgcgtactcaacctatgacaagtttattaagctccatgaaggtaataaaacgttgatggatttgacatctctcctgtcgtgcaaaattttatcatgacaactagacatctcaaaatttttgttgctttatctaggttggacagactttgtaaaccaaagtggaaatgaggggaccgggaaaactaagtatttactttttttatagggataagtttatgcctaccttttgtcacagattgcccttgtgtgaataatttgatacatgcgccagtgaacttatgttatatcagctatttacttcaattattggcaatcaggattcaggcatggtgtttattttagttttataggtatcgtgtgcataaattcaaaaacatgtattattcttccatttttgattaagatgtcggctctggtatccttttatgatgtactatatttagattttttttccgtcctacatagtggttacttgaattgtgggagagttgaaacatacctgaaaaaattagcaaagctagatcccctaaggtctgaacaccaaactggtagactctttgcattactatccattcagaagttgatgcattgtacattttaaagggtgcattttaataaaccaaaatgttgaacactgcaaccaataacaccatgtctacccgacctgtccaccaactagaaatttacaggaacatcacactctgtcaattatatttacgtatttcttggcaaaataacatcctgatctgacctttgactgcagaaatgtagctgatgccatgcctgcatgccacccatgagtggcatacctaatatcaatatcaaggaatgacttcctgtagtgctcttcttccttgagagcacacgcaataagctatcaaagagtatacagcttttccaagaaaacgaaaggtagagattttttttatcaaatatatcaacacatgacctatttgttgacttgaaaaggaggattggttatacttcaggtttcttggtccttgaagtgggaattggatatgcaaactgacagctccttttctgtttgtggtgcagggaacgacagagaattgccactctctaacccaagaaatatcacaggtatctgaagcaaatcactctctaacgttactgtttttttattctgttctaattttatctggctaggaagtgggaactatcgggcgctggaatattgctgcttctttgaagctccttttttttctgtcacaaaaactatttcgtcgaagtaaatggatggttaattcgaaatgtgcccatcttgacgaaaggagcctagcactaccaccacatggccatggtaggctgagtccagaatagagattagattccccaatccatgacatgcaattcgcaaaggtgatactcagattgtgtactgtcaagagaatggtttcctgactttaccatccacaacagagtcacactaatgtaatatttttatgtaccattatactacaacatttttattttccatcaagtttttattcctcatgttcttcacatcctctgtgcttctctggtgatttacatggtattacttcatgaatttacagacatttattttctccatgttttttccccatgtatctatattcacactgctgaactttgcattctattttgcagttgcaagatcttggcagcacacttattgagttgtggaacctaatggacacaccaactgctgaacagaaatgctttgaccatgttacgtctttgatttcagtctcaccaaatacaaaaatgccccaaggatgccttgcacgtgaacttattgagaagtttacaattgatcgaccattttatgttcttttgctttatttggattgtcattgaagctaacttaatttttctgtaaaatccggttgaggttaagaggttgaattcttctgatcattgtcaatacaactatagcgattcattgagggtaagagctcacataacttttatgtgctttactaatctttttcgttataccttccatatttgattactatgcagtagtaattatttttctgatcattgtcaacacgactacaaatatattttatagtagaacctctcatgaattacactgaaaaacaaaggccgaaatcatcgcctgcacaattgatctttaataaattgaacctgcccacactacctgtatgtgccacagttctatatagaaatttcgtgattagctacgttatgtaatacctacaccaaccatcctataatactatcactataatttcattgtaccaatatctactattaacaccactattcgcttttatcaccggcaccttccacacataaaaatacttatagacaaattttcatacaggtggacattcaacgaattatgtttctgcgcaaaaaatgtacaagccacacctgatctaaaaaattacatcaatgttattaagcgtttcctacagcattcgagcaaattctatgctgagactgttaacaggacattccttatgcagaatagagttgtaagttcgtacacctcctgttcattccttcaaatttataatacatactgctcgttttttctgcgcaccacagaaaactaacataacatcccagttgcagtactttgctaaagaattttcagaggtacatcgaaccactgatgcacaacagaaaaacaatcaacatttaggtccaagtagcaggaggcatttcaaccgagatgattctgaacatgtcaccagacgggcgctgcaacttggtgaaaggatgggcagatttcgcaacaaataagaacatatctcggatcagtctgcatcttccacttctataaaacaacttacttggaagctactatcgatgttctctaaccaacataagaatgctcttagtcatgctggaggcatccttttgttaccagtaaacacggacatcaccatggacatgcaccgctctccgcccctgccactattactatactaattagttctgcgccttatgtgcttatcacatagtttatgctcttctgcagatgtcaggctccatctatatatatctacttattactattagaggccagtacaatgcctgtatcaacactcctgtgctaactggtagatacttttgatgcacctgtttacaagtgtttatatactactctatgaaatgaacttatgcaccgcaagtggttaaattctgaccatgtttcgtcagatctgtttacattgtttctttaccttcacttgctccagctgcttacgtacagaaatcaccactgtttcctgcttcgtttctttgttggccgttcaggcggcgcgcaaaggcgcgccccaggctctagtacctctaatacgtgagactagtgtggtaaccgactacaccacccaaacttgccgatttagacttggcaaagaatttacatatacattttttctactcgtttcttaagtttagtaagggtatctactcatctgccatggcatgttgtttctgcttcttaagctcctgacctaacttaattcgcagagagcaattcagggaaaacatctatgaaacaattcatggcacgtttaatttagattattaccatgaactgtctactagattataaggctacattaaatattttaagaaaaaaaattaacaacaaaaataaaacaaatgatttaagcaaatacaacagaaactttttttaaaatttttttaaagcatgtaacaaataatatgtttcaataaatccaacaataagttgaaagacgggacctaaactatcattccacctatggagtagaggaattatattgaaatttatcagggttatggataccacatacctaatagtagttgactgaatctcggcaggactcatcacataccatgtcttatacagaaacaaccttcagatataggaggagtttcgcacaaggaaggatgaataaagttctacatggaaacgacaaggactactcggattgtatccatattggtttccctagttctacttggacaaggggacacctataggtataaatataaggccccctaggaggagatgggatacggaacaatagatcaagacacaagatcaacataccagccaacacgccgccaaatatcaacatcagagattagcttagacaaaccctatccggtacctgcgggggccggcaagaggggtcaagcactatctctgatctcaacgagttcgtgctcgaggaagaagactaccctgtcgtcgactacgagttgggttatctagccgtcaagtcgacgacagccagatatgttatcccacatattgtatttgtgtgatccaaatgaataaagagcaacaccggcttcagccaacaggatgtagggttattacttgacaatttaggggctcgaacctgtgtaaaaatcctcgtctccgtctcttttacctaagtctcgcgtatatcctagtactaacgatccccatactatgcaaatactagaatcgcgacatcaaacgtcgacagaatttgttcagaagaaaaaaacttaaaaatataagggataaaactactactaagtgcatatttagaaatacaatacttcctccgtttcacaatataagtcattctagtatttcctacattcatattgatattaatgaatctagatatagatcaatataaaagcgaaaaatgctaaaatgacttacattgtgaaacagagaaagtactacttattttcatgaacatgaggagcaagcaacagttgcttatttgttgggccattaagtacgtgataaatgggaaagagatggttgcctgtaaaaggagataatgttctgatttactcctagaacattgtgagtatgtgacataaaaacctagtctacacgaccatccaagcctccaaggtatgtgaattcttaagcattttgaatagttccgtaggatttcataaggtcaatttttttttcaatagttgtattgcaaaactgttctttttctgattatggagtttgaagcttatctgcacacttcacaagctcctaaatgatagtttaaacaaaactccaaaatgataattttttgttaaaaattctatattctaaatcaagctttcaactttatattagttaattcattattttatacttttaaatagctattacacaaccatattatctatcaatccatcagtttcagctatcttaaatagatgcttcaacttatgcaaatgtgtattacatctgactaaaaaccgttcaactgcgctcctatttactgctccctatgttcatattccttttgacttttactctattcaaacttctttagattttactaagtttataaaaaaataataatatctatagcaatatattagttttattaaatattatattgaatatattttgataatatgtttgtcttgtaaaaaaatattactatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgttttggttgaggaattttggctctaattcggtgccattaggtgggtttgtgtttaatttggggatgtttctgaattgtttccgtgcgtttcagattggggaatgctgtgtttcgccgagattttctcatcttccatatgtgatatcagattataattgtatgtgtttttgtttcgctgcaaattaattatattgatgcgaagtttctctgcatttgattgcagattttcgatgcattttaggctaaaagtgctcgggtctgaaacctacgtgcttttcttgtcgccgaagatggtgtcagcaaatatacatcgacgcacatgaacagcgatgatgcgttgctgaatccgtctgaagctgcaataagcatgacggttttgcaaattatgatactaaaccattcatgctgctacgccctcgtctggaactttcttcttctgatgcaaccgtgcacaagcaaacctagcctcgaagcgattgtgatgagttttagaggtggtgcgggttcgatcacgtggagttctattggtgttcagtgactcttggcaaaagttctcttgtaaaatcgacgacgatggaaaggtcagcagtaattatctcgcgaatcatattatttgttgcgtgcgcactaatttctgacatggcatctaatttcttctcaggtacaaagtgataagggagataggcgatggcacctgtgggaatgtttttagggcttataacactgaaacaaatgaaattgtaagtgcagctcttggcatagtacatatggttacttggatcttttcatgttaattcagttgccttctgctccttatatctactaacctataaaggaacgaacagtattatttgttgcacctaatcacctatgaatttcccacttgagggaaatgctagcaataatcatcttctacatcaccccagatggctacctattcgagcttgcaccttgtttgttggcttattatgttaacatttccccgaatactgtgcaggttgcagttaaaaaaatgaagaggaagtttttccaatgggaagagtgcattagtctgcgagaggtgaaggtaatatatctcatgtgttatcaaatgaatacaaatttgttttcaaatctgtgtgcttaaaaggagaaccatccttctgcaggcacttcaaaaactgaatcatcccaacattgtgaagttaaaggaggtgactatggaaaatcacgagttgttcttcatttttgaaaacatggttggtctcaagtcattcttggcatacttttttactactttctttatgagcaggaaaaaaaagaggaaaggctaaactattactagcccatatcgctatgatcttctagagttttgtggccagttccattaaaaatactggcatgaatattctatcgtctacaaattacgtgtatatcttgcggttctaatgattatagttctatagtttgtatgcctgttgcatttgttgtgacattacattacgtgtatatctgctgaatcttttggttcacacttctctcacctggagctgttaaatatttagcttttcacttactctggtatcattgtttcttttcacaggaatgcaatttgtatgatgtcataagagaaaggcaagctgctttctcagaagaggagatacggaactttatggtgcagatactgcaaggtcttgcatatatgcataacaacggttatttccatcgtgacctgaaacctggtatacctttcgactatattctgttgaagttataggctgtctatataccctagaagttaattagccttctctctttcctctttagaaaatctgttggtgacagatggcactgttaaaattgctgactttgggttggcaagagaagtatcttccagtcctccttatactgactatgtttccaccagatggtgagtttgtgtttcaaatttatctctgtataaccagtgaatatgtatacaccactttatccaaattattgtgaaatggtgaaggtatcgagctccagaggtgctgctacaatcgtcagcttacacacctgctattggtgatgcctattatcccagcccctgcattttactacttccatttttattaatgccagctcaacatgaaatttgagtttgtgcatataaaactcgcattgcatgaaactactgaattatataactgatagatgtgcacttcctcagatatgtgggctgttggtgcaattttggctgagcttttcacactgtctccacttttccctggtggaaggtatgtatgatactgttgtttgggtaccatgattatgttgcctctgtagttggtaatatccataatttactgtattcatgtattgatgcatatatgctgtctgcttacgcatgttttgatttgagcagtcaacagatcacccttttgatttctgttgaagtgaactcttgtttcttcttttggtgattagttgtgttctttttattttgtggatagttggcctgggaattttggggatttcatgccactatctctgagttgcatttattaattccaaggctgtaaaattattgttgttctgaatactgtaacaacaatattttttccctcatgttagtatttttagctcttatgatgcctatgttgttttcttatacgattaagcctatacttctccatactttttcttaagcccagttcatcttgcacagagtagacctagaccatttgtacttatatttccttgtttatggtgattctgctttgcttttaattattttatttgcttacagcgagactgatcagctatacaaaatatgtgctgtgcttgggacaccggatcatactgtctggccagagggaatgaacctgcctcgttcaagcagctttaattttttccaggtgaaattacttctgtctacaaccattaggataagttgcctttgacactgatttccttttcttttgcttgttcaaaagatcccaccaagaaatctatgggagcttattcctaatgctactttggaagctatcgacttgattcaggttagttatgacacatgagtcttgtttcttacatgtttgatttatatattgttatatgaaccccatgtttttttgtccagttgcttatgtaagtactaacatcaagttaattaatataacatcttacttatatattatattgttttaagtaatttaccatgacaattcacaataaattgcactaattactagtttgtaaatagtgtaaggtatgggtttgtaacatgttgatgatatagcttttgttgcttgatgttatttgtctgagaataatgctctatattaacatggtagtatttgtcattctgacagcaactttgttcctgggatccacgaagaaggccaactgctgagcaatcactacagcatccgttctttaatgtactaatttacacattgagttattcatgggaactatacttcgcttttctttatgtacctaagacttttgagttgtctaggtgggcaactgggtaccaaggccactccatgcctctcacacaaagacaattgaaactagtgagtttctcccctttttctttcaggaaatgataatttatgtattctgttttggtgatttgttgttgtttctcctattgaactccttttatttttgtaggaccgaatccaaggttggaactgaacctgtgggattttggtacagaacctgaggacaactaccttgatttaactctgagtctaaagccaagttttcctggaacaggtgcctaacataatttttcctttgaaattccttccggttattatcttttgttttattggcttatatttccttttctgcttgtagatttttctaacaatgttccagagcatacaaaagaggtgagattttatttgcatgacgtgggaacatatatttgcatgagagtggaatgggtgttatcctgaagttcgctatcatatcatgcaggaaattctgctgtacccaggatttgaaaatcctcctgtgcagtcaggtccgttctttgtctctctgccctcctccatttttgacttatagttcaggactgtatttgcttgcttttttgcgccaacagccagatggttatagatttaattgagatgcgtggtgctcaaacatggcttcctttttacattatttagcagggttttggcctctcgttgcatcagaccggccaatgggcgatgttccagccatgtcatcctggccacaggcatatgtggttgacgggtaagcatcagcatgtcctttacgaatgagttaatctcccaaagccagacttttatatccgctaagtgctatcattattctgtacttcagccaagccacacttccagctgttggattctctggttctccattcggtttgtcccccttacaaccaaatctgtttgagaaccgttcgttcgcaacacccatccggcaggtcaatttcttctgaggggatacaattaacagattgagcactgaaactatttttcagtccatacattcaacttgttcctttatacattgaactcaaataaacgggggcggcagatgaaatgtatataatcgtagcttgtttcctttttcttttctccccatctaaattcccctcacggagtaccctataatgtcagattctatatttatctagattgtgaatatgtgactttccaaaacagttttgtacgtcgatttgtcaaatgataacagcaagtatggatgagcgataactgacgatttgtgaagctgtttttgtatgagatgattcctgtgcacagagctggtgtgtgtgtcttgtgctatgaaacttgaaggcgtgtgatatgacctactgttttgattttgctgtcgtggtctagtacctgccatatcctgaactgaattcatgtttgtgaaggctcgcattgatgcggccaacgacaagttatgggcttcctgggcgctggatgaatctgacatggatgtaagggtgtagttcacgccaaaattgaaatgttgattgaaattggaacgatgtgatggaaaagttcaaagtttgtgtgtgtgggaaagtttgatgtgatgaaaaagttggaagtttgaagaaaaaattgggaactaaaccaggcctaacttgttggagcgatggcttgtgtaccgctttgttttgtgggtgtcagctcaatctttgtgcctaggcctagctgccactgtgcaaggaggcatcaaaccaccactctaatctgagagttaactgcacactaaacaggttttagccacgcagaaagcgagaggcagcaagaacatcgcagtcacatggccaagcaggaggcatttgcttgctggcagctggatagatgctgtgcaagtgtagaacgcgcaaacaaaatgagctgcactggtctgcaatggaaagctgtttttgagctggccttgccttgcctgaatgaatgatgcctgagcctgatcatcaaagttgacattggaagttgcctgtcatatcgtaaagttaagttattaatactacagtactacccttcttcatgtcactcgatagtcgatagtgccagtaggagagtatctcgagagtgaagagcactgaccacacgagtaaagaatacaccttccattttccaaagataaaggtatagttgataccggaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctccggcgacggccgtcaacgaaatttgcaggcggcccccttgccgccctccgcgagggcgattttgtactgtgcggggggccgcctgcaaatggg

SEQ ID NO: 18722 - DNA, 5167 bp, Oryza sativa
aggccgatcttatactgtccggggggccgcctgcaaatgggcggcgagggggggcagggaattttgcaggcggcccccttgccgccctccgctagggcgattttgcactgtgcggggggccgcctgcaaatgggcggcgagggggcatggaattttgcaggcggccccctggccgccctgggggagggcgattttgtactgtgctctatattttttttttatataaatatcaatagttatcaaatctttttatattgaaaactatacaagattaaaatctccaagactggtaaaatacaattttattattttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtgctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggtgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctgtacgtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcagtcaagtgcaaacctctgctcaacctcacctggactgcggtgatatcggcactgatatcccgtgccgcatcagcctatgcaagatggaaataaaaaattcagtagttgtcctatattatgcaagataaatgacataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccagatggactagcatcagcgccgcttggaacttctgcattcttcgggcatttcttgtaagtatggccgcgcagatcacacttgctgcagcgtaaagtcctcccacctgcttttgactcatccatatcatttctgatgcgtctagtttggcgtcgaccctttttcacccttaacttagatggatctggaatataaaaaacttgggcactcagcgttgtgtaagatcctgagatcccgaagccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcttgcacggcttgcttgcgatagataccacacctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtccgtgaaggatgaattcaacaatagcaaccaatggaagtacccgaactcctcgcattacccagttgtacacctctgccaaattggttgtcattatgccataccgagatccatcggtgtcgaacaatagagcccacttctccttaggctcattctcaatccactgagagaaatttctgatggccgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagatccataagatgtttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcgaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcttcaaccgatgtaaatgtatgtaggtcatagtaagtattattattcctctgggcaatggtggctaacaaacgaggcaaattatcataagaagcttcaaatgtgccatacctcatctcaatgatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacattcttccttcatgcacctcacttcatacacataatttgttgacttgatcaccctaaactctctctgcaatgaaactgcccaatgcttcaccgcctccttcatctcatccttatgagcataccttgcaccctcaattacctcgttctccttatactcccagggtacatgatcaccctctgatataacaagaccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatatgaccttacttgacattgtgcctgatgaaaacaataactgcgttaacctcgcatttctgtactacgccctaagttacattctctacaatattggtctctaaatttctaaaagtaggttacattctccagatcaaactaaactacatcttacaattaacactactgtctatgtctcaattcatactattatattctatgctctggatctacacatatgtgcagtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttgacaggggaggggctgggctttataggggggaggcaaaaatcgccctcccccagggcggcaagggggccgcctgcaaaattccatgccccctcgccgcccatttgcaggcggccccccgcacagtacaaaatcgccctcgcggagggcggcaagggggccgcctggaaaattccatgccccccctcggctcccatttg

SEQ ID NO: 18723 - DNA, 10942 bp, Oryza sativa
caatggcttcttttgggacttctttatggagcccaaacaaccatgttttcaatgccactgaaagctctgctctgctctgctcatctcatcccgtactcttgttgactatgacaacttgacaagccaattcccttccttaattacccctgtaaacgaaaatcaacatgattaattagccagcttatcatcagtcacgtttattactcacactgtcacagcaaaggcatgtgagtgacttttattagtgcagtagcagcagtaaagggaatgcacatgaattgcagttggtttgcacgccaacgaaggtgagagagagcagtcacacggcctaacacaagtacgaggacaacagtgcttggtcatgcgttacacttcgattcgatgccgagtacttataccaagcaaggccatacatgtgagtggtgctgcgtgttgactgcggtcatcaataagtttggtgtgtccctcccctctgcacggagtttttggccaattctagttcctggttatcttggataaaacatgcatcatttgattatggacagatattttatggtctagtactgccttacgtagaaccagcggttataccggtggcgtttgaaagatgccacttatgtcttctctgaatggatgattttttagatatttcgggagaaactgaactaaatcatgtgaaaaaaaaattctgcaaatttgctgcattatataaaggagcatgagtccaacctatttagtaattaggattgcgatttcgaacttttagggtatggtacatcaaaatatctagaaaatagtagtgtttggttccttttcataatttaatcttaaccatctatatgtcatatgcatttataatacactataaatttacttactgtagttattgatttattgctataaatcttaatgtgcattttaaccgtataacgcggaaagcaataaccattggatcctcacattcccaatacataaccattcctatgtgatgtgcaattgcaattccacatcaactatttttttagataatgtattttttattaatctggcctctatatctataaaggatatacacgtccaaaattccacatcaactattaaggagctcaaaataatgccttttaggcattacgagtatacggattacaaattattctcttcgaattttatttgaagtatttgtaaattccccactgcaacgtgaggggtatccactagtttgatctaataccttctccatacgtttgatgtccgtggcttgctatacttatatttactgtatattttgtgtttcctccgttacgtgtacttgcaatgcccacattactcggcgatttacgattttatacgtaatttttgttgaacattttataaataatagacatatcaccactttgtattatgtttttacatagattattctatgtttctttctaaaaacacctccttaccgtgtatgcattgatcaaatgtgtgaagtaaatttcaaccaaaatggtattaaacatatcgattctcagtgttatagtcctttttttttataaagcaactaaatagacccacaagcaacaatagttcaaatataagaaaggaaaaaaaaacatattgctttatctcggaggacatttcgatcataattccaacaatattcagacgtgtgtatccaacacacgtgtatgcgcgttatggtactaactgtggacaacaacactctacacgagacaatatgtaacattaggcgacaacaaaaacgacggtggaactgtggctgccaattccactagtccaattagggagcactgttgcgaaaaaaaaacttggtagccagtcagaaatgccaaaaaaaaaagaggaaatcgtttagggtaggagtcttatttattgatgataagtgtggtgtacgtgcatatatacatccaacaaatactaaaaagaacctattactcaaatggaggaggaagcaagctaaagtaaaaatgatccctacaagcatgagcctaataataataccataacggaagaacaataatccacgcgaccacgcaggcaaagaaacgaaaagaaaagaaaaccccaacaaaaaaacaattaaaaaaaaggagtaatagccggaaataagacgaccatgtgttgttgggcgcggtgaggggcccaacccagaaataagcgaggcggacctgggctatatatacccctacccagtctcctctttccggtttcctcttcccttcccccttcctcctcctcctccccctcctccggtgcggtgcggtggagtccccttcctcctcgcgctcctcctcctcctcaaccctactccttctcctcctcctccgaatccaaacctgacacacagaggcggcagcgagaaggtggaggagaaatttgaacggaaaaggttgggggatcgcatcgcaacgaacccagcactgcagcccccccgattccgattgggtggggggtcggatcctcggatccccccgcgccgccgataattcggccccgcccccgcccagatccccgcgattccggcgccggcgccggggatgagagccccgaggacatggtcgccgtggcacgagtgaggcggccccggttgctgcgccaccaggaggaggggaggaggaccgcccgcgcccgcgcccgcggcggcggcggaggaggtgtctgcggtggtggtggtggtggtgacctgaggcggaggagggaggaggtggtgggtgatccggggcccgaggcggccgtgccatgtctcgctgcttcccgtttccgcccccaggatatgagaagaccgcccgccccgacggccagctagcctcgcacctgctcgaaaaggtggaaaccccaaacaatctcacactccccccatgccacccccgtctccgtcctcctcgctccattgatcgctactagtacacatgcatccggggatatcttaacctgacttatgctgttgcagttgcctgtagaatttcagaaccaagccgtaggtcacgttctggtggggagaggggaggggggataagctagccctagatgattagggctgatgtcttaggaattttcagctgctgggctactagggttagatcacagccttgtcggctcgcgggaggcgttatcgctgctcacggggatctcacgagacatccatggaatttagatttgctagaccaatgctttcctaaaagtgtccttgatggcttgagctggataaattaggtctttgactaagcggttaaaggtaggcgtcttcttttggatggatcgacggaagataatgtagtaacgtatagtgtttattcattggtcgcaacttacgtcatgcttatctcaactatattagataggctagtggattgtagcatatttatcttgccactttgctagctgaaacctactcgagtcttcatgaaaaccacgacgtgttgttttgcaccattctgatggctgcgaagatggtgtggtagaaaaaacttcgttggttattttgtttgttagaggttacattcaattttcaattatgtcatggacatgttgatagaagattggacagtcaattactacactccttttatggtcttgacatgcatctttgtggaagttacaaagctagcatgatgcatgttatgctaactttgtctatgttaaaataaagttgtacgttactgaccttagtaattgtctgaccagaatcactatggtggaatgtgtcttttattaattgtcagtctcaatagtggttgttctaaatcaattttagctttcccttctaggctgtagaccatatatgtattccagcatttgtttctatataatgctgatttcaatcctctctcttcttcttttctatataatgctgatttcaatcctctctcttcttctttccatgcctgattatgtattacaacatttcctcactaagtcattattactttaggtaggcggaacttgtgcttctgttatgttgccttcatggttgtgcatatacatgattctaacagatttaactgccttttccctttggtatacctgtcctcagtctgtctttgtctatgtgctgttcctgtggttgcatagatcctcaaatctgtcaatctgcttcgtgcatatttcattctgcttcaatttttttttattacagctaacatgttgttcacttctgttcatgcttctgtttattgtccatattttgagtaagtagaaaatgcatttaacatgaaagttcaaaggggctaagctgaagtggcaacacaaatgcactaaaaatgaaaagatttggactttaagcttatgtctcacaaaagcaaatgccatgtttgtgtgttttttcttttattcttctggctgttggctgtgaaatatgcctgtagtgtctatgcattccatccgtatgataattgctaacattatggatgattttgtatctatgcaagcttacaaagttctgttacattctggcatcagggaactatgtcacacttgagttttactcttaaacaacttttagtggtgtcaaacaagtgaaaacaatggctatgatacagtttatataacatgaatacatgatatgcaacacttagtaaaaatatgctcttatttagtgattcccccactttgttttgtcacccggactcacgcttttgttaatataaaggtgttttctccgctaactatttgtaggctagtagtttaatttcaaaacaaaggtaactcatggttgttgcatatcttttgatctgtaacttgataataattggtacaattctccaaagcaaaatacagtgtgtagcttcatatacagaatcaggcgcacaattagtcttggatattgcagaaacaattagtttgcatttcaataggataaatttgttaccaaaaaatcctgcatttttttgtctcgtttgtttaaaaggcagtagctagccaatcttgcttataattattcaatatttatgtagtactatttcactggttcaaaaataccatttccgatacaacttgataaggatagtacagcggaagccatttatgatgctacttattggcttgtagtgttaatgatttacatctcagtgactgcagcatcggtaacttgttgttcagtagtatgtctttaggcagttccccaggacagtctctcttgtacgtaaaagtcttattatgttaccttggtcatcctgtgaggttaatgattatcagctcagagaaattttcttttgaaaatcatttcaatatgttcattcatgaatggtattgttgacatacatcttcgcgttttttagttatttgttttattctcaaactctacttaactgaaaaaccctccttgtttcaggagaaacacaaggagaagaagcataagaaggacaagaaggacaaagaaagaaaagaaggcaaagacaagaaggataaagaaaggagcaaagacaagcacagagataaaaaggatcggaaagaaaaacacaaagacaagaaaaaggacaagagcaaagataaaagcagggaattagaagaaggaactgaaagacacagcgaggctctccatgggcaaaaagttggagagagcagcaggaagtctgaagaaattaaggatcctaaatccagggaggacttggtcacgaggacacaaaatgagaaagggacgacgaatcaatctgttcagaacttttctgtttcaaatcaacgaggtcgtgaaggctttagtgctgcacctgcactggagaatgaaagaactgcagctaataaaatgcatagtcactctattaatgcttcaaggaaaactgaggtcttgggacagaagagcatcagcatcaaccaacaaaaaaatgggacagcaattcgacgtggagacaacatcaccagttcatctcaaagaacttctgatgtcttcattgcagcacctacagcagaaaaagaaagagttaaagttgcaaggcctctctctaactctactgattctgcaccaaagaaagatgggatgggacagcgaatcaataacattagcatactggttcagaagagaactgatagtccaaacaaagagactgcgaagaaagaagctggcaccaattctccactgcttccaagccctgctaataccatgcataagggaaatggtaaggttggtcggccaatggagattccaacacagaggtttgacagtccatcgacttctagtgcaacagcagggacagatagaggaatgcctaggtcatctatcccaagcccaagtattacaatacgaaggccaaatgggcttgtacgaccacctgagagcatttccatttcttctaagaaacctgatgcaggaggtgcttcccctgctatggggaaggaaaaggaacagggtggaaggatattgcagaataatattatcgatccaaaacagattaattcaaaacctccaactatggagaaaattacagatggaagaactgaaaggatggagaaggtcagagatggggcacctgatgttgcaaaggaggataagaagagtgatcgacacgagaaaaagaaaaggaaagagaaagataaacacaaagagaagaaaagggataaagaggcaaagaaggagaaagacgaacaaaataataacaaagagcatgataagctaagagaaaacagtataaattatcaggtagataatagtcttcacatgaagtcctcaacccctcctttagccccaccagctgatgatgcaaaagctgcccaagctgatgaaaacctgaagaagcgaaagaaccacgagatgaatggctacttgcaaagtgagttcattctttttctgttttttctgcacttatcagtattgtatagtgttgtagaacaccattatatttttctatggtacattatattataagacttctgatgatgtacagaccatcatgatacaatgcggcctacaaagttgccaagaccagcccactccaacactcctgtggagaatggtacagcatctcatgtagccgcgccactctcttctgtgaagccggaggccataaatattgaaaaggctataaggcaacacaagaaggaagagaagatcaatggcaaccaggaaggtcaacgatcttcagttgagccacggcttcatgatcctctagttgcatccgagaatggtgcacctactaagaagttgccacacccagacagcaagtatctcagtcagatatacagcattcctgaagcacctcaaatgatggaatggcatgggcacgatgaccaggactggctgtttgaccatgatggcacacaaccaaagaaaaccgagtcagagactgaggccgatggagcttcccaagtgtgggctcagcctctgaagattgaccaggcagatgtcattgcgttaccatacgtcattccctattaatacaatgcagcccaaactgctgggtgctgagtgaggatcctgtggagtaactgagcatttgaacgccaaactgcaacttgtttctaggtgctgcatttgctacaactagtgtagctcggcacaaatgggtgattcatccatttgcgggtagcacttcctatatcctcatgcaccctgctagattggtgcatgagattcatcactttgtgagagttggcgtagcagctgaagaatatcctgagtgaatgctgcgtgggaagacattgtccaattcattgtcagaacacgccgattatgtaaggggttgatatatcctgctgttaccgctgcacaattttgatctgtaaggtgtaaaagcatttttataaccaaaatgtacattagaaagaggaggatggggagagggaggaggaagactggaggattcatttatacttgagatggttccacatgctgttggctgagagtctgcttctgctttgatttatcccaaagtttggctctctacctttgacgtgccttttgtacatagctgttagttttacaatagatgatgtggtgtccgaggttgtaacttgcttcttgcgcggatttcatgttgagagtcatgccatctcctgtcacatacattttgaggtacctaccatctgaagaggatggatgactgttaatttcagttgactttaccagtttaacttctatcccaaattgctttgtatggtttataagagtagcttgctggcaactgtttgcatggacatgtcgtttttctaatggatttttttcgctctgctgtgctgctgttgcctttattccagtattgtttaccaagcttatgtctccattaaactttacatccaacatctgttccttgccaaattttaaattatcagtacccttccactttgcatttcgtgttctgctaaaggatcatggctattaagtgcatataatgcccatagacattaaatatactgcaaaggaatacctagcttatgctaatttttttaagaagaaatggtgaagtgtccatcaagacaagtatggtaccgggcacgctctctgcatacagatacggctcactaaactcgcctaatggtgcacctaatgtttatcatcagtttgtcattagtcaagtcaatcatcgagcgaacaatctaacaggcagtcaggcaatggcaaaattagacggcacggctaataagaggagagagccccacaaagcggtaagtgcagtgcatgacagcatgagcatgacaagactgtatatgtccagtattgcatacgcagcactggagaagtggtctggaaaatggaggctatccgtgagtaagaacataagaaccaatttggttatttcgtaagtagcaacagcttgtttcgaaatcttcagctcctccaaacaaaatgcatattctcacctacccaaattagttatagaaacaaaaagaaaattaattaaagtcaaaagctgagaaacctaacttaacttttctagctgtttctcgaaatctcaagctcctcatataataccaaaaaaaaataaatttaggattattttagttggttaccgaataaaaattcaaatcttgtattttgatttagatttctgcccaacaaaaactgcctgttaccggatttcccaggacggtaattattgacaaaccggtatttgaaactgtatcagcagcagggcagaggcagaggcaggtgcacttggaaaggcgatagtgaggcgtgtacttggaaaggctgactctgcctatgcaattgcacaaacacacatcacacagtgcaatggcaatgcaactgcaaggcagccaaaaagggaggaggaaacagaggagaagtgatggtggtggccgactggccgtgcgagcgtgcattgtctaacgtgcatctatctatccccaccacaaccaccgctttggtggtgagaatgagaggcattctgctcctgggatgggagtgacattctctgcttccagtcgttgctgctgacgactgcaatgccatagcagcaatgatgcttctcttctcttctcctgtctctcatctcatgtactactactaagatcaatcatattcagacgattcctacgcataagctgctacttccaaatcattatcgccatcagccttgtgttcatctgtactagtgtgccaacacttgtgctaatgtaaatcaatgctttcttggggccactagtaatggatcaattgctactagtagtcattaattcattatgcaccatgacaaattgacaaattgatcatcactagcactgtgattcttccaagtggaacctgacagctcaacacgactacacaataggtaaacaggaaaaaagagagaaaataacaagagatgatcccttaaccaaaatcatttttttaattatgctatgaaatacaaagaagaaaaatctcattctcctaactgattagattttggaaggcatgtagaccgagcaaacaagaagaaggaaaggaccaagaaagaggcatatgctcgtgattccacagccagcgacctgattccttccctttccttccttccagcatgcagtagtacggacgcatgcaggcaggcaaccaccaatctgtatctgtaatcagcatgctccatgcttgcttgtttcggttgcagaaaacaggaggattgtcttgttcgtttgcaagcatggcaaaggccagcaacaaccaatccccccggccatatatgcatgacggactgtagatttgttcatatctacatgcatgatctgattatcctatcattatctgcctctgattttaattatgcagagttgttttcacagggatggcactccatttcttgcttataccgagttctgaattcttttttttgttacacggaaaacacatacgcacgtacaacattacacacgtataacgtatagcgcgctcacacctattattacagtcccccaacatgcgctcaaagagacaaagaccaacgtcaattccttggcctcattaaaatcctattgaaaaggcacccatgtatagcacctgaatttttctattgaccacatgcatgatgcatttgtacaactgttcatcagcagaaaggtgctacggttagtatggacctccagttgactactactactacaactgtacagtgaaggactgaactgatctgatcaccagctatactggtatcaatgtaggtacaggtagtatgcatatgtatgtaggagtgagcaacttagcattccgtatcagtgtagggttggatcgacgtgttcactgcaacaaccataccagcaacaaccttcctccatcttgcactgcactatcacactacctcttttagtcatctcctcttttcaattcgcttgccttttcttttcttagtgctccagaatcgcttgcaccccactccagagatcgatgtcgatctcctcctcttctcctgctgctgctaattctctccaagacctgaactgcacctggttggttgttggctatagctccaattctgcagctgcagatcaactgatgcaacaattcagcatcagcatgtttgaactctcaact

SEQ ID NO: 18724 - DNA, 345 bp, Oryza sativa
caaacatccccaaagtgtccaggcctctcttcccatggaccaatagattccctccacctgaatgcgtttcttaaccattcaccctccacgaagcaacctcctacaattgtttgaatggaaatcaagtcaattatcccagacacgtctgacatatatgtgcagatatcaagaacttgattttcaattggaaaatatagctcataccagggaatctcaagaatcgtggttttaagtccaacatcatagatattagttctgtgcgaaaaccatgtccctgaatgtgtaaaagaaatgttggaagcagtagaaaaagcccatgaagatttaagtggtatcatacactat

SEQ ID NO: 18725 - DNA, 793 bp, Oryza sativa
ttatattttgggacggatggagtacaacattagtgcaaccaaatattaccacattgtatttcgaacatagattaatggataccatcgtaaaaagcagttccacaaagattgtacaagaagccatcaagagaccaaaaaaagtagaactagcatatcagtaccctgatagcagcaaccaaaaggaaacaaagtatgtgatatatgattgattctacccattagtttgtaaattgaacaggaaaacagctatattcaaatccacaagagaacactactacaatgtgatacaaacctaacgctccttatcattactccctctgtttcatattataagtcgtttgacttttttcttagttaaacttctttatatttgaccaaatttatagtaaaaatgagcaacattgaaaacacctaactagtttaattaaatttaacattgagtatattgagtatattttcataatttgttgttttgtattaaaaatgttagtatatttttttataaacttggtcaaatttaaagaagtttgactaagaaaaaaagtcaaatgacttataatatgaaatggagggagtattagtcaatttcaaaatataatcatcctcaaaagacatagaaaaacataatttttcacaacaaacaaaaaattattacacatcaaacagaagaatagaagatattactaattgtaacacaacagcttaacaaatcgtgccattatttgtcatttttcaaaagataatcatcctcaaaagacagtgaaaacttattttcccaagaaacaaaaacaaa

SEQ ID NO: 18726 - DNA, 558 bp, Oryza sativa
cagcagctggctaacaataggatggtcgccatctcgcacgcaaataaagagcgaatggtacacgagtactacgccggagtgctaggctccaccccttgaacttcaaggaagcacacactcagcttacccttctttagccctagccgacctgtcatgcacaacctcgaggtgtgcttcactgaggacaaagtccggaatgcaatcaaggacacccctaatgattgcgcgtcaaggacggatggcttcaccggcttgatctacaaatcttgttggtcggtcattaaagaaaatatccttgtagccctcaaccaactctttcatctggacggatcaagatttgacaaagtaaacaaggcccttataactttgctacgaagcgtgcggacgcaagtggcttgaaggactactggcccataagcctttgccacagctttgcgatgttattcacgataatcctatcaaagcaattagtgcccaaacttaatttgctggtcgccgacaaccaaagtgccttcatcaagtatcgttgcatccacgataatttcgtgcttgtacacc

SEQ ID NO: 18727 - DNA, 363 bp, Oryza sativa
ggaatgcagggctagcgccaggctctttaggttagccccttcagccatcgatcctcccagaaaaggatgcaggtcattatcgtagacacgaagtcgcattcttgattagagatcggcattggtagccctttccagggcttgcttgcattggttcgcagtgcccaaagccaccgagcatgaagggccagacccattagattgaggtcatggattccaagaccatcgtagttttgggcacacatacattgctctaggcgaggcggcagtggccacccttggctttggctgttccagtccagaggaaaccccaccttatcttattgatccccttgataacccatttgggaggggacatggcgatca

SEQ ID NO: 18728 - DNA, 295 bp, Oryza sativa
gtgcatcataagaagcaaatgaattagaagggtttaatgcagccatgcaaatcaacaactccatattaacctcatcaaacctattgttaagctcttggctaatcttgtcaataacaccaatataaacttctcttctgaaatgatcatcatttgtttggtccagataaaatcttggagatctcccatgaggcacatatttctcatctaagagtggaactttaatgctatgcttagtgcaaaatgaaagaacagtcccttcatagaattcttcccaaccatcatttcttaatttttg

SEQ ID NO: 18729 - DNA, 1177 bp, Oryza sativa
  unsure (1)..(1177): unsure at all n locations
nnnnnnnnnnnnnnnnnnnnnnnnnnnnnnnnnnnnncatattccttttgacttttactctattcaaacttctttagattttactaagtttataaaaaaataataatatctatagcaatatattagttttattaaatattatattgaatatattttgataatatgtttgtcttgtaaaaaaatattactatatttttttataaactgaatcaaaataaaaaacgtttggctagaaaaaaaagttaaaacaatttataatatggaagaagtattattccatacaatagtactattataaaaataaaaccccatgcttattcgatttatttttctatggtcgtgctaataaatatttatagattcatacaaagaaacatttttagatggttaaccagcagtgttgataataaacacaaaacagcagcgtgcaggaagccaggaagaggaaaaccgacggcgacgggacgcaccgggccaaaattttcaaacttgttactagtactgttctcttcccttctctccacttcgcaatggaaaaaaaaaaaccgggaaaaaataaaaatgtttgggcgtaccacggtggttgtacctagcagcaacgcgggagcacgacgccgttaacgcgctcgcccgcgcgaaatgacgctactaccctcgttgctcttatccactcgcgcctcgtaccaccacaaccctcccggtttccctcgtaaatccggaaaccgagcggaggtaggatggtcaattcaccgcgccgtccgacttccccaccgtggcgttggatataatcttctcgtatcgtctcgtccctcttccgttttttcccccaatttctcgtctccccccttcctccaatatatcggcggcgatcccggctcgaggagaggaggctccgccgcgattttttcggtgtcgcatcgaaattatggtgagttggtttcctccctccccctaattcccgatccgcaattcgattgcgatctccattgcttgggttctgccttttttgggggaatattttgggcgatatcggcgaatatatgctgggctctcgcgcgattcctttttgattatggtggttggtgttcggtgcgttttggttgaggaattttggctctaattcggtgccattaggtgggtttgtgtttaatttggggatgtttctgaattgtttccg

SEQ ID NO: 18730 - DNA, 887 bp, Oryza sativa
  unsure (1)..(887): unsure at all n locations
nnnnnnnnnnnnnnnnnnnnnnnnnnnnnnnnnnnnnnnnnnnnnnnnnnnnnnntgagttctgagattgtcactccaactttcttgtcggctctatcatgagccatgaagtattttcttcctaacaaatatgttctctaaatacaagtattcaacttagttctatttaactcttgaaagtggaatctcctcgtgtggttgataagacattctgtggcccctatgttgcgagttattaagatttgtataaccctttttctcatctaccacaaaccatccctgctgtttatcctcagcttcttcaacaagaagccttcgcctttctttcttgatattttcccagtctcccagagacagctgcctgcactttatgcagaaataatgtactgactaaacagatacaaagagacttacatggtaatcctccatttctatctcatattgctcaagtcgtctagtgtttccctcttctctccatctggaagaggggagtacatgttggccattgctttctttctttctttttttcaaattagtctttaccttctcgaacgcctctggctataagagaagtcattcttcccaagatgtttggtgcattcctaatttgctcgccatagggaatacagagatttttggattgattcggtcgccaccaatgtagtgagattgtttgtagcatcacgagtcgctgcgaggctaacgatgacaattgacaaaagatgagataatgaatgaaatcgatttaactttttagtagggactcctccatggctctcctaaaatataacgaagaaaatttatttaactttctgtttttctggtggttctttgagggattaaagatagagtggaaaaaaaagaaatagagccttacccagagacta

SEQ ID NO: 18731 - DNA, 844 bp, Oryza sativa
gaaatcaatcacctcatgtatggcaaatgcaaggatttttgaggagaaatcaaccggctgatgtatagcaatgttgaataagaaaacattttcccccctcaataaataaataaataataatatttggagtttaactttaactgattttttgtctaatttcttgctttaggttttgaagctggagccaacacatcaaacattgacccatggtccatcattggagatgaatcctctgttcacgtgacaactgatcgctcatcctgtttcagtcaaaatcctgttgctgtaaggatagaggttgtctgtgacgattgtccagccggtggtgttggaatttacaatccaggattttggggcatggtatgagttctatccatttttataagtgcattcctatatgaataatatgcaaaatagagcttgtaattgaaagtagtatcctttttttttacgacagtttacaataaacagtgctgccacagaaagaaactatagcaaagttatttattctgttcgaaatggtgaagaaaacaaataattaagctaacctattttttgtttgatttcaatttgcatttatcttttccttgcataatgctggttttttatcagattgttgtgcattgctcttggaaaagtgtaatctatagcttttcttcgaaccgtttcattttaccttctcatattttaatgggattttaccttctggttttgtgacgaatatgatcatttcaattttcagaatgtagaagaaggaaaggcatataatctggtcatgcatatcagatcattagaatcggtggagttgacagcttcactcacatgctcaaatggatcgcaaaat

SEQ ID NO: 18732 - DNA, 511 bp, Oryza sativa
gagtttgcaaagggaagtgacaaatcaacatggggctctgttagagccacgatggggcaccctgaaccattcccactgaagtatgttgcactagggaatgaagattgtgctccattcaagctgatataccgaggtaaattttgcataataaacaaatagtattgtccttcgtgttaatgctgcgatgattggctaaattcatcattctgttttttatcgatctgcaagggtaatagcactattttatttaacttcaccctttttagtactatctgattgcataatggagatattttggagaaataatagatgaaaaaattggctgcatgccttgtggcagaggccagggatgtaaaatatttccattataaaaaaaataatagatgaaaagaaaagcaagaagttaatttaccagtctgctgttatgtttcgaaacagactttaccagttttagaaggttcattagttttacatttgattgaggccaaattggctacgacgtataatgctg

SEQ ID NO: 18733 - DNA, 409 bp, Oryza sativa
tctccttctttatttacttgcttgatctaccgctatttctattcattcttcttgtaacctttaaaaattagatcttatagtttttaaagtttatagtcacgttgggtttcgtttttataatttctagatgtctcgtcaaacgttgccattatactcctctacggcccgtccaccgtctcttctctttattgtcattgagatttaaaattcgaacataattatcgtttgggttcatttttacttcctacttttcaagaagtctcgccaaaccgttagcggctttgccattgtactcctttacggctcgcccgctccctcccttctttattgccattgagattttaaaattgaacatgattatcattggttttttttactttttagaagttccgaacctttaaaaattaga

SEQ ID NO: 18734 - DNA, 595 bp, Oryza sativa
tatgcataacaacggttatttccatcgtgacctgaaacctggtatacctttcgactatattctgttgaagttataggctgtctatataccctagaagttaattagccttctctctttcctctttagaaaatctgttggtgacagatggcactgttaaaattgctgactttgggttggcaagagaagtatcttccagtcctccttatactgactatgtttccaccagatggtgagtttgtgtttcaaatttatctctgtataaccagtgaatatgtatacaccactttatccaaattattgtgaaatggtgaaggtatcgagctccagaggtgctgctacaatcgtcagcttacacacctgctattggtgatgcctattatcccagcccctgcattttactacttccatttttattaatgccagctcaacatgaaatttgagtttgtgcatataaaactcgcattgcatgaaactactgaattatataactgatagatgtgcacttcctcagatatgtgggctgttggtgcaattttggctgagcttttcacactgtctccacttttccctggtggaaggtatgtatgatactgtt

SEQ ID NO: 18735 - DNA, 560 bp, Oryza sativa
acaaaaaaatgggacagcaattcgacgtggagacaacatcaccagttcatctcaaagaacttctgatgtcttcattgcagcacctacagcagaaaaagaaagagttaaagttgcaaggcctctctctaactctactgattctgcaccaaagaaagatgggatgggacagcgaatcaataacattagcatactggttcagaagagaactgatagtccaaacaaagagactgcgaagaaagaagctggcaccaattctccactgcttccaagccctgctaataccatgcataagggaaatggtaaggttggtcggccaatggagattccaacacagaggtttgacagtccatcgacttctagtgcaacagcagggacagatagaggaatgcctaggtcatctatcccaagcccaagtattacaatacgaaggccaaatgggcttgtacgaccacctgagagcatttccatttcttctaagaaacctgatgcaggaggtgcttcccctgctatggggaaggaaaaggaacagggtggaaggatattgcagaataatattatcg

SEQ ID NO: 18736 - DNA, 564 bp, Oryza sativa
aaactacgatatactccctccatcccataaaaagaggattcctagcatcccaaggcaaatttagtgagaagtaaaatgactaaaatgaccctcatcaatagaaaaggtagtactggtgataggtaggtaaagattatttaagagataaaacttctcgttttatgtgttgaagataggtaggatggtagaagttggttttttgtgggataaaatttaaactctagaagttaagttttttttttgggatggagagagtatcaggcaaggtctccggttcctgcagcttgtccatcagctccttatgccacttgtctgggcaatctccttccatttgtagcagtttccatctttgcacccacgccagggctttgtagactacctgcaaaggtgatttagcaattttattttcaaaaacccactcatttctatttaaccaaatcccccaacagaaccaagcaacgaacacaattgtgaggtttgtttttagtttcttctttagcatcctcaagccatcctcaaaatcatttggtatttctgacagacccagagttactgtcaacacac

SEQ ID NO: 18737 - DNA, 737 bp, Oryza sativa
gctaatatgaatatcagtcctcccaccatagcgcactagttgatgttttctcagtatcttctaatattacaaataaggagacccccaaaatttaccatgttcttaaatgtcacagtatccataattaagtctgcattcattttctgaaatacatagtcatcatcacaataatttgaccttatctctcttagatctttactgattccccttccaaaacttcttaaatattgttgaacgtcatcgccctcaacagtttttgttggttcatgagtgaaggagaaacaagaacttctgccttttggtgtgtcaaagccatcgagatcatcactggagctatttgtagttcttgaaacgggggtcatcatagtatgactataagtatggcctccagacacatcagatccagttaagctaactgagcactgggtttggttgtcagattcctgggagggcaaaaaatacttgttacagtgtgagaatgatcgttactatccacatcatatacctacttgtctttctactaaaatgctgctggcaaatcaacaagagtatgtaatatgattccatacaacacattaagtacaatgtagattgtagacaattcaggaatatttgagtggataccaataggaatatgaaaatagctacaagatgccaattaatggagagcaaagactgtactatttctgaaccacatagtaaaaaaatttaaatgtttaaaaaaatgttgatggagg

SEQ ID NO: 18738 - DNA, 478 bp, Oryza sativa
atacaatggcagaagagtctcggtagaatggtaagaataatttgtttccttctgaaaggagatagcagtaaataaacttggatacccccactaggccatgcttttttcaagcacctcaaaggtagggctggacgaaaaaactcatggctggtgaccaccttgactcaactcgacttgttgtgtttttctaacgagccgaactgatagcttgttagcgagtcacgagctttataagctgcaaccttagcatgccacattgcagcagcttggcggtccaaactcatctgggaaagacccaactcaattgatcgatcccctgaccctagttagctgtccccgatagtcattcccgtccccttttttttacgaattggtcttttttaaaaacttattttgaaactagtccctgcaaaaaacttcaaccaaaaataggtcgtggactccgcgccatgaacattggcgctaagctataacgtat

SEQ ID NO: 18739 - DNA, 718 bp, Oryza sativa
gatgttatttgtctgagaataatgctctatattaacatggtagtatttgtcattctgacagcaactttgttcctgggatccacgaagaaggccaactgctgagcaatcactacagcatccgttctttaatgtactaatttacacattgagttattcatgggaactatacttcgcttttctttatgtacctaagacttttgagttgtctaggtgggcaactgggtaccaaggccactccatgcctctcacacaaagacaattgaaactagtgagtttctcccctttttctttcaggaaatgataatttatgtattctgttttggtgatttgttgttgtttctcctattgaactccttttatttttgtaggaccgaatccaaggttggaactgaacctgtgggattttggtacagaacctgaggacaactaccttgatttaactctgagtctaaagccaagtttttctggaacaggtgcctaacataattattcctttggaattccttccggctattatcttttggtttatttggctatatttccttttctgcttgtagatttttctaacaatgttccagagcatacaaaagaggtgagattttaattgcatgacgtgggaacatatatttgcatgagagtggaatgggtgtatctgaagttcgctatcatatcatgcacgaaaatatgctgtacccagatttgaaaatcttctgtgcag

SEQ ID NO: 18740 - DNA, 256 bp, Oryza sativa
ttactgtctgctgctgctgctgctgctaggccaaaacgaggaggggggttgtgtctccttgcttaatgagctccaagttgatcttttgggccaagttgagtctcatggatgtgacgctctcagcacttacttgatccatcaccgactcaaaccagcagggcgccgcttcttctgtccttggatgcttcttccaccaccggcagatggccagggcaactgccaacaggtagacgccgcaatcgtacccattgctctg

SEQ ID NO: 18741 - DNA, 974 bp, Oryza sativa
aatccagaaagaagcagaaggtagccgggccggatggcttctaattgtgcctgggattgaagttggtcccggggttgtgcttcatgctggcgtcgaactccaccttgggctcgccgttcgcctgatgaacgccattgactcggaaggtgttggtagccattgccgccgtcggcgccgctgccctgggctgctgttgctgcagcagcaatctcctgctactcctagcagcaacagcagctactgcattgttgttgccgtcacgcaacaagccggtgctggtctttggtgatgcagcagcagttacagcgaggagaatatggagcaagaagatggcagcgaacatgcggtgcaaagccttcttcttcatggtgatgatgctttgttgatcaactgtgatgtggtggtagttgcagtactgtgtgcgtgtatggcagttgggcatcaagggggagcaatgctggcttatatatattgttcttgtaacttgtgttacacagactagcttgtttgtagtagtaacatgcagatgcaatgtgcaggcacgctgcatccactacttgggaacatgcagagaacatgccacacatttccctgtaaattttagcttctgtggaatattttgttaagaagacaggagccatgcatcaagtgggtctggaacatgccaccctgagacctcagttttgttttgcagacctcaaattgacaagctaataatagtgctgtttctctttgactgaaaaatctccttttccttgagcgtctcagatgatctaatccattaaaatgcttcacattaagcatatgatccataattctttctagggatatatgcgtgagtgccgaccatgtgagagatgcttctatttgactaatagcatctcttgcagagttgcagtcaggccggccgtatacaaacaaccaaatacaatacgttcggtcatgtgagcagatcggacattcatttttttcaa

SEQ ID NO: 18742 - DNA, 653 bp, Oryza sativa
gtagccatgcaggacagcaagtgaaacaaatttcccagattatgtgccgtcaaattgaggaactatattgaccgggcatgcatgaaaataacgttcatgcgtaatgattgatggaatataatggcgttgccttgcttgggtctaaacgtgaaggaacatcgatcgatcatacatgcgcgatagcgatgtgactcatttaccgctgatctgatctgattctgatcgacagaaatcactgaaatgcatgcgcatgcgtgcactgcaacacaaacatattgattcatccatggatcgatcgacagatatatctagcttgagtttgaatgttgcatatataataatactagcagctcatttatgatttctcgatatatatatatatatatatatatatatatatatatatatatatatatatatctgatgctctcttgcgtgtccgtttgcactcgagatatgattgatatccacgaattgaagaagaagttgcattgcttgcaagatatatatgcgacagtaatcgtcacatctgtcctggagaatataatgcacaagtgttcattccagttccactactctactcttgatttctcactcttctatagatctttaatttctggtattattccctaataaaaatctttaatctcttc

SEQ ID NO: 18743 - DNA, 305 bp, Oryza sativa
agcttatacatttttaatgtcatattattgtatggactgttttatgaataagtttattatatatatgtttaattgtagaagacaataaaaaataattttcattaccacatatatgtttctctttaacaggatatggcctttgctgaatcaatatggacctttatgccaggaaagaagggatcagttgttcaggggccaaacactagaactctaacaaatgctcatgatggtatcttggatgatattaattgtgctcagattgctgggaagcatgtgggagatcattccaattgtgctaatgtcat

SEQ ID NO: 18744 - DNA, 4980 bp, Oryza sativa
  unsure (1)..(4980): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaacggcttaacatcgactcttagcgtttataaaaggaaactttgttgcatgaggatagataaaagaaaagaaaagaaagataacaaaaaaactgttttggtgcattaatgtcagaaccttttgtcgtcttatctattgtaagagatagtatctgaatagagcctgtagcagactctagctggtgattggtactattatttggggcatgccatttgtcaagtaatccctgtgaaatttcctccctcgcccaactctagtaccatatcccctacaatttgtcctgttatagcattactcaccagttcataacaactactagcttcttaggggagccaggttctgaaggctcacccttccaaaagaacaactttagggtattcctgtcagatgctgatatgcattctaatatctgagttgtggagatgatttaggaaacaaatctcaaatagtaataaaattttcatgcatttgtatcaaccttttgtgttagtgatttatagcgtggaaatattattgcatttcaattcaactttgtattggatattatgtgagttgttttttgcttttgcttcaagtaaccaaaactgatttaacattatttacagaaatgtatacgaaatctttgtataaaaatgtcaatttatatcaattttattagagatgcaacaagcctctttaatcgtagttgtaaccacagcgcaggcatatacagagtaactgtgtacactttttgatatattttagtgatgttggccattgcaacttttgcatgtttcatgaatacttgtgtgctattatctccttgtgaattttcttgatgcacagcacataacggcaaaaaacgaaatactttgcgtattaattattggttcatggcggcaagtggcaaccaataggttttgttattgtcttaagctgactacatttccctgaggatattttgatattgttgacacaaacaagttggaaaagttaaaaaaatatattggtattagtggtgattttccctagtgcaggctcatattttgcatattttggtagtatatatgtcgcatgattaggtccacaacaatgaaactgacctgatgaagttcatgttagcgagaaccactatcatgttgtccaccatgaaatatgatttagtgtgttatttgtccagtttataaatttggggtaaaaaacaactagtttcttagttcagggcatatgcttcaagaaagcactatgagcctaggcccaaacacattacattaaaaaatattgaaaaaaattacactaaaacagcaacagaacaccacccaaggtagttcatctgcctaatgcaccatgtataatgcccagttcaaagttcagggtgaaaaatggactagaaggaaatttcaaatgccaaaaaatagacttttacctttttataatttatagtcaattacagttaccaagttgaaatttgaatgactaatgttcatgccttgtaccttttgaaccatctagtcgtattatttggttcctaatcctgaatatagttaaggcaaacgaagagaaatagttacgtaattttgaatatgtttgtatatgtactttattttaccaagtaaacttgtattcgatgtgattgcaaactgttctaccttctttcagttcatctgttataattaatttttctctaaaccattcttttttgtcatttctttgccaccaatgatatcattgtactacatgatcatattatcaatatatgcactttattttaccaagtaagcttgtattcgatgtgattgcaaactgttctaccttctttcagttcatctgttataattaaattttatctaaaccattcttttttgtcatttctttgccaccaatgatatcattgtactacatgaccatattatcaatatatgctatttttatgtttcattttctgacatttttcactatctgatataatggttctaatgtcattcaggtgcccaatgtggaggtccttgcgcgtgtttcatatattcttaaggaattcgggttttgccctaacgaagaatacattgacaccatgatcctgtactgctctttttgtattcaatataatattttttttctatgcaaatgtttgttgtttattaattatttcttaaacttgttattgaagctgtccatataacaagatttcttacagcgacatagttcacaaaggtgtgtgtttattatttaagtaactgtttctgaatttctcagaaagagcctttattaaattttttatggtcatatagatgtaaccaaggctgttgcacaaatgtctacttctctgcctgctgcagaaaaaaaggtaattgtattccgatgttaccaatgatgatttcttatattcaccttgttaattattgtgcaacaatgcgtggggagtatgatgtaccaaagcatgcagggagcagcagcagctaatgatcagttacttaggttccaagttaggtttgctattagttgccatcttactggctggtgcatataagccagagtgcctgccagatcattatcttgtagttgggattctagaaaagtagaaactctatgtctggtctcttctctatcctggtaaaaggttgctcggcagtttttacagcagtgcgtcattctagattatagtactgtcaacaatctgaaaataattgattttctccaatgagatagaatgttttgctttaagtattgtgtttagatttgatctgcctccctttctgtgtgtgtgtggtcttgcgatagatttttggtgtgcaatggtttgttttgatatttgatcatgacctagttaagatgttagaatgaacgaactcagtatgattagtccttttgtagttggatggtaataaatcaagctgatagatgtctgttatgcttctggttgttatgtttctgccgtgcagctgcttactggttcagctgcttttgcttaagcaattcagtttgttgacatcacttgaatataaccagaaaacaatttattctgttgctcaagtaaaacacctctcccaggatatatgaaaatattgtgaatcaagtgctctttggttgatcaagctggaatttaacaatttttttttgggtttcacaaagcttaatcttcatttaattatgggacaggctgcgagaaaaaaggcacttaaaggatgggatccaacattcataaagagaaattttttcccctactggagatcagtattaggggcccagctgtctgtatccaatggagcagcagatgagaagtcaatgcttcatcgtccacagttccgtaattcagtagtgagtaacgagtcttcgagtctgaaccataatattagtttcttgggaagaattcagcaactgagtggtactcatgaatcgagaaggtacagtactgctgcattcagaatgctcacgaaggtgctaaagacatgagcaaaaaggtatgtcgtgagttttgtttcagtctacagttactgaacatgtggaaatcattgctgtgacgcctatattattaattgagcaatatatcgtaatgtcaagttgttagggtacctcaatagaatttcacttgtttaaatttacagtaatattttcttgtttttcttcgtgcaggtgcctagtggcatgttgctgttgataaccataggtctgcaaagtattatgctgcgcacgtcttttgcggacaccttaagaaggttgcgaatatacatgtgaccaccaaaaccttgttcaaagtgatgctaagtactttaaattatgatgaaatgcaacatgccgtgtgttgtattcggcttgaaccctcgacccgcgagatgtggacatgcgtgccagcatgttgtacttgtaccaggttcaacgttagcttgaacactgaacaagttaaatgtgttgcaaaatgccatttttctttatcagcaatctcttctacctatatcagggtcatgattctagaatgttattgggccacgtggcagcctgaaaaattagctaaacatcaccaaaatttttgccacgtgtcaatcagatataagctcttgtgatgtcccttgcacatcagaatctctagaaaacccattactttacctatctctttgcactaatgcagttgataagtatcgaccaataaaataataaagagagttaataagtgcttcacttttgccaaccgatagccggaatcagcttttttgtgatgttttgatggatgcaaaagatatagttatatttaacatgtaaaatctataactaatataaatattcgtgtttttccggtcgtcacatctaattttcgtccatacacaatccgattcggttagcaatagccatggaataaaattgcaaaaaaaaaaaaaggcggccggcgccgacgcctgtcttcacgtcgtccaggccgccgcctctcccgctccgccgcacatcccctccccccgatctagcggaggggagggcgtcgccggccctcccgccgccacacaaagagaaaggggaagaagtggagagagtggccgccgccgccgctcgcggggaggagggcgccgccgccgccgctcgccttgggggaaggggggggtgccgtcacacaccggcgcaccccaccattgccgcgccgtgccggcgagaagggagggacggcgcccgtggcgggggagtcggccggctggggggagggggagagacgccggtggggaga

SEQ ID NO: 18745 - DNA, 46504 bp, Oryza sativa
  unsure (1)..(46504): unsure at all n locations
ccggctcggctcggctggggggagggttagggttagggtttcatcaattttaatctgatctgagccgtccatcaaaactaacggctgagatcgattgagggtttgggccgcacgtgggcccgcggtccactaaatgaaaggagtatgggggtattaagtagactttggtctcttgcgggctgaagaagaaaatgggttgaaaaaggcccatagagaaaaaaggatttttatttagatttttatttcaataaatgctgaaatgatatttgtattatcaaaattagcaattaagctaggtaaattccaataaaatttcaatgagtgtaattaatatagaaaatttaataaaagttaaatccaaccacaacattttatttcttacacttactttacttataaattaatttaattgtatacctacctacttaaaaaatacctaaatatttcagaaaatttatatttcatttaattagaatttaatatgttttaattcaactttatctgttttttctattcgttgcaacgcaatatcacttttgctataatttaaaagagtgtaattaatattgcagaaaattttatatttcattaaattacaattcattttcttcatataaatagttcaaatcaaatttcagtcaccatatcattacccggtgcaacgcacgggtattttgctagtattatacaatatttatagaacttttgcaaaataaagagcgattaaaatttaataggctgtgtcaagtaaaaaaaacaatcaaatactaaaagatatgttacgtactcccttataagaacatctgttagccaatcaaatcaaggtatatatacatatttaattaaaatttaaaaattgataaggacgcaaaggatatttcttgccactacaaatttgcatgagaattgctagaaataaagttttcagggttggagtagaattttttttttgttagttctactttcgtgagaaatgccccgtcattgtaaggtctaaaacattatttgaaattgggtataggtattaataaactaggtgagtttttagataatggataaaatccagtgtttacttcaatagaagctatagccattattacatagttcttagttgaaaaccaaatataaactaggtgagtaagtggaaaaattaaataagaaatattaaccaaatataaactaggtgggtaagtggaaaaattaaataagaaatattatgattggttgagacaagggactggatactcaattgctatattctgatataaactttgaatgcttatattttgaacgaggaaaagatgttcttttatcataaattcgatttggtcttttttatatatataaaaaacgagtacggtcgttatttaaaaatgtccattttgtaaagcttatttttaaagaccatggcttatttagctgaatataaagctcgataattaatatttttaaaataagtacattttaaataatgtagacttacataaaaaaacagtccattttataaagcttatttttaaagaccatggcttatttagctgaagataaagcttgataattaatatttttaaaataagtacattttaaataatgtagacttactaaaaaaacactttttaatagctatgccataaatagattaaaatatgatgatctttaattgaataaatctacatgttaaatgaacaatttaatgaagttggcctaatcctaccaaatcttttgaaatttctacgttcatgcataagaacatgctaaatggggcgcgccatttggcgcgagattttctagtatagtactaatatttatctgttcgacgcctccaaataattcgttctcgtgtagtcgtcagctacgtaccgaaagctttgcgctttgcatgcagcaccatcaccatctagttctactaataaccagtaagtccatacttctcgatacaactatggattaaaatataaacatgtaaatttaaatgcaaactacaaaataaatataaacacggatgtttaaattcaaactataaggtataagaaagaatacattcttaatttgtagattgagagattgagttttaaattgaacgttatggaaggatggaatataggtttacttaaaagccgtgcgatcggtggaagactaccagcacatcagcaatttttgcaaaaaaaaccctacacttttggttaattacgcaccggtccccgctaatatccgccgtccgatctcgaggtagggtcgatctggccgtccacgttcctcactgtgctggcccttccgcacccgtgggatcgtcggatctctaacggacggtgtggatttcgcaagcctgaacaaaccctagccgcctcgccctcctcctccaatcgcgccgcagcctcgccctcctccttcactcccgtgcgtcgtcactgccgcaactccctcctcttccactccctcaaggcctcaacctactccagctatctcgccgtaccgccgtcgccgcttcctctcgcacgcgcgccgccatgccctcttctcttcattcctcgcgcgcgccgtcgctgtcgtagcttcgtcgtccttcgcctccctcgtgccctcatccagccattgttactgtgcccgcgctcccgcgccggcaagcgagtccgtcatgtccaccagtgaggaggcggggcttccagatccggcaacagcggcctcctcgctggtggattgtcggttgcccggacgagagggatgcgagccactgcactcctcttctcctctttcatctcatctccacgttagcctctctctccctcaccctatcctctatgcctgatgcgatcccaagtccgattccctcgactttccaggtggatccggtcgtggccctcttcggcagtacaacgctactctccactgtcttcctcacccgttctccatgccgctcacctcccctcggtgccaggatggggagagcaagagcagcagcttgggcaccaaagccacgacggcggaaggcatgggctatggcaaagtacggcgacgacggcagcaaggcacaaactatggcaaggtatggtgacgacggctgcaagtaaattgggacattgtgcttcggtttttctcctagatgttcttcattctttcaacatgactactgctaaaacattgattctccctattatatgcatatatacatatctgttctagcgcctgctctctattcttgatttgctgctcattgtgagtttcacatgattggtaggaaggaaagaaaaaagggagtgaaggctagattattcagtactaatgtttaaacatcaccacccaggtacagatcaaattaatcatctccttctgtcatgcatatgttgtatatgaattgagtgtattgatattatgattcggtttgtctcctagatgcccttcttcattctttgagcatgagttttaacagatcatttgtctatacaaattagttttacctgtttgcacattagtgttgcagtattaatacgaactgttgccatggtctagctctctatgtactttttggttgggaacacaagagtgacatatatgcctgtcattaatctataataataactgcaatgctgtattttatctttagaattacccattgtctaaggatacaaaatatccatatgtaatttgaattggttagttcttacattttgcatatcaggtttattagtaccatgaattccgtttccataggctttctcaatatttgatacaaccaaaatttgctatattgactacaatgtgctttgaaccaaacaaatatgttgtaggtctgttatctactgtgcaatttggttattggaagtaatttatattaccaacttctaagccttttacatttcaccgttttagtttgttggcacctactgaacaatatttttcccatccaaagtattcatgaggttattttctgtttggaggtctagacagtcttctctggggtgtacattattatagttccatgatacatgccggttatttttgttgttatagtgagtgtaaaggtgaagccaattttattttccaaatggaacatgcaagccatgttaaactaagttcttcagctttcatccttggtaataagttcccttttgtgcttcttatcaggtgtgcaaatgggaaatgagcagcgctgtcagaaagaaatagaagacactaaacatggacttgaatctggaagtattacatatgacccggcaaagcttaaattttctgatgacatcaaagattctcggtgaacctgacaatcttgacatattattgcatccagtgttccaatttggcaagtccaaaagtaccatttgtttatatctccatttttactagctcactttcctgatatatgtatgatagatcattaggtgggcagttcttcctgccttcttcacattgtagttctcagtgtattttctctatattcttgatctatacatggacttggaataaggtgttcaccctgaataaggagggaggtcagtacatttttcctaccttaaaaatctgaagtatggttgaatattgtattagatgatattcagataatattgttagtttataacaggccagttggtttatacctaagccacttggtcaatgcaaagctatatattctataattcctttatttcttaccaaggaatgagaatgtgccagtatgttccttcccatgcatttgcctctgtttgattttttattgatttgttgctcctctatttttgcccctatatttatttggatactggagttcattcaaagagacgaacctcatggtcttcaggcttcagtttagacagataattgtagtgtctttaaagtaacgatgttatattgcggtacaagtcttttagccatcatatctggagtaggatccattatcccgggaattatattgaaacaactgcgatggttaaaaaattatatttaggaaaatcagttgaagattttgatattggccagaatttaatagaccacgaatacacatttttgcgatctcttcattatctcagttcaagctctgtgtataacaagataattggcaatatgttgagacatgccctgaatatagatggcagtatcaataccagatataaatggctaaaattgtttatatgaatgcgcaagtgtgcacacgacctaacgtggcattagttaccgggttacttggcagatttcaaagtaatccaggcctagagcattggaatttgtaaagaaagtcttgcgctatttgcaaggaacaaaaggcctcatgctgtctcacagaaaatcagaatcgctccagatagtggggtattcagattctgactttgcaaaagataatacaaagtcaacatcgggatatgtgttcaccctggtagtaggagccatttcatggaaaagctcaaaacagactatcactgcagggtctactatgtatgccgagtttatagcatgctatgaagcaacggggcaggtgaactggctaaagaagttcatacccggtttaaaggtggttgacagtattgtgaaaccaataaagttatactgcaataacgaacccgcagtaatgtactctcacaacaatcagtcaagtggtactgccaaacacattgacataaagtactatgttgtgagagacaaagtccgggatcaaacaatcagtctcgagcatattataacagaaaggatgctcgcggatccgctcacgaaaggcctacctcccaacatgttcaaggaacatgtagcatgcatgtgtttaagggaagccttatgaatcctggactatagggcccaaaagttaaagtatctgtttctgaatagagatgtgtatagtggctgtcgaatccagcggtaattaaccgtgacgatgaaacatgctctatatgtaaacctgtgatggaatagaaaaagctaaaagaaatagtgagatcaagggggagaatgttagatggatctccctctccttgagcccaacggctcaagggggccttgacccgcgccctgatcgggggcgcccagcccaatggctggtgggcctccgtcaccctgcgccatataaagaggggtggaggacnnnacnanncangacacgaggttngtnggcaccggcaattaacccacaaaccctaaccgatcaagggggcacagccagtgcgggaagactccatcgtcgcgccatgacctcgccggaatcgcctacgaccgccactgccgcgcagcatcgtcgccgccgcccacgtcaagcgcacaacgacaacgacgatggccggcctcacttcctcctcctcaacatcgaccggtcacatccctaaaccctctcacttcctctttgttagttcatctattgttgttcatccatccaaagtgttctaccgactagatctaaacctaggtaatccaatagacaaacctaacagttagtactcaagtgaggcatacatagctttgcagagttctttctgcaactagtcaagtgcgcctcccctgcccttcttcccgctcgccggcgtccgccgctcaatgccgctctcggagtcctccaccctcgcgacgtcggagctcatgccgccgaaccagaacgtgctccacttgaagaacccgccaccgccaccgtgccacctcctctccatgcttagcctgtccacctgagcctgcagcgcgctgcactggacctgcacgtcgcgacgaagacaatgacgaacacctcaaagctttgaattgatgaacggtggcggcggagatggccgtgatgaaaccgtacctggaggcgggcgaagtcctcgcggaggcggcggagctcgtggtgctgggcgagcacctcgcgcttggagggcagcgggcgccggggaggtcgaataccaggctgggcgcgccgaaggaggcaccgccgctgagctcggcgaggcggttgagcttgccgtgctcggaaaagagcatctgcagcacggagcgcacggggaggcggtcattctgaacggcgtgcgccaccgcctccgcctccgcctccgcctaccctcacaagagaagagaagaaaataaaagagaaaagagaagaaaagggaagaaagaagagataacgtggcatgctgacatgtgggtccacgtgggtcccacgctgactcagccgccatgtaggataaaactgggatcaaaaccaatacacggctatatgatattcttattattctatttctatatttactcatattctagtttcataaagctatactttagagaaggaaagagagattctaggaccacttgcccataagaataagaccgaacttaactacctgtaactgtcccaactgcccatgtgtactaaccccccgaaatcactttccctactgctacgttgaaatgaaaatgcccgcctccaatccacttaaagctcaatccaaaacatgaaagcggaatcacaactctcacgaaagaagggtctcaagcagtgttcatggtcactccaaacataggattttcggcatatactctttgcgaggcttctatctagatggttaggtcacaggagctttgtgggagaaatggatttctagtaaaagctactgcaagagatttccaattgggtagattaagcctaacctgttaaaatccgcgagccccttcttatattcggaactggtacagtaaaagctcttgtgggctcactccaggtgtagccgcaatagcaccagtttttatatctcttggctttacctttttttaaagaaatgtatgtgcgtagttcaagttttcgaccgattcaccaaggaatattttggttgcttttggcggattgcttactactaggttggatcagatgtcaacctgtggaggcaccatttgttactattggacaagttccttctttctttttcttcttgttctttgccataacgcccattccgggacgagttggaagaggaattccaaaatattacacggatgagactcatcgcaccggatcagtctcttagacggatgagactgatcacacctgatcagtgatcaattctggcacaatgaatttacgagttattttacacaatgaatttacaagcagatgagtttgcaacggtagacctatctcctgaaaagagatcagtaaacaagggaacgaagcgaccgataacgtcccctcggggaggagtgttttaagggattgacttcggctcctattatctttgtttacaaatcttaaaattggtgaattggttaataggaagtgcgcgctagcacgcttcatatttctagtaacaagggcagttgtttgtttggacgttagatcagagggcgctcatcccttgctcggtccctgaaaatgagataacataggcttttgatatctgctgtgtcaacaagccctggttcaatccctgcttcttccgggccttatcccgaaagaggtcaacaattctttttgtgtaaagccttttgttcactggtcttcacttcaagcaattccattagtccaagtctgctgcaattggtaataggagactagaggttgggacgcgccgcctgcacatagatggattaattagattattttgctgtttttaggctgaactactggtcttgtaagattaaagctgaataaagttgaaggcacatataatatatatgaatcaaacggcttatatgttagccattggtgagtaatttcgtacgagtggtgttacagaatctggagagaacaaaactattacatagccgttatactctaagaatgaagcactgatgcatatggaaaatgaaatcacatatttgcacgatgatatgagatcatgacgagatcttcactctaccctttgcaaggtcgatgtaacaacttggtcagaagagtcaggcccctgctttccttggctttcctttgatgagcacaaaaacatagttaaattgtctaagagacccagttttggaaatagatgacaaacagtttgatgcaagatggtttttcacactgaacaaatatagatgtacctcaactgtaaaaatatgactctagtcccacctttccaatattagagaccagctagcaactgttctaaaggacacactcatcactgaaactgaagctaagttatttgagatggactgaggagatcaatgtgtaacttgatttcttcagacatgaccttaaaaacctgcaggttaacgagaaagacgtgataagctacttagagtacacatgtgaactaaagcaaaataagctgatagaaatgacacactcgaagcttatctaaaggacttgacgagcttacaaaaagaaacacagagaaattggctccagttggtaccagcaagtctcaattttgaagatatagtagtatcagttgatagcaacaagaaaattgaagatgacattttgcagcttaaagttttactgacaaatcttgaagagcaggctatctacaaaacatggttctaagataaaaaaaaaaaaggaggaacataataaaatgtcattattgctccaggatcccagacaagagtgcttgaatttaaaagagaagaacaaggatcttactcaaagaattgttgaacaaatggtgaaggcggaagagttgaagaatttgtctatccatttgaaggaatcaaaagagaaggctgaaaagctgaaagaaaggagaaaacaaagatcatatagtgagcatatttttatttgcacctcttaagtgattgtgccagatgtaggtcaaaaaactcctcgtatgacatctgcttcatggtagaggtgtggcttagaatacaccgaattcttgaaaggtgcatgttcatgtatttggtatgacaagattaaaaattaaatttgagggtagcaaagagcattaatcgaacaaatttctaaagaaaatctatgtagaaatatcagaatagaaaatgaaatgatagccttgggtaaaatttatcaccaacaactcaattctgattgaaatagcagaaaaacataatattgcaatacgtattaaataactctgaaaatattcaacactctccaacaaaagtattattttgatgataggatttaggaccctttttttgaaatctgaaacatctcaatccgttttagaagaaactgattcaaattataacatggatacagaggataataatgccttttgtaaagcaattgtaagatatacatgatcaaatatcagctagaaaggcagttgggctagcaaaccatggtgtcattcaaaatgtatacttgatggaaagaccttcaataaaaacttgggtaaagtccctgtttggaggaaacataagctcattttcctaaatagaaatttaccatgaatggaagttttgtttttcaaataaaccaattagatagattatccagcaaatgctttcgcaaaaaatgtttgttttgttttttcagcagaaaaaatagatgcttatgtgatcactgatcagtgatccccaattnaactactcttcgttacatgggcaaaatagcatatatttcacgctgtaaaaaagaaaaccagttaaataggatagggtgacatgctgagtttgaatttagcttcggagaagtagtttaatagatataactgaaatatcgaacaatggagatgttatattgactggtattagaataacaaaaaaaaaatttgagcaagaaccttagttattattttggttgtaaaaagtgatgaacgaaccagaaaacaaaacataaacctagttcaatctagttccctataacaaagtacaagcacaactaagtgttcttttagcattatcaatataccaatttatttcttcaaatcacaacagggtttacccccttcatcggtcaacgaaatcatgcttacctcatagagtggttacaacgaacaaatcataaagtttgccttgctacaagatgaaatagaaatatccttattcttgatctgtataaattcaagaactatagaaaaaggatttctgtccacattctggtcagtaaatacttatggctaatggctagtcctaatcacaggtttgtcatcagaaatgaacatgcctactatattccctaggtggaaatatggatctttttccccatttcagaagataggtttgaaatacaaagtatactatatggacaaaacattactggagaaacaattgttacagcgaagaattcaattaccttggccccaagagccgccatgatactatcagcagcccatggcatgttgttgatccaaaccaacacaaatggaccatcaagggatcataactctgaaccttaaaactcaacagaaagaccttgataagaacacaaatactttccatttagtttttgacattttacagtgcaattcttgagttggttaatggcatatccatatgccttgctgcctggggcagcaattaagagaagactcccataatattttctcagtttggactgaagacatcattttcctacaaatatgccgatattcttgaacttcctgctcagtaatcacattatttgttgtaactaacgcgtctagaatatgagtgatgttgagaaaattgaggacaactccaggaaaataatagtaagcaatttttaggtgaaggctaaaggagtaagttcgtagctgaaaattttgcctaagcttgcatatacaccatattgttaaatgcatttttatccctgaggcctacaccctacatatttgcatgtatggcataaaggtgcatgaagacaagtagtccattgatgacagaggtgatcgagtaaacaactaaagaaacgaaacgctgaatacaaaatcaaagcatgcacttctcactcaaactcaatatccatatcagccaccaaacctgaaatttattattatcattattcctacatagtgatagctaacaaagtatcattaggattcgattaaatggattccaattttgtggcataccccaatacatatggtaggaactaaaaattttcttattcgcctgcagaatggtgcacacaaccaaggactgcctgtgacctgtgcaacaaaaagtttgatgtttccataagattgtccattagaaatgagcaaatcaacatggagcaaatttcatgtgtcattgaaatagatgaagacctatgataatggcaaatactgcatttcatagactacgtctcacaataagaatgcaacagtgacctagtcatgccatttcctgtgtctgcataaactacaaatctaggccttgtttaaaaacttccatttttttttgtttggaagatttccatgctgaggtgcaaactatgtagctgcaagaaattgatgaagttctccagttatatgcatatgattctggcattagagtaatttaaagtccaagagcaacgtcggtcatttcttgtttaacatccagagtgatggcattgcatatctaagatggcaccactgtactctagtataataaacgttgaaaatgatgtagaataattattttgtcaggggcatattaaaaattcatatccatctcaccacggaggcactgccattgaggggaaattgttactgtcacaatttttttctttttgtgagtagttccaacatcataaccacatttttccctactaattgacaacgaactgaaatatcaatacaatcattatgtattgtcattgtatatgtctgaaggatagcaccgtatatacttgattgcattagagagcatgcaaatcagcagtacaatgccaaaatctagctcgcaactataacctagaacagaagatagcttgtacaaattaggaaatttatctactaattgacgatgaactgaaatatcaggttagctgctatacaaatacaatttctaagtaatgttgatacaaatgactaaaagttaaagctctagaaaatacctaagagcagtaaatcttctaaaggaagaccttgccctacagcatctgctgaaaattccacatgtaaaactcataacactaagctgagatgagcaaaaatcattgacacatacttgttttacttgccgttgtacatggtactgaaagtgtctacatgatgtcctctacagtgtttgtgtcaggtgaggcaatgaaagatatctacacttctgaatggttcatggagcaggggttctcatctggtgaagattctcatgtacagattctacgtatgtggtttgaagctttgaaacacagatccacttagttgtcggtactccagtcatcggtgcctaaacaaatctatctccaacctacaaaaaagatattgtttttctgggaagaaaatagaagcgaaaggatactggatagtatgagatgattatatatagagaggggggggtacttggagacattgttggctgcattaggtggtctgaaaatctgaggattctacaggggcggcctaatctcctagaagaaatggaaaagaaatgccaagcactcgatctttaaggttaggtcaggtatgattctatgtctgagtggattgaatcatccacaaccacaaaaataatcagctaaagaaatctattattttcagtttcgttacgatagctctaagaggtcttcttactctttgagttattggctctagcatcctagaacatgcaaaaccagtattgaaggacgagtctgtgtatctcttcaagcaagctccctcacccctaatgtcatacctgaaaaaatgcatgatcacatccatgaaggccagcattctctttagttttcagtagatgcaagcttaactcacacatgaatagaagaggttaagctatcatacttgtcacgtatgaacaattttggaggcccatgacactgcttgatggagtccataatgaaacaaagtgtgtgagtgtgtcaccttttgtcacaaccccactgtctaacctcgaattcaaatgccaacaaattcctgcaaacaaaccaatcaactctccatgtgaatgagagaaatacaaaatgcttttgttagcagaaacaggtagacgtgaaagatgtttcttttagaggagtttgtgttatgtggtgctgcacatacccctgttagaagcaacatacaggtagtctgtatgcaaagatcacaagagttattctccacgagtggcaactctgcctccagctgctgaactgaacatatcatggagaacgtctgtgcaacatatctgaacacatgaatgggaaaatccaatggcatcatgatttgtattaaataatgatatgtcagtctcataggtttggagaaaaccacacattgcattagatgccccccccccccccctctaatgaaagggcaaattcttaccagtatacccaggatcgcttcctcaaaatgtggggcaaacacagatacatgaaaatagatgcaggaatagaaaaaatagagttgaggacccttttgttaggcctcactaacttggctttgagttgcagaggtgtttatatagaactaccttacttgaatactgggcctcaacataaggccatatcgtttccatggtaaggcttatgcaactccagatgaaatagaatggtcactgtcaagccattgaaacatagggggtgaaccactgcatgtttgatcttccaaagcaaagtaacaggaaataataatgtgaggtaaaataattaggaacagatcctggacttactcttgtttctccagtacattttccatgatcttgaagcaatccataaataatgaggaaaacccgcatgctgctatccctttgtcagcaacatatacatctgggaactgcacatccatgaaagattgaaacaaatagccaagttaggaacatgcgatgtggcattagctcaccgtcgttgtcgccgtgccgtggccgaaatccatcgcgccgacctccgcaatgcccctgccgtccctctcgaccctggctccaacatctcctctgcttgcgatgtgcgccactgttgcttggatccaaggccaccgccaccggtccgtgaccgcgtctccctcctcagctcctccaagctggaccttcctctcactgccgccccaacaccttgtacgccaccggtgcacaggagctcatccccgccggccatggccgcactacggattgggacgagacaggccgctaccccagcgccttctcggcacctggcacaagggggctcgaccccgccgccatgacagcgctagggtttggggcgagaccacagggctgatacaacactgatggggaggaagaaatggaagcggtgagagctaaaggagagggggaaaagagcagtggtttgctggcggaggagacgatgcgcggtccacctcaggcgagcgaggcgacgccgcagccggcggctgtcatcctgtcgagggagaaagcaaagggggtgaggcgaagggggatagagttgggggagaaagcgaggggaaggcggaggcggcggggacgacgatggcgacggcgcgaggcggaggcagcggcggcgtgaaggggagagggagagggagagggagagacgagagggaggagagtgcgtgagggctgctgccgctagggctggatgccgccaccgtggcggaggtcaacgcggcggcggctgcggcgcgaggggaggcggacgcggcggcgtcatgatggcgcatgacgagagggaggaggagtcgaggagaggcggcaagggggtcagtgcgcggcacttttgcgaaaaagcccctagactttatatttttacatagagctcctatttcgcgtttctcccctcctgcgcatgtaatatcaggattttagaagggtccttacgcacaatatcgcctcaggggcactgttcggaagggacctactcggaattacgaacaaaccggagggctttctcgcaaaacaaccaccccgggcactgtaggactgtagctttttgctgacttggcatgccccctcgctcgcccctcatgcgccgcataatatttgccgataagcaattggtggtcgtaggctcactcacctctagatacggtgctttacccgtagacgcttctccagctctcgcaggaattgtatgggagtcgtcctcgggggaacttcccgaatgaccgtaccgaggaattctaccgtactccgtgtagctatggttgttgattctgcggagctcacccaaaggttcgggccggattgtaggaagtgggtgatacgtttttgtatttctatgagaagaaatacggcacccacgatttccagtagtaagtcgtcggcatatcgcgcgtaacaaatccttattaataaggaatggcttttaaaggggggccagcttacgggccaggcctttctctaacctgataactagtatcgcttcccgcccagctctatcagcaggcctcttcttttgcaatacttaaaaaggtcactcatggctaaattcttattaaagccttctctaccattgaattcggccctctgggtcaacccagcggctctcggggtcaacccagcggcttctatgagaaagggggcgcaaaggaggctcgaggccgctgaaggggagaaaacaaaaggcgatgattttgtaactcggtgacaagttgagggaccttcggtgtattttttcctttctgtgggcgctgccgccggcgccatgggcgcgcgtggcgcgcgtacgcttgccgccgccgctgccttgccaaccacggcaagccgtcgctgtgccgtgcactccactgccgccagccaacccttccgcgaccgccgcgtgtatgcgccgccgtcgccgaccaatcacaggccacagccggcgccgtcgcctttcttctcacgtcgccgccaccaaggccaactccctcttcccctctgcaaaccgccattgaccaccgcccttcgtcgcctataaatagccggcaataccccatcatttcctcacatcgagcttgaagctcttttctctctctctccctccatccatgtccggccgtcgccgccgtcggccgatctcctccttcgtagttccccttcctcttcccttgcgccactatgctggctccactccggcgaatccattttgcccatctccccttccttttccccttgaatcaagccaccaccacccctctctttaccaccggagataagctcttctactcgccgttccggccacatccctcttcctctcttccatccaccaccctccccgggtgcgcgtcgctcgggaacacaaacctccgccgacgtcgcagcctcccagccactggagcaccgccgccccactcggcctctcctctctcttctctcggctcactgtgagacagaaagaagagaacgaaaagaagaagaagaaaaggaaaaagaaaggctgacaggtgggcctatacacagtgcattttcacatttctagatttaattcaaatcatattctttagaagcccatatctcctaaacagtagatccgattccagtaaaacttggacataaattcatctaaattcaaatgcttcattttgaaacccaatttgctattttatttgaatttattcaaatacccgtttgaatttatatttgtctttcaaatattttcttttatcccaaactaccccttaagccactaaaaagccgccggttgaaactttacgccttccatggggacgttcgcggtttactatccccgacgttgaaccgttggttgtaaagcccggcaaaacccaaacccaaggtcgaagtgctgctctcgacactccacgcctcgatgcgtacaacggtcggagctcactattccctcgacctttacagcacgccgcacagttagttcttgagctctgtgtgatcctaaccactccgccgccactcacggttgtcggagtaacacttccacaccgctaaacttcctattcctctaaccgtcatgctgtctgttgacaccggctaaagaagataccaaatcaagtcgttatgctacccaactctagcaacgactagcaaacaactaaaccttatactacctaaacctaccgccagcaaatactagcccaataatccctataccctataaaggaaatagaatataccctaaaccatagcccttttaaccatttatcgttctctttctattttatggcttttattgaatttggctcttccttcaagtagagtctattatcttttggatggcaacctatggtatttcaagaatcgataatcaggctgctatattggatttatttacgttggagcaaggcaagttattatccctctcctttgagcataattgtcccatattccatgcctctattattctatgcattagtcatacatgatttcaaatgcataacctgaacatagtaaaccaaatatgctagcttttgcttagccttgcctagttagattgcataaaaatataataaacttagattgggacagtacgtaggaattggttgatttccgggtggctagtgctgtctcagtcgatataattgttcaccaaatacttatgtcaaacgaacaggtatgaccgcagcttctagaatggggatatacctagttattatgtcaattaataatgtggtatctctgtgtagtggttcttatttaagttctcgcgcaggaggcaaacttacgccgagcagggcgattgtaatatttaccgaggcgcaggtaaatatcttgattatctcgcgagctgtatgtgtgaattgtgaaaacctgattgagatgacggggggtctctcaactagttctctcgaaaaacctcgagaacgccagaactactctcgctgctgataacgttacgttcagagcgcatgaggactagagttcacggaacaggtaccactattgttagtaacctaatactgggccatgactaagctaatgattattggcaagttatggactgcgggtaaagcgtacatctactgcagtatgaatattcttaaaactattcgaatagccgtgctcatggacttgagtatcgggactcatatggtatttggttagaaacctaattgaagattttattaaatattgatgcatttcaaacatcataggctttgtccctctttattctcagctttctgcaagtaaatctagctctactaagatattatcatttcatgcattcaatattgaatataatagcttgctgagtacattgtactcacccttgcttcaaccccacctttttagagtcattttggagattttgccaaagccgggagtttaatcatataagttagtttcattccaacttaacttccaagtctagcgtagttagatggtttaagtctatagcaaaacattagagttgagtcattctatagcttctgttgtaataatagttagccacaaacttgtaaataccctattatgttataataaaatctcctttagagacattcaaatgtatgtaatgaaaattcagattgttgaacctgtatcaatctactgattcagggcttgatacagttaaatatatcggttttcgaatcattagtttcgggacccgacagttatgtacttgctagttcaacaatatatcaatggcggtgtatgactgacatcctgtggttgaaacttgtaggagatgcgagactgtgtccaacgtggcaaaactaaaggatatataccttgacagtgctcaaacttgatggtcatgcatgaagtctcatgctatgatcgtctggtcattggtgaacgttgaaacagttatattctttggaaatgagttctgtatgcactatactttctgcaatcaaatgtatgcattgtgtagcgtaactcataaactataaacgaacctatgtgatacgttattatagccctttcatcttctaccctatagttaaacaaaggaaaaagtccaaatacccccctaaactttggatggaagtccatctagcaccctaaacattaaaaccggacattcaaccccctaaactttgcaaaaccgtttatattaccccctaaggtggttttggatggtggttttgcatattttaaaagcttaaacgaataactttaaataacatatataacatatttacatatcatcagttgtaagtcatcaatttatacttatacagcgataccgtgctattattatgttggtacttgtttgtaagagagctaaaaagtggtaaaaagaaagatttaagtggagattttaatatatatgtctgatgtgtatgtcacgtgatcaaactcatccaatttatatacgaattagataaaaaccactatacaaaaccaccatagtgggtaatatgaacggttttacaaagtttaggggttggatatctggttttaaagttcagggtgctagacggacttttatctaaagtttaggggggtatttagacttttttcttaaacaaatggttttactcattcatcatgtcacacgtccaacggtcgaaacccatctgaagaatttggatccaacgtcctatatcagcgcgcgtgtcccccacctccctccgcatcctctcccgcatctacctctctgccgcaacgcatcctctcccgcacctccttctcttccgcaatcgccgcgcctcctcctcatccgcgcgaccgcctgtcgcgttggtgtgacccaggagaccctcggcgccgtggtagatcatgcgcgcgcagcgcaggaagtcgtcgctgtcgccggagcccgccacgacgtgcagtgcggagtccccccgcggcgtcgtcgccacgtccaggagcagcgccgccgcggagggtgatggcggtggcggctgagcgggcgcttgttgtcccgggtccggcggccccgcgacgtcaacggcgccttggtccggcgccggtgcggcgccgccaagaacggcctccagccactcgcggtcaccgcggcgcgcggcactgagcagcctgggatccatcgatcgtcggcgcaatcgccgcaccgtaaactggagacggatttgtgagctctcgatgggaaatgctcgagaacaaaacgatcgattatcgatcaggtagacatgccgaattggagcaggatttgccttagcttaatttaattccttaactaataatttgatgttttgacctctatctatctgcctgtttgcataaaaatggtgtgttttttttatcgtgttcttggctcaacgtgcagctctcaattatgttccctgtgacagcaacttttagttaaataaataatatccatattccatatatgactggatgatttgatctggactagcataattcagtttttgcaaatattgtccagtaggtggttgtcatctggatgttagcgattgtagagagttttattaagtagttcagctactagcttggtggtatcagtacattttttagagagttttattaagttcgtttctgaaccatgtagatgaaataacggaattggaacttatttggtcaagtatatcagttattaattctattacaccagaaaattacattgtttcatcgcatttaaaggctacaggtatttttcttttttacggaatgatcaaaccgaatcaggggatacactgcaaattatatcttctcaccctagaggacttctatatggagtgactatatcaaatgttttgccttttatgctgatctaattagtctgctgatcgttacggagatgttggtcatttccaactcttaatcttgctaattttttttccttcttttgctccttgataggcttgcttggcaaggaatctcccccacaaaattcagaaaagaggagggactgcataatcaggtactgcatactctccctcacagcttcagtaatgcttgcatgaaaaaggtattaaaaaaggctctctgcaaacaaaattcatttctttgccatttgctaagcttatggtctttaacaactaagaattgctttattaaagaaaaatcaaagtaaatatgagtgatcttaagtgttgtaaatttgatggtaacagcgtagaagcacatggattttatgctgctatgttgctctaacacaagtttgccaaacatttatgcagcatctccattttctgtatgggggtggtttattttgtgtacaacagtgagatattactcccagtgaaatttctacagattttaataaacatatttaaatatgatccattctctaaaaatatgaaatgttttttaagcatgtgtatgcgcaaaccatggttacagttgcaagcccgttctgttcttgaggctgtttggaatcgcctcttgctgtgtattgttctgcacaaacctgtcaaggaataacaagcagtacaatttgttgctccaggatggtttcaactttcatataaattatatctgttgtgatctcttctccgtacaattaattccttttcagaagttcccccttgctgcagggagaccgaagcttttttcattattgatgttataagatattattgatatattttaatcacatcttaactaacttgtacttgtatgagatttgcagtgttccaaaattttgatatgtgatttgaacctctgaagtaggactacccaactaaaattcctgattactcttgctctgtcactacacgcctccacatccctacatccgaggctcctactcggcgactccgattggcaattgaaggtcagtggttgatagctcatgcctcattgctcataggcttgtagctcaagcttaggttgccaatttgtgatttgtgaatgaatgcgaataagtttctgctgtcatggaatgttttggtattggcctattgggtaagacgtgaataggaatggggaagtagtaatctttttaagggttgtttggagaaattggaacacagctaatgcacttgacaaacatgggggatgtaccttgtgcacaccataaagctcaagaaaaatataactcaatttgtactggtgtggggctataactgatgctcttgatagacatgattttagtccattattgttgttaagggatattatttctatatttgcatcaattttttaactaatttgtagttgtaaatgggatttcgatttcaggttcagataattgcattatctatctatttgtgcgattcaatggaaatgttcataaatcaagactgtttgattcatgctctgcatgttgatttatatattactaccctttagttgagcttaattaccgaaaaaccatgatgccaattatatatccatatgcataacaactgatgtcaagggtttatgattttttctccatgtcctccagatcgacgacgccaccactggaaccctctccagtctcaacctctccgcgaacacggtaatcattgcacgatcactttccttcaaccattacagttcaaattcaaattacgatatgtaatgcacaagccattaaaataaagttctatgggcttatatgtacactgctgccttattttcatttactcatcaaaatttgtcattactgttggaaactggaaagcgcctttggctatattttgaatttcatgcattatacacatcaattgaccggaaatttgtgtaaaatataacctgactaataatctttagagtggtgtactgctatattaattttcatttttttaattctcaggtttgacctctggattacatcttcaactggtaataatcttcaactgtttgcttccctttttcaccaactatgagcatgtttggaatgtctaaaaataacaaaaaataaatataagcttcacagaaaaaaaatcacattcagcggtataattttaaaataaatccaattatatccacgttgcaaaaaaaatactttggaagtaaggctaacctgttggacgtcgcctccattgtcccctctgccggtgaccgacgtccttgactcgccgtgaatcccagtcaatgccgcccaggtactttagtttttttaaagatcaactgtatcagactcaagcagtgagccaaagctgatcgattttattcccttattttctgaggatcttaaagaatagtacatagagattagttgctgaaattaatttgctcatgctcgaaagcaattggtaaccatgtgctttcctgctctatttacgtacagatggcgaacaattgagtcaatattggtacaaggattattttcgagataatttcaataattatgcatacgattggaaatgtagtgtttaatccttctattctgagcataattttgacccatcgtgttctacactttttgtaaaaatgatagaccaggatcttaagtaggggtgggcagaaaaaaccgagaccgaagaccgaacccaaacaaaccaaaaccgaacccgaactacccgaagtttcggtcatcggtcggtagttcggtcatgcactcgagaagaccgaagtttttttgggtagttcggtcattcttctcgggtactcgatgtaaccgatctgtataaaaacagagttaaacataggcaaacataggcatgtgttggtgttgggctcatgggttgggtggctggcaagcccattagtgattagtgtatttctccacgagacaaacaagtcaacaaacctaagtcccgaaccagaatctcgtcgcttcgcctcaagcgccgccgctcggcctacccactaccccaatctcgtcggctcgtcggcgttgccgcgccgccgcggcactgcccgcgcgctgctgccggcgtgctgcccctccgtgcgcccgtcgcggcgcgcaccgcctgctgccgtgcagccgtgctgctgtctacccgactgctgagatagcgagggggccaatcgccgagccggaggaggagggggccattgaagtgaaggtgacgaacagagcagcacaatggagtccatacaatcttgtaatgtactgtacgtatgagcctgaatccttcaacgcttgatttgttttgcaatcatgttctgattgttgtgttggctgccaattgccacatgctgtatgcctgttcggtctgtacggtctaaccgaagaccgagaccgaagtttcggctaaccgaactgtcggtcttgattcttgtgagagcaacttcgggtgtcaattctagataaccgaaatttttaaagaccgaactaaccggaccgaagtctcggttatgaccgaacgcctacccctagccttaagtgtgctcatccgatttcgaattcttttaggtttattacaatttcatttgagaaaatttgtttcttgtatccagatcggcggcgaaccccttcacgtcgcgctttgagccgtttctggagccgcccatcatcgagccgtgcttggagtgacagttctaactaaaagactactgagcttaattttttatgtaaaacacaaatggttgagaaaacaaaaatatacatgatgcactttgattgtcagtctttaggaagttatgattctttaggagatagataaaaatattttatgattcattgtataaaaatgactttatggaagcaactatagatgacacaggggaatgtccaatagctatagagctcaattacttcttgctggaaacaagcataatttcttattttgaaggaatcacatcaaccgagacgaaacgtttgataggtatttgatcatttagaaacgatgggaagtggctaccggctttttggagtgggactgtaaattatgaagtttttacattaacattacttattgttcatccgtcaaattactctgtaaataacgtattgattttggcacattgtcacattgtcgaggggtctgtcaaggcaacttgacaaacaacaaggattttggcaaagccaaagaaagaagtcgaacctacagggaagaacagaatatcatgtatcaaaacgttcatgattggtgagcaaatgtaggttcgcgtgatcaaaattaattcagaaacttattttagaaaatagtaaattgctaactggaatgttactcaccaatgtcctcttgttttgtacaacacgccatcaccattcaggtggaatattgtgtgattaataagatgattaaatatgcacttgtgtctctctaaatatgcatttccgtcatcgactaattttagtagtcgtttcatataaatattgaaagaagacgttaacgagataaccaacaattcttatattgtgaaacattgtcaaactattactttgacatttgtgtcatatcaaactggtatttgggtttataaattcatgccctcatgctatccttaatgggctgcgaccagcgtgtgccatgtgtgatgaatagaaaaatcaatatttttaagtacataagccaatttagaaaaatgaatggaattggcctatgggaacatccgaattcgtgacatgtggaaaatatattttcttgtactctatatattttttctatttgcgacatccaaattcattttagagttttattaaagattaatataattgcaccgtagcgtttagcacgggcatattactagttacaataattgtccttttgcgtgagggtgaccaaccattgttttagaattatttttatttgacgatcttactttgtactgacatttagccatgaggcaaagtggcagaaatataaagtttaccatttatttaggtttcaaatgcgagacgatggaagcaaattggaagagaacactaacgttatttgaccatgcaacttagccatgccaagtaccagttcgacgcttgttgaacggtgcagaaccttggacgtgagctcaattggcatcgatctgtaaagcatacacctatgcccgcagcagccggcaatcgcttggcggccgacatcactgcacgagcctatccctaatgggccggaagaaatttctatggggaaaaagtacacagtatctttctttgagcaagtatagtattgtcaattactagctttaattcattatagccaatctaatagctcatttatacaatagttacatactacactattaatatctggtcccacatgtcatacacacattgtgtattggagtccgtgctatagctggctacaaatctgtagcctgttgaccttctctctcctcatttatctgcttaaaatatgtttgcagctggcttatagcctgctattgtacctgctcttaagtatgataccccacaaaattaacactaccaaaatttgctgagatttttcttttagaaatgaattggaccaagtccctcgtttgcatgtatgtatggatcgatgacaaagcacaataccacccatccgttttatattacataagtttcaccaaatttataaaaaaatgtagcaacattttcaaataaaaaacatactatataaataaatttgatattatatttgatgaaattaatttagtgttatagttgttgctaatttttctaatgaacttaataaagcttaaaaaggtttaactataaattagttaaagttaaaagtttcgagtaatacagaaaacggtgggagtacaagctaccaaaccaacaaccgaacctttgtggtggggaatatatactgggcgggtcacctggccggaatcgattaaattataaattatcgtgcgtgcatgggtttcagcccctccatcgatcgatgtgatgtgatgctgtgatgggtttcagattttgatcgcactactagtagtactcctatttaaataatccacgtttcattctcgatcaatcaacatcaaatcaaatggaatttcaagaaaaaaattaatcaatcccgcatgcagcgcggccaaccgatcgtatgcgcggggctgcgttaatttgcaccgtttccatgatgcatgcactaaagggttatttggtttgctatcaaaatttgtcaaagattaccacactttatattagacaagtttgactaaattagcatattatttggttcatagccacgcttgtagcaagattctttctcatctattagggtcccacatgtcatcaactcattaaagtatggcacaatccaatcttgctagctaaggcgtggctcattttttttaagccacaacttagacaagtgtggcgtaaaaagtatgatgaatagtggcaaacttagtatagcatccaaatatgccctccttatattccaatttttttcttcaaacttctaacttttccatcacattgaactttcctgcacccataaactttcaacttttccatcacatcgttccaatttcttcaaacttctaattttgggcttagttttcaaaacaaaagcttttcacctattctatcgaatgtttagacacatacataaagtattaaatatgcatggagtattaaatgtggataaaaaaatcaattacatagtttacgtgtaaattgtgagacaaatcttttaagcctaagtgcaccatgatttgacaatatggtgctacagtaaatatttgttaatgacaaattaattaggcataataaatttgtctcacagtttcctgacggaatctgtaatttattttattattagacaacgtttaatccttcaaatatatgtccatatatccaatgtgacatccaaaacaaaaatttttgccatctaaaccaggccaaggtcccgtcgggcttgcctccttccctttgacctatctatgccatgatgctcatggcagcttaactcttattggattttcttttctaactggattttattctaaagattaacctttgctgtaaccaactgagctaccagaaccacttgcctaaagtctcttttcttcatctatgagcatcccagtggaggagtttgctcaagaaccaagagccggccagggagttggatgaaaattaagatttttatggcacacgctttttaaactgctaaacggtacgtttcatgcgagaactttctatatgaaagttgctctaaaatatcatattaatctattttttaagtttataataattaaaactcaatcactcatatatcaataccacctcattttacgtaaaaaaacttaatcttcatctccatcttcatcttcagaagaaaagaacaccacctaagtagagtgttgtattagtttttttactactggctcaatcttgggataatttactatatattatgataaatttatttccattagttcgcgtgaatattgacggaatggatatgcatcatcaatatccatgcatccatatataaatacttgtagtcaggccgaagataaagattcacacctcctacttctttcacgcagcagcgtactccctattttaaatacaaccataacttttttatccaatatctaaccgtccatcttatttaaaaaatttataaaaaagttttaaaaattaagtcacacataaattactatttatatcttatcatctaataacaataaaaatacaaattataaaaaaaattaaataagaaagacggtcaaacgttggacactaaaacccacaagtacgcttaatatgggacatagggagtagtactcttgaaggaacacatttgtacatacaacaaatagtgagacaaatcatcatccactatttgatactccctccgtttcaggttataagacgttttgactttagtcaaattcaaactgtttaaagtttaactgagtttatagataaatataataatatttataatactaaattattttcatcaaatcaatagttgaatatatattgataataaatttgtcttaaattgaaaatattactacttttttctatagacttaaatcaaatttaatgtagtttgactttgaccaaagttaaaacgtcttgtaacctgaaacatagggagtagtacgagtagatgggcgaggcgtgggatggagacgaagaagacagcaacatagggcctttttagttcgcgaaaagaaaatttttggctattacatcggatgtttgaccggatgtcggaaggtgttttcagacacgaatgaaaaactaatttcataacttgcctggaaactgcgagatgaatcttttgagtctaattaatctgtcattagcgcatgtgggttactgtagcactcatggctaatcgtggacaaattaggctaaaaagatttgtctcgcgattttctcctaaccgtgcaattagttttttctaaatctatatttaatactccatgcatatgtccaaagattcgatatgaaggtgtgtttggatcccagccattgaatgccatagctacagtattttcgccgcgctacagtattttctgaggcgaacaaaatgtccgccacaggacctgtggcgagccacgacgtggcgtggcattctaatgccctgtttagatgggactaaaacttttaagtccctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattataaattaattaggcttaaaaaatttgtctcgtgaattagcttttatttatgtaattagttttgtaagtagtctatatttaatactctaaattagtgtctaaagatagggactaaagttaagtccctggatctaaacaccacctaagccgccaaccaagcagccccggtatttttgggaaaaatatttgggaactaaacgaggccatacttaatcagcagctgctgcccaatccgtcaatggttggtggggttttttagtgggctgtcgccgagcgagattcccagttctcacaactggtttaactctacatttgatatcgaggtacgtacacgtctctggtttgatatcaattaatctgtgtctatgtgtcgcaacaatcggttcccagcatgtacgcgcgcgaaaacggaacaatctattagcgcgtgattaattaagtattagctaattttttaaaaaatatagatcaatatgttttttaaataactttcatatagaaactttttagggcatttgtaaattttccactggtttttttaatattgcaaggatatcactggaatgatagtactaatggcatttttgcaattttctagtggcagttttttaataacaattcggagtagtggtaaatttgtaaaaaaacaaaccgtttaacagtttgaaaagcgtgcgcgtgaaaaacgaggtggagagatgggaaccagccgttccaaacacagcctgtgccttcttcttttcttaacatctgttaaagttttttcgacccccatcaccaacaccaaggatcttatattggatgcaaatgagtatagtagttgcgctgctgtagtacctaaacaatgcatgcgtcttaatttggtaatccctaaacaacaacgattgttttaattattagagattagtggataacccgcccggggtatgtctacaataggaatttcgcatagaggtatgggtaggattgacatttcacatcgtcagatcagatcagatcttgagaaaggggccggcggggtgggtgtggaagactgcacacgttgtactacaaccctagcagtcagctctgctttccccaacgcgttctcaaccctactccatcccacttcgttgtcatctctgatgaatcttttctctcctgctgcaggctgcgtgtgcgcggaggaaaggaatctttatggagccaaaatttcgcagagataggaatggaatccttacgaagccaaaatttcgcagagaggaggatatctgtttgaggaaaaaaaggacggggtctcccttcctgcaacagagtacggatgaagtccaacatatgattagtgaagtactactagtagcctatttgctctgctttcatttcttctctggtgtttgattgattgggtgtgttgatgatttctcatcgtttcaagatccagatgtggtgcacctacagatgcagtctagttgcaaaccctagctgctaggctgtgtttagttcacgtcaaaattgaaagtttggttgaaattggaacgatgtgacgggaaagttgtaagtctatgtgtgtaggaaagttttgatgtgatcgaaaaagttgagattttaaagaaaaattttgaaactaaacacagccctagtatcagatcgttagtgtttaatactactactatttcttctcgcccggcggttttatttttttgctttcatttggttgctcagttggaccgatggatttgccgattcatattcaacattattataagtactactccaagcatggcaacaatcagtctgattggttggtcggctggattgattgagctgtggtctgtggattattattatcattatcctatttttacttgtaacctatatttcccctggtttacatacacagccagtgcgcttttagcagtatgttttacatgctttactttacattaatcgtaatttttttttttttgcagaccgcgtgatgatgttaccgtttgatgtgacgtaccttagtttgtacgcgagattcaacaagatgaaggtaattaaacgaattacttctcttgtgctatgtctactactcctgtagtacatgtgttgcactgtattgcactgtattgacccagtaattggattgtgaatacgctccatatggggcgtccaatctgggggacaaaaacaggcgccccacatagctattcattcactcatttctctctcccgtatctcactcatctctctaacttatcttcctgctcgttttctctcctctactttactctttctctctctcaccaaggctttgatgtgaggacgagggcgcagcgtccccgtcactacttaaaaaaacgatttttcatgacgacacccttttatttttgccggcggattaatgaaacaaacgctagtaaaaacatatgggaggattctcgctcatgagccgccagcgaaaaccgattttcgctagcggaaacttaggaggtacgtcataaaaaataacactattttttaggcggacctcttaagtgtggcggtagagcaccgctcgtaaaaaaaaataaatcccattgccccaccacccacagcccaccgctcctaactacccaccgcgcattggtttcaattttcgcaaacagtattctgaccgcttgtggaaagtaaggattttcactggcctttacctgctggcgcgcctgtgcaaatgtttttaggccgtcagtaaaaatgttttttctagtagtgcgtagcaccgccaccgaagatggcgatggagaggacgcccgcagcagcggcaaagaggaggcgtggggcagcccatcgtggctaaggaagttgaagtacgtatcaccgggtcatcgcgttgcagcacttgaggttgtcgaaggaagcctgatccaactaacggagaggaggaagaagccagacctagccagcattgattttgtgaaatttccagtgtttcagtcaatgcatttttgatgtttcttttgttggattgaaatgttgtaccaagtattttaatgttgtttcattattttgtcttcgattcattgcagatgtgtagatatttttgattcactgcagatgtgttgatatttcaccaaattgaatttgaatgttttgtgtgagaccaaaatgtttcaggcctaaggccctaattgtagtgtatttttatcactatttctttcatttagctcgcaatctaaggctttaaaattcattaggtggaacgtcttgtttttgctgtttaagggcattagcattgcgatgcattgtgtgcacgtactactatgcatctatgccacacgggttgggtgcttttttatacaactagtaacatgtaaaagtgataagggcttagtatcacattccttgctgtgataattgcaaatcaaaccttgtatttttcgtgggctgtcctacagcagacaattccatactatggtacggtgcgctcgctcatagacgggtatcaatttgatttgttgtttttacgatgctgaacaattttatctatctgagttccaccgcataaatatgtaaatagagatgttatatctgtggatgggtaaccaacgaccacttccattcacgtgaagagttaaactaagtttaaattgtactgtcatgcatcaaaattaattgatcccccattacgtgacaccactttgaatcttctatcatgccgcaggggccggtgggcaaggcgtcacttatttgcggaggaaaggaaacccatgatgccaaaattttgcagataggagatggaggagattcagttcattgtgtgcaaaaaagacgactgatctccccctgcaaatgtgtacggaggaagcctatgattggtattacaactcgtattgatgagcactacaccatggtacagaggcagtaatatatccctacttctcttaaataaatttgctctgtttttgctgtgttcttttctccactgtttgattgtttctgctgatgatttttacatcttgcgtcccatggggaacccgtacgcctgcaaacgtccagtttctaggtagattaatactccgtccgtcccaaaaagaatcaacctaggttgagtttttttgggacgaagggagtactcccgatgaggtgcacctatatatagagcctgcttagtagagctctaactcctaaatttaactttaggagttgggtctagaggggagttgtggagctacctaaacccagctccacctctctagatcattttgtgagagctccacccagctccactccaattttaggtctccaattttaggtggagttgaaactgttttgttgagctctagctctagtgccacaatatacaatttctactaaaatatgacatgttttatatgatctgacatgtgggacgaaactctgatatgctcacataagtatggtcatatggtggatgaaagaactcatgaatcccccacgtgtcagatctgggttaaattggtcaattatttggtgttatgaaacagtagtgctaaaacttatgtggttttgtgtaacttggaccataataaataatactaacatcttcaatttgtcctaaaataagttcccaatgctccttcaaattgtctgaaaataagttcatctttaaagtaatcattgcattggaatatgcgaaagtagtgaataattgtattgaaagtagataaagcgagtaatagttgcattgggattttataaagtaggagtattgtagtctaaaataaacttattttgagatggaggcagtagtaatagcactccctatgaggtgcacctatagatgcagtctacatgccgtctagctggccatatatgagtgatttatattttttatagtttactattactccctttgttttattaaaatataaaaactcttgaagttataatattttgttaaaaaaagaacctactacttgtaaaaggtgatttttaccaccaacttacttaaaatgccttacccacactactacgaaagggtttttctgcaaaagggcgaaaagcatttttgcatgcggttgggccagccgcatgcacagaaaggtctgcgaaaatcgcgatctttgcatgcggctagggcaacagcatgcggttgcttacatgggccgcatgcaaaaataaaaatctaaaaatcgcaaaaaaaatcatgccggccacgcgtcggcgtcgtgggatcccgctgctcccaccgtttgctcccaccgctgcccgttcccgccgtcggatccaggcgggaggaggcccgccgccgttgctcccatcgaccaccagcgtcgtcgtggaagtcgcccacgcgtcgccgccaaccgctcctgccaacagatctaggctggaggaggctgagctgtcgccgttgccgccaccgccttgtcggcggcggggagggggggggacggagccggccgccgccaacggcgacagtgaggaggggatggtggtggtgccgccgcctactcgcctgatccgccgcccccgctgcgcgcccgccgtcgcagcagccgctccctagggcggtggatccaaccttcctgagggtggcgccgccaaatccgccgcccgccgacgccattgccacccgtcctgctcccggtcgtcgctgcccgctcttggagagagagcggggaggacataagaaaacgagagatagaagaggataggaagagagagagagaggggagactaaaatagagagagagagaggagatagaaataatttgaagtggtgggagggaaaagagagtggagggagatgaaaaaaaggggtgattttttttgtttgcgggtatcttaagtggtccgcatgtaaaaatgctaactcatttttccatgcgggctcttaagtgattcgcatgcaaaaacgagcttatttttacatacagacctcttaagagcccacatggaaaaaaaacgatttttccatatgggcgccttaaagagccgtatgcgaaaatgccgctcgatttttccagacgcgacaacttacggtccgtttgcaaaaatcatgggtcccgtacagaaaaatcgtttttgtagtagtgccactccttaacaagtcatttttgcccctccttgctggctgtgatgtcgagggcgattttgttttgtttgcttttctttgatggctccattaaattggatcgatggaaccaaaatacttactccatgatcgatggagtacatgttagtaatataaatccatgatcccaatctagagttcggattgcgtactgtcacttttgtaaagtaaattgcacgtaaccataggtattatggtctaagtaatacaaaaccatatgggttttggcatgtgacacataaccacgagtattacgagtattacggtagtgtttcataaaatcgcacaattgacaaattctacttaaatatgacgtgagatgatagttttatatgatctgacatgtgggatgaaacttttacatgctcagtgaagtatggtggatgaaataactcgtaaaccaccccctcccctccccccctacatgttagatttggattaaattggttaattatgtggttttatgaaacagtagtataactttgatataatacctacggttttgttcaaacatttttacgactgtgcgattatttgttgatgcactttacccgagtttctagatttatcataaaaattggattatccataataagaattagttaattccttcatttgtacagtcaaatactagcaatcagtgaaaaaaatagattatacagtatgtcgagccaaaaaaaaatcagctatctcaaaccgggccaaaagtttcagctatgtcaaaccaagccttcaacttcctgcctgccttgcggatccccaaactcccaaagtcgaacatgaaggcccagtagtctctattcgcactttctcaacaaggggcaaaaaaaaatctctattggtcgtcgtacactcgcttcactttccccttcccttctactctctggaaaccccttttccccgtctcccttctggtggacgaggcggccaggaaggggcgacgaggaattgggagggagatctgcggagatgtcgagtctttttcggttcggccgccggagatggacgctgtgccgtgcgctgaccgccggcggcagcaagcaagccgaggataactcaggtcaatccactcgtctctagggatggtctaagttttgtttccctagctgatcttgtagattaaaaccttattgatctatgtgatggtctattaagttgggttggctcggatttgtttcctagttgatcttgcagattaaaccctattaatttgtgtgatggtccattaatttggcgaatttgtttctctcgtttatatatattaaaaaaatcctctgatttgtactgggcgtggaaactggggatttgtttctctagtctgtttgagatctggtagatttgcttggcgtggagactgggggaggtgggggcaatgtcaaagcagtcctttttttttactctattgttcgatcttggagattaccccccggtagatttgttcttgtggattattcccctgctgctgagctgttgtttgatcttgtagagattatcccctgctactgatctattattgtttgatcttgtgaattatcctctgctgctgatctattgttagaacttgtagattatcccctggtagatttgttcttgtggattatctaccctgctgctgatctgttgtttgatcttgtagattatccctgctactgatcttttattgtttgatctcgtgaattatcctctgctgctgatctattgttagaactcgtagattatcccctgctgctgatttgtgctgttattttcatgctcgttttggctgtttggtgatggtgtttttatgtgttcttttgtatgcatgcaggtgtttttcgagatcccggcgagcgtggattcagcacaaggcccaatctttctttggaacagttgagtgttggccctggggacactgcggacttactgcggaaagtacttccaggcattcgtgatgcaagtaagacctttgctatccctgcgttgaagcaagtgtttgaggacagcattcgtccactacttgtttcaaagtgtttactcattcaccagcctcttgataaatccatgaaaactttcaaccaaagaacaaataacctgttgaagaagtctccacgctacctcagtgccctagatgtgaccacagaaaaggaaatcctgctggaagatgaatggactttgttccttgagcacatctttaaacatagggtcattgttgtagatgattggacaaagtgctacgggaccgttcagaccttcctccactcgagtgatgctgaatcatgcagtgattctttcaagggggagtgtgatgcttcattctgtgagcaaactggaaaggcaaaacttgcctttgtcatctttaaagagggtaaacttgtctgggctgaggttttccatgaggtaccttgcaagagtgttgtggaggcagaggctttggcagtcatagctctcctcttcaagcttattgaccttaacttgttaagagggactgtttggaccgacaacaaggtctgttataatgtgctgaatggtgaatatgagataaaggttgatgatcccaacaggtcgctgtttctgtttctgaggagtttgagaggtcgctttgagtccttgaccccggtctggaaacccagagaactactgctgatcccagatcgtctggttagtatggttgatgaccccctgatatcaaggaatagattggtactcagtatactggaaaaaacagttccaattcttagtcagccgcagttcaggatatcatggagcagctatctgcgaacaatttttggtatgctctgtttccttttttttgccctgttataacatgttgtttcagattatgcgtgtttcagatataatttgtactcttgcatttttcaatttttggtatgctctgtttcctttttgccttgtctgatgataaaataaaaattgctctgctcgacactaatgcgggcgactaactagcaaaaaggccttgtttttgtgggtgcgccagttccaaaaactcgtgttttttactcttttggcagttatatttttctattttgtacacgccgctctgtagactcttagtccgtccagcactccagcccctacagatatgaatgctccatatataggcatcttaactggggagtcataagaatactcggtttcagatgagatgagtattgtagtagtcaacacttacagctcacatgcacatattcaccagaagtgtcttggccctttgacacgttccagattgatttttagtctggcaagtaaagcgcgatttgtataaatgcattgcctcaatgttcggtagttagaacattcataagataattatcagatcagtggttcagtacttcagttttttacatcctacattgtttgggttatagtcacatttgctgcttactctgtctctccttatgtatttaatttgtcatgttttctttttttcctctgttataacattgttgtttcagattgtgcttgtttcagatttaatttgtactcttgcttcttttttttccagacaaacgtgatggtggaaaacaaatttctaacacaacaaatgaaattaaggaatcagatgaatccgaggattcaatctgttgggttaaggctgatgatgaagaagctgaaattgcttcctttcttgaaattatgaaaactttttcagcccatcgcttgcttattgtggttgacaactttgaagacaaatctcctcattatcaaaagttaattaaggatctctctcaaaagttttacacgtgttggatgagtaaagaaggcagtgtcacaattgtggagtatgactctcctaacactgaagagaaagagaccaaaagattggtggttatgtttggtgggacaatggcactggatgaatatatccaccaaaaaaatctctgtacagttgttttggtgaagacatctgagattaagctgctaagagatgctggaatcgaagaaataagtgctaagacacttctgagttttcgcaacagtaagtttgtttatctttttttcagcttttctcgtagtttttttgtgacttgctatgtaaatttaatgaaaattatttctttgcagtcaaagcaaaaccagttgtgccaaagaaacctcgggaggatgaggatctagagaaggggggggggggggggggggcgcccccacgcggtgaatagganaggagacgcccggttctcatacaaggtggacaactcactgaacttcagtcttttgcatgattccttgcgacggcagattccttcggtcttttacatgtttgatactttgatgcatcgttgagacagttttttttgtacctgaatcatgatgttcatgtcacaaccgtacgtgatgctcaagtaatcttatctgacaatgtagcttagctaactaaaacatatgaagataaaggtggacaactcactgaacttcagtcttttgcatgattccttgcgacggcagattccttcagtcttttacatgtttgatacttgatgcatcgttgagacagttttttgtacctgaatgaatcatgatgttcatgtcacaaccgtacgtgatgctcaagtaatcttatctgacaatgtagcttagctaactacaaacatatatctctatgaagaacaatgcaaaatctatataaacttgagcaccaagcttgtgattgccatatgacacacatactgcattgagatcagacgagcaccgaatgaggatcgccgttttccccgccaaaaaaatggggtcggagttttggcggtatattttctttttgtccttttcatttttccatctctcttcgttaattttttttcccaatctctcgttccatcaggatgtacgttttcctccgcgcgaagcaatctggaccgctgaaatttgatcgaacggcctgaacatgcccaaattatattagacagggctcacatcatacaccgaattaaagcccaggctcacgaagttggggatcgctagttggcgcatacgcagcgctttgttgggataaggcggttagactagtattagtcttagataacaacagtttgagataatgacggtagtagataagatttttcttttttccgcgagatttttttactaacaaattgaaaagaaaaaatatatatctaaagtcaaattttgaaaattttaaacccagatttgaaaacttttaactcaaaatttaaattttttaagtcaaaatttgaaaactttcaagttttcatctcaaacttgaaaactttcaactcagatttgaaaactttcaacacaggtttgaaatttttcaaccaagatttgaaaactttctattcggatttaaaaacttttaactcgagatttgaaattttcgaattcagatttgaaaatttataagttaagatttgaaaacgaattagcaatcacccatgaagttaggacctgtttagtgcagcctaagagttttacgtaaaatgatagcagaactgagtggagcgctctcacaaaattttaaaaaaggtggagctaggtgtagcccggaaaagctagctcgcgcacgcgccgccagcgtgcgttccgggggagttaagacgtactaagtaagttagctaaggataattacgaaattaagagtagattttttctggagatttttttactaactgattgaaaactttcgagttggatttaaaaactcttgacttaagatttaaactttgaagtcaaattttagaaactttcaacttaaacttttaaaatttcaactcgagatttaaatttataagacaaattttaaaaacttacaactcagatttgaaaactttcaactcgagatttgaaaatttttaagtttaagatttaaaaaactttcaactcgagttttgaaaactctcgactcgagattgaaaaatttcaatttgaaaattttcaacttaaaatttaaatactttcaactcaaacatttgaaaacaagtctgctaaagattaaaaaaaattagaaaaaaggcacaaaggaaactgaaaatatttggaaaaaaataagaaagcgaaaaaaagagaaaaaatcgcaaaaaaaaagggaaaaaggggctgccagccgcgcgcgccaattagccacgcccgtgtttagcctgcttcataactttattttagatccaagtcatgaaatgaaaaaaaaagaaggtgaagctgggttttgcttgctccaactcctatagctagatttaagagtttgagctttaccaaatatgcccttaatcagcccaacaccagcacaccgccacccgttcagacgatctggacagtagaagcttcatccaacggcccatggtccgtggataatactaaattgcgagttcgtgacaaacgtgactagctagggagaggtgctgagaatcgaagctggtgagtgtcgcgactaacaagaataataatatccttcccagataccggtgaattcgttcaagtggcgtacgcaaacctcaaggttaacattatgaaaacccatatgatactagccacgaggtaattgtctgagctaattagcacaaacagcacgtgcagatgtacttcgtagacttcgtatacacgccaggctgtatttgcaatcccatgttcccaatcactctcttttttcgcgcgcacgcttttcaaactactaaacggtgtgatttttttaaaaaaattgtatacgaaagttgcttaaaaaaatcaaattaatccatttttgaaaaaaataactaatacttaattaatcacgcgttaatggaccgttccgttttccgtacgtgagggatttgttcccatcccttgattacgaacacagcctgttgaagttccaatatcctcgaaaaacaaaagaaaaaaaaaatccagcggttaacagggtttaccaaaccattttatattgtgttcttaagtccaagttcccaaggcttttcaaactgttaaacggtgtgtgttttgtaaaaaatttctatagaaaagttgcttttaaaaatcatattattccatttttaaaagtattttaagctaataattaattaatcacgtattaatccattgctccgtttttcgtgtcggaggacctaagaacacaaccagatttgacgattatcgcgacgtatactatagttttaaaaactaaaaaggtactgcacgtgataatcacgtgataacggttcacgtcaatcgctcgtttggaactaaggaacagaggaaggcagaatataggagaagtttcctgtaatctgtacctttgcagtttgcacccaaaacggggaaaaccaatgttttctcttcctatgctgaaaagtgagaggagcgggagagagaaaaatcatgtattccaaacacccaactatctattcttcttcatgtgcttttctactcatttgttgtacgtacatccgcattcctttttttttttgtatttttgtgttttgtttttcagcgttccaaacatatctttgtttctgtgttttgtagttctgttttcatatacatccctacggagattccatttttttatattcctatattttactattcctgcgtttgaaagggagcatagccatttttatcccttattcctttataacttcaccaattaccagacatactatagggcctctttaaaatgaaggaaaagcaaagggaaaaaaaaggaattttaatcttataggaaataacactggtgagtgttgatgtctttgactcgtatgaatgagcaaacgagaaacataggaacttttccttgcaattcaagaggaaaaacataagaaatttatcccctctttgatttgtacgacaaacattgaaatattggaggatcttgatcctacatgaaaatttccaagaaaggcctttgaacaaagcattaactcccaccattttatttgaaattcctatgaaataaaaatactataaagatattgaagaaaagttagcaaaaaaacttcaacctcatagaaatttcatttgaatatctatcatccgactcgtgggtttttgtgtggtctactcaaacaatcattcctattttttaatctattttgcaatctatattttacacttaacaaaatactaagttatttctatttctctttttttttcaatcttgcgtttcaaagagccctttaagactcctttgaaatactctccctatttcgtattataagtcatttgacttttttttttgttagtcaaacttctttaggtttgaccaactttatagaaaaaaatagcaacatctacaacaccaaattagtttcattaaatttaacaataaatatatttggtaatatatttgttttgtattgaaaatgctagtatatttttctataaacttaatcaaacttaaagaaatttgataaggaaaaagtcaaacgacttataatatgaaacagatagagtataaaattatcagttccaaaccagaatggaactataagtttatcaataaacaaacttggtgtgaaatagatacaaaataaaaagaaagtttcgtgacagcctggtaatgtggaccggagcaatcacctatataccattacctcgcaaactgcatgctacaaacttcatctgttttctaatagataatactattgactttgatctgatgtttaatcattcgttctgttcaaaataaattatagaaatattgtttattttgtttgtgacatattttatcattaaagaatatttaagcatgacttatactttagcatattcacactaattatttaaataatgcgaacagtccaacgttatttcaaaagtcaacgtcatttattaaaatatatattttttgaaaaaaaatacatgctaaatatagacgtgctaggaacttgtataaataggggtgaatgcttttgttacattgcatcggcatgcaaagtggtcagcaggctccttaacaactagctatagctacctgtaggggtgaaaatggtttggaatttttccagattccggacctattttcggaaacggaatcagccggtcggaattttttcggaatttctcagaaacggaatcggaaacggaaataatttttcggaaacggaattgaatatgataatagcagtttccgtcggaactcagaatcggtcggaaaaattccggaaagtttgtcggaatttctgaagttaaaaaggcccatccaaatagtccataattcctccccaagttcccagcccaacccaagtccctaaatcactaactggctaactctaaaaaggagagaggctaaccctagagaggagagaggcgtcgtatctagatcgagagaggcggcgcatccaaagcctacctgtgcctgcaaacaaagatggcaaagcatggtgttgcttccattttaacactggcactggtccttggagtacttgcggtcactcctaaaggtaagtatatactacctccgttttttaataaatgacgccgttgaccttttctcacatgtttgaccattcgtcttgttcaaaaattttatgtaaatgtataagatataaatcacacataaaatactatgagtgataaaacaattcataccaaaataaattataattacgtaaattttttgaataagacgaatggtcaaacatgtgagaaaaagtcaacgacgtcatctattaaaaaacggaggtagtatatatactactacatgaatgatttttgcgtgcaggtggaattgatttttacgtgcggagcttctacccgtctggaagtgtgcgtctgtgaaaatcccgattttttcgtgcgggtgacacacccgcacgtgaaaatcgattttcgcgtgcgggcgccgcacgcacgggaaaattaaaaaccgaaaccaaaaaaaaaaaacaaaatcaacccgcaaaccctaacctagccgccgttaacaccgccgccgccgtcgtcgctgccttgcccgaggcccgtcgtcgatgtcaccgccaccaccgtcgtcatcgctgccttgcccgaggcccgccaccgccgtccccacggtcgccaccgccgcactcgctgatgccgccgcaacgccctctgatgccaccgctgatgtcgctgcggcgcccgccgatgtcgtcgccgcactcgctgatgccgccggcgatgcagccacgacgcccgccaatgctgccgccgccatcgatgccgccggctcccccgccctaaccgagggcgccggcgtcgccgagaatgggatggggaggaggagagggagcg

SEQ ID NO: 18746 - DNA, 56674 bp, Oryza sativa
taaatgacccgcacacgaaaatagatttttctgtgcgggcgacgccctgatgctcgtcctttatttttctgtgcggttgcacttatggtccgtttgaaaacaatctggtctagtgtctaggaaaatctttcatacatataaccggctcaaacatcgccctcaccatgggcgtcgccaacgagaacctctccgcgttcgcctccgacccctccgccgtggccaattgggtcaagcagaacgtccaggtctacccgggcgtcaacttccgctacatcgccgtcggcaacgaggttgagagcggcaacacgcagaacgtcctcccggccatgcagaacatgaacagcgcgctctccgctgccggcctcagcaacatcaaggtgtccgtgtcggtgtcccagaagggcgtgctcgccgggtacccgccgtccaatggcatgttctcccccgaagcgacctcgtacatgacgcccatcgcgaagtacctggcgagcaccggcgcgccgctgatggccaacgtctacccctacttcgcctacgtgggcaacctgcgggcccagatcgacgacatcaactacgcgctcttcacgtcgccgggcacggtggtgccggacggcagcaaggcttaccagaaccagttcgacgccatcgtcgacacgttctactccgcgctggagagcgccggcgccgggagcgtcccgatcgtggtgtcggagagcgggtggccgtcggccggcggcacggcggcgagcgccagcaacgcgcagacgtacaaccagaacctgatcaaacacgtcgggcaggggacgcccaagagggccgggagaatcgagatctacattttcggagatggattctaatagcttgagtggacgtccacccgtttactgcatgtcaactaaatggttacgaaatatttttaaaaaaattgacaagatagatcagtatgtaatatatcacttcacaaacatgcaaattcaaattcaacttctacaagttgtaccaaaaataaaaaaatttaactgtaaatatacatatattaatttgagtcttgtttgttatatttgttagaatttgtagaagttgatttttaacttgcatgtttgtggagtgatatattacatatttatctatcttgttcatatttttttaattttttcataaccatttacatgacatacaataaacgggtggacgtccactcgattgagctgttaaaacagttcccgccaatgttcaacgagtacgacaagaaaggcgccgacaccgagaagcacttcggcctcttcaacccggatcagtcgccggcctacaccattaatttctaaagagaacagcacttacaggctccatacaattaaggacatcgatgaggaaagcaacgactatatagtactccctctgtcctataatataagggattttgagtttttgtttgtaacgtttgatcactcgtcttattcaaaattttttgaaattattatttattttatttgtgacttactttattatctatagtactttaagcagaacttttcgttttttatatttgccaaaaaaatttaaataagacgagtggtcaaatgttgtaaggaaaaacttaaaatcccttatattgtgggacggagggagtacgtaagttccagttgcatgtttggatttgatcgaataaactgttacgtatatatacgtaacacttgcatgttttggataggctatctgtcatttaatttaagcatgatgtggtaagcttgtttagtcaaggtgcccgcgctgctggacattctcaacatgaacatccctataacgacaataaaatactcggaattacatgctaagaagacaaggaaagatgactgtatggatagaagcagttcaagcccattgagagtttttacagcatgttaattaaggagtacaaggaaaataaaatcctactattcaaaagggggaggacagactcccccaaatctccgacttcctccatcacgcccttgcacgcgtcatcggcggcctcctggtccagagccctcctcaggtccaagtcgggatgcgccggccttacgcacgcgaggacgtggcacgccctggtgtagatcccgttggacgtctcctcaccgatcctagccgcatgcttggaggggatctcctccattgccgtagctagctccgcgagcgaggacatcagcgagaactcgtcagggttcgccgggatggtggtcgtgacgccgcactacccggcgagctggtgtaggccggtgtaagatacccgtagcgagccgcggatctctgacaagttgttctcgagctccgacatccggtgctcgagcccttgtcgctacctttcgttgccggccaccagccccctcatcttcaggaggtcctcgcgggcctccgccagttcacgcgctagcttgtcggcgcgttggttcgccgacgacgccgctgccttggcctcctcgatctcgcagcctacgctgcgagcaccggcctggaggatgcactccatctctgcttggagctccccccaggtgagggcatcggcaggcgggccccgagcaggcacaaggccgacggcgaggctactcggcgtcacctcccggtccttagtagcgaccacgacatctgtcgaagtcgctgcaggggacgtgctggaagtcgaaccagtcccgccttgcgccggcttcgcccgtgccgccctgcgaagagtttcctctctttcatgaagctagttaatcaggactttgtgaatgaaaaaacttcaaaaaatatccacttacttcttgccgatcgtcacaagcctctgccttcgctgaggtggaggagacgcgtccgaggcctaagtgagataggatgatgtgaggctaaatcattccgactacatgctaaagaacaagagaggcttaccaccgggcttggcgccttccgataggtcccgagtacagaggagaatttcctccccttcttcggaacattgctgccactcatggtagcagcagcaatgtcggacgcctccttggtgacgccctccttcaaggacgctgccgcttagtggtccataagtggcccgatgacgtccgtcagagggagagcctgcataacatgaagtcacgacgcgatcctggggaggaagatgtaaaggatacatcgagtacactcacgttgatcgcagcctcgtgttcagccggacccttctcgcaaagggggatcgggatgtcgctcgccgtcgaggcagcgctgatcatcacctggccgacgcggcggttcatggtgtcactgtccagacctgtagatcgagaacagaaactcgataagtcgggagaaacagacatatccaggacaaaatccgaaatacaagaaaaaaaataccccgaggagagacccgggtcgtgtcctctggccccgagtaatcaaaggccggatgggcgggggcctggagcggttggatccgtctacttatgaagtcggcagcgacttcataccccgacaaccctcgagttcggaggttatcgatgatgttgatgaaagactgaagggagggagtcagggcaggtttggcggtccactctgggattttgtctggttgttcttccgggacaacaaggacgggatccgagttttctatctgaagatagaaccatctcgcccgccatttgctacgagaagaggggcactggaaggggatgtaacgcgacttcaggcgatcccaaagtcggaatccaacacatccggataccctattggattccatccagcgcaactcatagtaaaaacggaaaagatcaaggaagggctctaccccaatataggcctcgcaaagataggagaaaatactaaggaatgcgatggagttggggttcaggtgaagcaaagaaaggccataaaagttcaagacaagaagaagaaatttggaaggcggaggaagaaaaccgcaagaaatgtaatcttcgaccgcaaccatacggcccaagatgggttcgggttcaatacctcctaactccctctgcatggtcccgcgaccaggaaggcgccgtcatcttgcaacttcttcagggacgcggtggtggaggtggacttgtcgagatccatcgctgccggaggatcgccggagagtaaagcgaaagaagcaggctagggttttctctgcaggagcggagatgacgaagggcgcttgaagacttgagagttctttggcaaacggacttcaaaatggatccccaaaatccctttaaataaccgcactaccgacggtgcgtattccaaggaaaggagagagattgccgccggaaaattctgggtccgttacgtgtggtagtttttagacttcaatttaaattcattcatgaccattgaacttcatacggcattgtcgataactcttcgtctctacggttctcacaccgagatcgatcagatgagaacgacaacgattccgacatcagaagtcacgattggttacatgagttcatttaagcagaagttgggggctactgtcagggttacggataaggtataccctctatccttagatatgcgttgtatattgatatggcatacccgcgcgtatacggatagtccttgtatgcgttaaagaaatctatcacgagatagaagcggaatccacagatggaaggagtcctactcagacaagattgggtatttgccatatcgtgaggggtctgatatctccgagtcctacttggagatcaactgacccgcgatataaaagggacccctcggcaggacgtaaggcatcgaatcacaccgccaacacatccaccacagcctacgaagccggagcctacaggagccaagtcgccgtgtgatctagtcgaaccaactcgactacgatctcgtcggtattatcgagttccgctattccttctgtaatctgtggtttccattatataatcccataccaattggattagggctattacctgctaaggggtctaaaccagtataattcttgttttctgtttgcttgatgtcgtactacgtagatcctcgtaccagcgtaccccaataccctctatatccggtctacgggtacccactgtcgacaatttgaaaataattcaataataagataaaaaaatccgttggaatatatccatgtgtggttttgttttgaagatttaattgcaacgaatttaattgtgcaatcagatcatgattttgattaaatcatgataaataatttaagagaaaaaatagtttaaattgtttttacacgtatgctgacgtcagcacccgattttacctcctctccacgaggcacccgacggtagtcgcttccggttctttcgtcagctcgacatgcgagatcgatcgagaaggaaataataccagctccgtctgatggcggaagcccggccgtctccctctcgtcgccgtagttaagttgatagtttggaggtggttttcggtaggatgggggttttcgtgtccaaagcaagccatcgtgtgcgaatccgccactggattaacaagctaaactgagacaagagaaccagttttttattgatttctctaagatttctctccgttttctctgttattcacttattccttttccttttttttctatcttttcttaccttttcgttacacttctatttttcagtatttgtctaccttttcaccgtttggcagcctacttaggaatgtttgtatcattttgacccatcattaatgcaataggtagaatctctctaccttctcagagtaaaaataaccttcacacgtggtgtagctagctccggccgccgccggcggcccgaaaagcgcaaggagcgagaggaggtgagctgcgcgccaacttgcggacattgtaacgaccctatcccgtcgggtttctgtgaaccgttggatttgaagtttacggtccagataaaccgattcccggacaaacgcaacgatccgattaggcccacaaatcgtaaactaacattgggccatcataattgggcccattagaatttggatagtagccatcgctatgccgtggtaaaagtctaattgaactcactcaattgcctcagtccaattcctatatcccgcaaccttagccttcggcagcagagattgtgagtgagtttgtttcgatttccccacgcacacttcctgaactattaaacggtgtgttctttgtaaaaattttctatacgaaaattgctttaaaaattatattaatccattgagtaaatttcacaaaactacaggtattttgaccaaattatcccaaaactacagatttaaggagttgtatcacaaaactacacatttagcaccaaatttatcacaaaactacaaattttaggttaagtatcacaaaaatgcatatttaatattgaacttatcacaaaactacaacttttagagtttaaatccctagcactattgttatggtggagctataaacattattactttgtaattaaattggttctaaacctgtagttttattataatttagttactaaacgtgtagttttgtgacacttcatcttaaatgtgtagttttgtgataaatttggtgctaaatgtgtagttttataatacaactccttaaatctgtagttctgtgatagtttggtcatagtatctatagttttgtgaaatttactctaaatacaatagttatccactacaggcctacagcatttatatcatcatcgcttaattattttgtctctcacctattccccttttctctttcatccaagccaatcagggaagcccgttcatgctaatttctttatcagtcgacgatatcgtcgataggaaggcgccaagccagcgataggagcattggtgcccgtgcatgaccgtcgacaaattaatcgacgacgtttctctctcatacttctctttctaccacctaggtataaaaatccaacgcaagcttactacttgtagttgccctaactcgtcgtcttcctcccattttttctacacaaacaacgccttgctggagctaaaatattccacgaaacatggaaactcacctatgttttcctggtgtggtgttcttttctcttgaagatgaagattaagtttttttacgcaaaacgatatggtattaacgtatgattgattgaattttaattattacaaacttgaaacatagattaatatgatattttagagaaactttcatatagaaagttttcgcacgaaaattgcaacgagaatcttaatcttcatccaactcttgttggagaaaagaacgggacatccatttgtgttctgccgctgcatggaaattcttatccattagtagtatttaacagtacacccaacttgagaaaattgcatatctacaatcgcataaacttgcttcgctagaataccagtggtactgtaaattgcattggtggctcatattttgttcttcatgattacaccttgaaatttttgtaccctcgaatttaattgcattccttctcttcactgtttgtgaacgtatgcgtttgtaccatgtttaaaaataaacctcaaagataccatggtccttgcagttatcacaccgcgccgtaaatgaaccttcaagcaaaatagaggacttctttttttcgttgcgagatatagaagttgaatttgaacttgcatgtttgtgtagtgatatatcacatgttaatacatcttcttattttttttataatcatttgagtagaatgcaaataaggatgtgacatcctctcgaggatcaaaatagtctcctcatgaacatataagtcgcgctcaattgttcatgcactgattcattgtcgattagggaaaaaaacattttcttcactttactcatggcataatacactattaattctggaatttgagaatcgcaggcacaccatacgtgctgcacactttattactgattgattatttctactgctctgcttgaagctagcttatttttagtttacagttaattttaaggatgcatacgagcaagagctttcagtagctgctatgtcgatccgatgcagcatctgacttagaaccggatgggatacacgggcgacttgttagggtagaagagcccaaagtttctctcggtgggatccccgttcttctggttctcattgaacatggcgaatatgtacgcctccagtgcccccggcctcttgggcgtgccacgcccgacatggtcgatcagcccctggttgtacgccctcgcattgtccacgctcgccccgaacccttccgccgacggccacccgctctccgacaccaccaccctcacgttcccggggccggccttctccagcgcggcgtacacggcgtccatcatggcgtcgaacaggttggtgtaggtgagcccgttgtttgggtccctcaccgtggtgcccggccggaacgtggcgtagttgagcctgatgtcgcgcgggttccccctgtaggcgaagtacgggtacacgttggcgagcagcggcgcgccggtgctcgccaggtagcgcgcgatgtccttcatgtaggcgtccctgaagacgccggcggagggtgggtaggagttggagatgacgtcgaacttcaccgcggtggacgccttgatggcgccgaggcccgacgaggccagggcggagttgacgttgcggatggccgggaggatgctactcgtggcgccgccttccacctcgttgccgacggcgatgtacttgatgttgacggccgggtagtagggcctgacgttgtcgcggacccacgcgcccgcgttgaagaagctggcggcgaggttggacaactggtcgccgacgtcgaggatgagggcgatgccggagttgcgcagggcgttgagcgcctccttgtcggggtagtagatgcgcatgccgttgatgcccttggacttgtacagctgcaccacctcgctccgcgacgggaggttgttgccgagaacgccatagcacacgccgatggattgcacagctgcatatgcacgacaggataatggacaccgacagcataaagttaggttttccaataaaccatagcagagtacacaatgaacgtgcaccttcgaattatcagagcatgcctagttgaatttcaagtgaaactttgtttgcccaaaaagaattaacccaaagctatagtgtctatctggtccggacattttatttagtttcatctatctatttatctatcttccatatatctatctatatattatctattatattatctagaccagacatgatctattatatatatattgtatagtaacataatgataacttgaaacgaagtcaccatattcgctatgtatacctatacattatcatattaataaaataataagatctaagctaattacatcatctaggaccaaattaacggtgtagattaatactccttccgtttcaaaatgtttgacaccgttgactttttagtacgtgtttgaccatttgtcttattcaaaaaatttaagtaattatttattcttttcatatcatttgattcattgttaaataaactttcatgtacacatataattttacatatttcacaattttttttgaataagacgaacggtcaaacatgtacttaaaaagtcaacggtgtcaaacattttgaaacggagggagtatatagcaatatttgtatacaaagtactattgcaattgtaatgtattgtgtagaaaatattgcatatatggaaataggaactaagagttctatatcaaattcaattcaactgacccgtgtaaaattacgtggggaaattccatagttatgaaaagacaacaagatgcatatagataaaatgtggtttattctataaagaacattgtggtgctcttcagaattttgttcccctcaaatctctgactagccactaaacacttacagtacgtgctcagggcattgcaagcaaaacagagaattgctatttgctagaaacatagagagaatctgatcagtacttgttggagcagaagcaaatgctccaatgatcagagcaattgtaagcatagaagcaactccctgtctcctggccattgttgtcccagctagctactcccaactgctgctcctgaacctgaatgttatgcatgctatgtgccaatgcacacccctttatatacaagtttcagtgtctagccagttaggcacattaatttcctcacatccacggcccaagtgcgtgcttacagctagctgctacgttgcatttgcagcctaactagccatcttcctcccattttttccacagaaacagcggcttgttggagctaaaaaattccacgaaacgtggaaactcgcctctgttttcttggcgtacttagacacagcatgtattcttccgcttcatggaattcttccctcatcagcagtacacagagtcgcggaagatcactactaataccacactagtttgtttttccaaccgtatatccgattttgcattgaattcttacgtatattcttgaccagtacgtggaatttcaggtttggggtgctaactgaatggaatggtggcttgtaccggagtgacttcctgacgtgtgttcattgttcttttgtcaggttagcagcacaacactacctttccatcggttgagaactcacctgaatacctgatccacatcagttactatacacacgcatctcatagaatttcttcagcatggacgtaccacgaattaaacctatggaattatctggaatctgtatgacctggcactaattaagtttttgagatcagatatgggaaatacctgaaaagaaaaaaatattattatatataggaaatcattaaatcatttgtatcctaatatagaaacgggttctaatccctccacagaatattatctcgtatacctttttcttccgaatttaatataaatagtcataaaaaaatcttaaaaaaactaacaattgtaggtacagtacatctatcactgcaccaaaaagcaagttcaaattcgacctacacgatgagaaaaaaagagataaattcagctatgaatagtacagagtatttaactatttgccactcttagatttgttgtttaactatttgtcacacatgtgccaatgacatatgagacctcatgtgtatatgacatataggtccaggtggtaaattgttagttgccacaactgagaatgacaaatagttaatatcccgaataataacacaccaccacactactatttatatgttgaagttgtattttttatatcttaatgtataaattgagtttgggtctaaaattttgtgtactgatacatgtatgttatatgaatatatcccatttttttagaatttctttataactatttatatattttttaaacaaaggagagagcatcctctcgagatataaatacagtttcccatccgaatacaatacgctattacagcgcaagcaatcgcgtgaatttgacaactggcgctgatgatgaacgatttcactggaaattgatagggtagactgctgtcttgttagggtagaaggctccaaagttttgctccgtggcttccccgggcttctggttctcgttgaacatggcgaacacgtacgtctcgatcaccccgggccgcttcggcgtccccttcttcgcatgcttaatcaggttctgcacgtaggtccgcgcgatgtcgatcgtggccgagtccccgccggccgacggccacccgctctccgacacgacgatgctgacgcccgccgcgccggccttgtccagcgcggcgtagacggagtcgaccatggcgtcgaacaggttggtgtagaccaggccggtgttggggtcgggcaccgtcgtgccggcctggaacgtggcgtagttgaggctgatgtccttcttgttgccgatgtaggcgaagtaggggtagatgttggcgagcagcggcgcgccggtgctcgccaggagcttggccacggccgtcatgtagggcgccgcgaacacgccggccgagggcgggaacgtgttggtgacgacgtctagcttcaccgccgtggacgccttgacgccggtgatgctcgccgcggccagggcggcgttgatgttctgcatgaccgggaggatgttctgcgtgggctcgccggagatctcgttgccgactgcgatgtacttgatgttcaccgccgggacgaacggcttgacgttcgcgtcgacccaggacgcggcggacgccgggttggcggcgaggtcgatgaggatgtcgttggcgacgccgacgatgaggccgatgcctgtgccgcgcagggcgttcatggcctcgacgtcgggcaagtagatgcgcatgtctgtgatgccattggatttgtagagctgcacgacgtcgctcttcgacgggagatcgttgccgatcatgccgtagcacacaccaacggattgcacgcctgcaccacatgtatttcattcagacagaaagcatcagtacaagctctgatctttaatttgtttctacctacccaaatggacctaagatctctttggacaagtacaaagtttttgcagaaatttcgtcggaaatagttcagtccttataatttttttttcaaaattcttatgtttcaaacaatgggaaactattttaaacttttgacgagacataccctcattgtctacatgtcatctaaatagttataaaaaatttaaaaaattcaatcagatagattaatatcaacaatacatatatcaatattcaatagtacaggcgaatcacgtacctacagggattgagataaaaactccaagaagcagcaatgcagctgcaaaaaccagggagaaacctcgtatattcaccatctcttgtggtctcaaacctagagagatgtaacaaatgtggcgtattctgtacctagaccacctatagttcacttggtttctggatgtaatttacagagttcaaagcagagcagcttgatttatactggtactcagcaagcagatgaatgtgtgaattgttccggataaactataaacactcagcatgcagatgagactgaataggttcccgataagctgcaaaccatagtgccagaaaatcaaaattccaaatgtcaagacataaatacgggatgatgaatctgacctctcaaggaatccaaccaatgttcatgatgaatttgattagcaaatcctctattgctttatttgactggtgtaattattttattttcattttttcctttatctccttgcttatgtggtggctggcgaactaatcttgttatatgtggctccaggaaagttgccactttgaaatagagtttgtgggtcatcctcattttggtcggaaaattggatcgacgttcgaacaacagattgtggtgatgttctttgggggtgaacaacagattgtggtgatgttctttgggggtgaaaaccctaatctagtattccgacaacgttgaaatttcttcatcggctccctgttaaagatgttgcttcttgagctaagtctttgggacgaatatcttgtatagacctttctagtcacaatcgtcattcgacatactttttttcatctcaaaatagagctatttttagctatgaacatagacaaaaacttgtctaaattcatattaaatgtacgacaaagaacatatttttttataaaaagtgttgtacgagagagcaccttcaatcggacctcatgtcatggttcaaattgtttaatgaaagcccccaacttcaaagaagaagaagaagcaggttgtcacaaaggcagcgtgacacaatcaaattgttttaagttttttcattccctttttgcctttgtcagataatattacttccatttatcattttatccaaaaatactatagtacaacaatggtttaatgatgtggaggaaaaggaaatacctcctccggtcattaatatataccgtttataccatcgtactccctccatcccaaaatataagtgatttttagacggatgggacacatagtcctatgaatctggacatgctccctattcagattcatagtactaggaagtgtcacattcattcaaaatcccttatatttagggacggagagagtacatgtagtatatagaatcaaattattcattacacgaatttatttgagacagctaaatacgacaacttgtttatgtgttatctagatgtaacgtacaaatattatatagatcgaccatgtgcaaattagtctgttccaaaagttaccgtgcattcctacctttccaaatccaaccaaaatattcgttaaccaaatgttacaattgaaacatgagcttgtttaaaagtacatatgtgcacatgtggtgggtgagtgttcaacgactgttcatgttcaacatctggcacatacaaattctaacagattttgattcgtaagcaccagattaagcacatgatatatactgtacgacgtagtacatattccgtattggagtaatttttcagaaagtgattgggtaaaccggtgtcttgtcttggattgaacagcccaaacttcttctccgtggcgtcgccttccttccggttctcgttgaacaaggcgaacacgtacacctccatctgcccgggcttcttcggcgtgccttgggcgacgtggtcgatcagattctggttgtacgcccgcgcgttctccacggtggcccccttcccgccgtccgacggccacccgctctccgacaccacgacgtcgacgacgctgcttccgccgccgctcaccttctccaccgcggcgcggacggcgtcgaccatggcgtcgaagaggttcgtgtagctcagcccgccgccgttggggtcgctcaccgtggtcgagctcggctggaagagcgcgtagctgaggtcgatgtcctggctgtccctgtacgcgaagtaggggtacacgttggccaggagcggcgcgccgttgccggtgaggaacctcacgatgggctccatgacggatgggttggtgaacacgccggcggacggcggcgatgaggcggcgagcgtgtccatcttgatggcggtggtcaccttgatgctgtccgcgaggcctgcggacgcgagggcggcctggacgttctgcatggccgggaggatgctcgccgcgtcgccggtgccggtgagctcgttgccgacgacgatgtacttgatcttgacgtccgggtagtaagccttcacgttgtcctggacccaggagtccgcgttggccgcgagctggccgacgtcgttccgttcgccgacgtcgagggcgaggtcgatgcccgagccgcgcagggcgtcgagggcctcgcggtcggcggagtagatgcgcatggcgccgatgccgttggacttgtagagctgcacgacgttgctccgcgacgggaggccgtcgccgttcatgccgtagcacacgccgatggatcgcatgctgcaccaaatctcagcatacgcacgcacaagcgtacgggttcagtgacaacgagcacagtatcgcacggtaggcttgacatatgtggccagatgactagttttcgggtaagcactcaattcatccagatccaaattaaatcgtaaatttgacattatcatactgatgtccactaattttaggacaagtacttacgatttacaaaggtgtgacgagaaaaacgagctaatgcatactgcacgccaaaatctagagtcaacggctatgaataattttgttaactacagttggagatttacaaatagacttgaataaaagtttcttctttagtgttgctattattagtttttcatcttcatgtcttaggttttatgagctctcttttaagccagttatataataagtggctataacttcttttttaagggaagctataactttataaaacacaagcaggaatacatttacattatctttaaaaaaaaacttagtacttacgacctacatataacgaagcttagcaatatgtgtacctgaaggaaaggaggcgaaggctgcaatggccaaagccgctgcaagcacaggaacaacgccttgcatagacatcttctgctgctactagtttgatctgttgcacttgaactcgatctggatgtaagaaaatgcaacgctgcaagcttgcttttatagtcacgctgctcggaatttccaggcgaagactggacaagatcaatacaaatgggattgacatacgttcatttactgttcattcgtcaccacataaacaagctccgtgtttttttttcctttcctcctgggttagccaaccccgtcgcacacgggtgagtgcagagtagatacacctctgcagacttaagagctcaagtcaaaataagccgctacttgttggacggttctggctaaaatcttccaatgctttgttcaaaaaaaaaatctaccaatgccaacctctgaatccttcttgaccacacacgtacacacgctaatttggaactccaagactacccggcacatcacggcatagagtactcagtacagtgaggctcatgaaagtttaaagttgagggaatgaccctcgatgttgtactgaagtatcgttgtttgagggaatggccctcgatgtgcttaaaatttgtcaaattacaacaggctgaggaaaacaaattgcattgcagaaaaatatcctgtaaatatatgatacaacagctgtgatcttactgaacaaacaaagctcataggggcagtcatccatacctcatgtcataacagtagtgagctatttgcctgatggtgggatgagattacaaggctaacaaaagattagcctctctaattggttgtcgatcccttaactgcacttcaagtaataaatgatatttttagactcttcaatgatgccccaactgtacactgtaatttccttctgagtttcgcacctgcttgctagtatacaagataaccagaataagtccttcagtttgtcacctttcaaagaattgtctcctcatggtaccgcagatttcatccgccacagcagcattttcacgtaggaatttctcagcttctgccttgtttggaaggaactcaccattgatccaatacccagaatcatccttcataataaccccaagggaagaagccagctccaggatctctgattcgtagcagatccccttcccaaatctgatgtcaatgccagcttccttcagagttgctggagctaatttgttcttgattatctgcactgatataccgatgccagtagcctgaaatggcagaattttcttaattgcatatttacaaatgctgtacactttacctagaataatgcgcgctcttgtctagtgctagtattctaaggagggaaccggagaagggaaatgagaagcatgaaaagttatgtacaatacctgggcctcattgtagcgtaattcccttcttgaagtcctcattctgactgcagcatagaatcctaatgcattgccgccacaagctacctccttgaagattccaggagtctgatttgagctcaactttgttctaacctgcaaacattagcaatcagaagctctaaataagttaggcagcatcaacactaaacgatattgaagtatgccatcctggttagtgcaaaaaaagcaatcatcccaaacctgattaacaaaaataatcagcgtttcagagcgacttagtgtgtgctgaatttttcgaagtgcccgagtcatcaagcgggactgcacatcttcagaattcatatatatttcaccttcaagttcacatctgggaataagtgctgcaacctgtcagaagtccagtaaaagcaaggtaaacaaatatgtagcaaagcacaagatatcaaatacatattagaaaaatggatgtcctgacagtatgacagtgctaaagagcatcagaagtgaatagcagtccaattttcaaatttagtaactacttatccaagtattaggcctgtcatagtagggaatgcataaaattttaataagccaataaggaatcaaatagaagagaaaaaactaatccaaactgacattgcggaagaaacatacactatcgacaacaacaacatcaattgatccaccaacaagagtgttcactatgctcaaagaattttcagcagagtcaggttgggctatcaggagcttttcaacgtttacaccaatggcttcggcaacagaagggttaaaagcattttctgcatcaatataagcacagcagcctgcaaatagtcccagtcacaactccaatcatataatgtaaaatttagaagaagggtatactccaaaaagaacagcaaggaccataaacaaatacagacctcctttcttttgcgcttccttgacaacatgaagggcgagtgttgtcttcccagaggcctcttttccaaataattcaaccattctaccctgttaaatatctacaataattttcaaacagcacaactaaaagcagtgttcaaaacagtatgccactacactcactgatcatatcaatcaaggtaagcctgcagtttaactctaaacatatatgctatcaagaaaaaaaaaaggatggatgatatggacacatttgacagaagtaaagctaagcaagatatgggcatcagttctacctataaatatatttcctaatcagaaataccatagacaaaatgcaattttttgttgtccagcaagaaggaaaatactgccatcaacaaatagtattttcacaactaaagaagagggcttttggcactaatttaactagttcaacacatcatggagatttcattggattaacacaaaagggaaattagacatcaaaagatgaaaagccccacatgacacatttgacttttagagttcccattgcaacaaaatagtgaactaaggccgtgtttagtttcccccctattcccaactttccatcacatcataccacatcaaaaactttcctacacacataaacttccaactttttttccaaactcccaactttcttcaaacttccaacttttttcaggaactaaacacaccctaactgaacaataacaccatgcagaagacttatttgaactttgatccttatgtgttatatcagaaatatatgatttaggaccaaggtaatatcatatggaatgatatagtgataaagagtaatgatatcattggaatactaaatatctagaattctagatctggacaatatgaaagcacatcatgacctttggtaatccaccaatgccaagagcaatatcaagcttaagagaaccagtggagatcacaggtgtgcgccttgtgcgggagaaccgctccaaacataaattagattctctatcaaaatcacttgcgagttgagagacagcgacacttagtgtcgactctttctcgagaacttttacaccatcgagtgggggatcagtctcatagtctaattgcacatcaactgaaaagaatcatatcattagaaggaaaaaagaaatgaaatgtttgtacggcagaaactgtgagtattgataataagtggacaaacattgagcatacctgaggttgacatcgaacaactttttgataagaaccaacaaaatctgtcgtttatccaattctagcaaatcacagggaagtaaagatggactgcattacttcgtagttcaaatatttgacacatatatcataaattcaagaaaaataaagcgttccagatcttaatgttttaagagcggcaagctgtgaaccaaacatcacatacattataagtgttttttcattaacaacttgagctgaacatatctgtgttccgtattattgtcagaatggaagaaaaaaaatgaaatccaacgtttgttggaacacttgacagaacacaaaaggcagaaccatactacactgcgcagagctcattttctcctcacacactcacaacccactcactgactcacatcggtacttacgggcaaaaacctggagccgcctaagtgaaacgctaataccctcgctctttttaatcccctgagtttcaaattcccacaaattcagtctaaaacgcaaaatcaatcaacaccacacttggataccccctcttctaaatctatctcaagctggaaagagggccttagagatggggaagtattcgagggcgtacctggaggggaaagcggcggagaggagaggacacgggaggcgcgccattacagaagcccgcgccggagaggttggcacgggcggcagatctccggaggagagcggaggaggctacgagagctcgcatggaggctgggcagggaagcgcacacggctgggcggcggggcagtcgcaagcgaagggggcgggggcgccgccgcgccgggagcaggcgccgccggtggtggaggattcgaacgcgccgccacacgcgaagccgttgcaagcgggaggggaagaacccgccgtcgcgtactcgcgtatagccgccgcccgccgcgccctccggacgaggggaaagaagagggcggcaataaaaactgggccgaacagcgctacactattgggtcgcctcgcaacggtggcccattactctatgacggctcggcccaacaggaaaacaccgtgctcgcccagtccacgggccctgttttgcagagcttaacagtctcatcttggcttatatttatgcttatcataagtaaggggactatccggtaaaaatgagctaagtattaaaaactcgtgaaaatcatgcctaaaagttttgtaaattcataaaaaaaatactagggataggtgtagatatgaaatacattctcaccaaatctcaagttcaaacttaacttcgtttaggagtaacaaaaaagacaaatttcaggtgaatagtaacaggacactgttcacctgaaatttgtctttttttttctcataaacgaacttgggtttggagttgaaatttggtgagaatgtattttatatctacacttatctctattatttttttcataaatttacgaaacttttaggtatgattttcacgagttttcaacatttaactcattttcaccggatatgtcctcagtaagtaaaactttaaattttcgaacttagatttagagctaactagctaggtggcccgcgcaatgcgcaatttgcgcggctagtacccacaaaattatctatttttacacacgattctacttaaaatttattaaaatattcatctcgctgtcttagaactttcaaggatcgaacattatcatccatgtgtttctaatttcatagtttttaaaattcacatccgttgctatccttactcctttgtcacccctttatttgttgcacggctaacacccatccaaaattatctatttttaaacatggttttatttaattttgttaaatagccatctagccgatcttaaaagattgaatcttattatcatcgggttagttttcgaaagtcaataagtcgccaccccttacttttttgccgctcatttatttgattgtccgacatgtcacaacttttattcatcctatttggaactttcatatttagatcttatagtttttgtagttcattttcttgtcagttgcatatttatatttttagaagttacatgaaatgtcaccattgtactgctctacaatccacccgatgtctcgtcttaattgtcattggaatttaaaaagtcaaatatgatgttatgattatcgttggtgtttttttttttactttttagaagttccgtcaaacgtcacgattgcgctccttgacggcttgcccgctgttgtttcttttaatcgtcgttgagatttttaaaatagaacctaatcgtcatttgattttgttttattgttttttaaatatcccatcaaccgctacaccttattcatttatggctcacccgttatcccttcctctttgttgtcatttaccattgttgtggtacggttgttcttttaatatttctttatttttattttgaacttttgttattcataaattgtattctttcttaaacttttgtttttatttttataatttcgtaatttattttttttaattttaattaatcacatgttgtgttatagatgcttttttcttttcatagtctttattattttctttcgaatttagttatttataaatcatctgaattgttgggtgtatatttggtgattaaaaaggatcaaatagataaagagacagtcgcttcattttttattggcaacaaatatttcaaagtatgttctaagtagttttgaagtgattatagactgaaaaaataatacttacatgagcacacgtatatatatggctttctgcctacctagttcctgttgcttttttttcccacctagaatcaaacctataacagttttgaaattggatctcaatttatccgtcgagcagagcagggccgctttgtactcctgtattagcactacaactctaattcctatattcctatatacgtgttatatctcaatcgttaaattatgaacgttaaattgtgaatccactataatctaaccgtttaatctgactgtcattaatccatctcctgtgaaaaatatacactaattacaatatgtcgatatcatttgtactttcataaacatcaaagaaacttttggtgtttgatgcattgccggctacaagtattgatctatttattctaatgtctatctaaatatcatgtctttttactatgattggctcccgctaccattgggttcaagcccaatctttgctgcttgaaatctacagaatatatatgtgcagcagtgcaagcttttgtatatttggcagcacaaatcttgcccgtgtaggtttgtaattgaattagattatacgtgtactgtgtacaccgctaaagaaacagaaaggacaaagactcctagtatgtaacgtacacaatacagatctatggacttatcttttctcctacaaatctagaccgttaaaatttagaattgtaatcaatggttttattaatctcgtattgggttcttatatggacacctcttttaatattgcttatttttaattccgaatttcagttattttttagattgtatttttacttggactctccttttctttttcttcgattaatatgggaatttctagcctccacagcgaacgtagtgccttcttttcgagctatcttaataatataatagatagattttggggtttttcatcaaagtttatttttcagactttgtttatattgctaagaacacttatataaaagttttatttacaaattattttctgtttgcaaatatgtcatttcgcttattccgtcaataagagaaacgatagagtcctaagcttcttataagcagttagtgataatctagagaagctggcaaacccagtttctgatttcgagtttattttctagattctacaactacaacttttcaaaatatatgtgaaaatctaaattgtttgatggagtttctggcagctgaagattatagcagaagctacagctactgaaatttccctagacaggcccctcgcatcgcacgttgctgcgctcttcaaccgttcaaaaaagttttttttaaaaaaaacatttttttcaaaataaaaaggataaaaaaagaaaaccggaatggtggataactgctgaacgactacaattgcacgtatagattacacaatataaaagtgtggttccatatttccactgactcgctgactaacaacacgataccatacttgtcaacaatgcgtgtcaacattcgtgatgggcccttggaaccagaagcgggcacgtagcacccacgcaccaacactgagcaataacacgccgccgacggccaccggagtgtagttgaatgtctccttgttggccaccgggtacgccaccggcagcgagaagagcaccgtgacggtggccacccacaccacacccgcccagccgacgacgaccccgtatcgcccgaggtggaacggccctggcacgaacgatctccgagccgtcgtcacgcggaagaacacgggcagcgcgtacgcgatgtacatccccagcgtcgcgatcgaacccatcgcctggaacgccacctggctccccagcgactgcaccggcaaaaggcagagaaggcgtcgtcatcacgcgcactcaccgtgaatcaccggagcagcaatgcgaatgcaaatgcaactcaccgtgagagccatgacgaacgccacggcgacgccgagccagacgacgttgaggggcacctcgtgcttgttcacccggtaccacacgcgcgacaacggcatcgccccgtctctggagaaggcgtacgccatcctgcacaaacaacgagtatgtatatagcactttgagcaattcaatcgatcatcagggattcagggcgacgtgatgctagctctgtcacgcacctcgaattgctggtgacgcacgcgatgccgcagaggaagacggcgacggcgacggctcccaagcagacgatccctccaactccgctgccgtatctccggtggaaggcggtgtacagagcctgcgcgatggcgtagccgccggcgtcgttgctggggctgagcaggtacgggatgtccgtcacgacagatgtcagagccaacaggtaaatccaaccaaacaccgtcgcgaaaagaaccgaggtgatgatcccaattgggccgctccggtctgcattctttgtctcctcaacctgcatgcatcgtcagttaatcactgccacactaccgtctgtcaatgctcattcagatatctgcaacctgagggacagcaggattaacttaccatgtgagcagatgtatcgtagccgataacagagtactggctcatcagcaagcccacggctaggatgtaagccttgtcatggatccccatgccgttttccgtgttgagatgggtaaacacgaactcaatatttggcctgtcctttgctactgctggaatcaagatcgtcagcacaaagatacctgttgattgtttcagacagataaattcagggttcagaattcagatgcctagaaccgatagaactcacttcattgtgtacctgcagcattccagatggctccgacatggccaaacagagatagccactcgatagggaggctgttgatgatgccatgcaagattaggatgaaggcataaatcgccagcacggtgtacttggaagccatgtaaccgccgccattgcctcctcctgtgctaagcaagatgatcacttgtagcagctgcgccaacgagaaatctacgcttgcaatagctgcccactgccacaacaattgaagacaagtacaaggccaacgacgatgcaattatagtctgcaactgaaaaaaaacaatccccaagattatccaagttgacaatggcaagtgtacctgtcccacaacgttgaacctgtcgaacacaaaaaaaagacagaattcaagtaggcaccatctcaaggcaagaattgcatctgacaattttgcattagcacgtaccagccagtgacccaggaagccaaggaagcccattgtttgccggccagcttggcgctccagtagtatagcccgccggaagtcgggtacgccgagcagatctcggccatggacagggcgacgcagcagttgaacaccgccaccaccaaccatcccaacgtcatggacaccggcccgccgtaccgcagcccggtgttgtacgtcgtcgtcacccccatcatcacggagatgttggcgaaggagaaggcaaagttggacagtgccctgtacgcagattagttgtgaaaagagtcttgtgactggaagatccaaaatgcatgcttaattgctaatcaagaactagtctgaacaaattaaacacaagcaagcatatgcgtctatacgagaggccacgcttgagctcctgcttgtagccgagctggtgaagccggagactgtccggatcgacttgatcgccggcggccaccgccaattggacggagcgagacatggcctggatctctagatcctctaccttgggaagaagctttcacctctgttgctcactagtcgcgctatgctgcagtttacatgctcagacagctcagtgtaactagtcaagtttccgaaagagaatagtccaagtatctgtcatgtatgattcgcgagtcaacaaaatggttggaaattttgtaccactgattcactgatctgcccatgtcacgatttcctttcgtattacacgccaatgttgactcagaaaatataggatatatatacgtcacgttagtactacttctaatcacggttcatgttaaactatgcttgaatgggtgcatgcatgcttttttttcagtacagtttttgtccccacgcctgtccttttctaataaaatcagccggatcttagaccgttgaagttttcaaatttgcatccaataaaaatgtgaatccaatgaaggttatgtttggcaagagctagagtcagccaaaacgttttaatttcatctaaaatgtgagtgaagctggtggaacattctcacaaaatgaattagagatatactttagacccagaatggtaaatttaagagttgagactctaacaaatactaagccctaaagaacgacctcttattgggcccacttatgggcctccaagcaaggctacacatcagcgggcccatacttttctaggccgtcaaatcgggccgtcactagtgttggtaatgggcccttggaaccagaaccgagcatggagcacccacgcgccgacgcttgagcagcaacacgccgccgacggacaccggagtgtagttgaacgtctccttattggcgaccgggtacgccaccggcagcgagaagagcaccgtgacggtggccacccacaccacacccacccagccgacgagaaccccgtactttccgaggttgaacggccctggcacgaacgatctccgcgccgtcgtcacgcggaaaaacacaggcagcgcgtacgcgatgtacatccccagcgtcgcgatcgagcccaacgcctggaacgccacctggctccccagcgactgccaaaaaaacaacaaaattagcgcaccgtgtcagagcagcgcacgcaggaggaacagaagcagcaacgcgtgcaactcggaatataataattcaccgtgagagccatgaagaaggccacggcgacggcgagccagacgacgttgagaggcacctcgtgcttgttcaccctgtaccacacgcgcgacaacggcatcgcgccatccctggagaaagcatacgccatcctacagaaacccgacatgtaaatcaccaactcgacacgatgattcgatgaacagctagctgtggaatcatcagatcgatcgacgcgatgtgagcccgtcaccttgagttgctggtgacgcacgcgatgccgcagagaaagatggcgacggcgacagctcccaggcaggcgatcccgccagcgccgctgccgaacctccggtggaaggcggtgtacagagcttgcgcgatggcgtagccgccggcgtcgttgccggggctgagcaggtacgggatgtccgtcacggcagtcgtcagagccaacaggtagatccacccgaacaccgtcgcgcaaacaaccgacgtgatgatcccaattggcccgctccgatctgcattctttgtctcctcaacctgcatacacgcatcatcagctcgtcactgtgacactgtgttctatccatattcagttatgctcattcagatatctgcagcctgacaggagtagaggactcgtttaccatgtgagcggatgtatcgtagccgagcacggagtactggctcatcagcaatcccacggctaggatgtaagccttgctatggatccccatgccgttgtccgtgttgagatgggtaaacacgaactcaacacttggcctgtcctttgctactgccgggatcaggatcaccagaacaaagacacctatcattgttgattgttcagacagataaatttcgttcagggttcaatattcagacttcagatgccaagaaccacaattcataaggactggtgattattgcctccatgtgtaccatgcacctgcagcattccagatggccccgatttggccaaacagagatagccactggatagggaggctgttgatgacgccatgaaggattaggatgacggcgcaaatcaccaacacgacatactttgaagccatgtagccgccgccattggctcctcccgtgctaagcaagatgatcacctgtagcagctgcgccagcgagaagtctacgctcgcaatagctgcccactgccacaacagttgaagacaaggacagggcaacaatgcaaatttttttctcgaaaaatgaagttataagctggagctaaaaacagtatctagatccaccagacaatggtagtatacctgtccaacgatattgaacctgtcgaacacacaacacaataacaaattcaggctcgcaaattaagttgaacaacagcatacatgcataatccacagcaacaaatattcaaaatagtaatgatcaaacataatcttcaagaaggcaccatctcaagacaacaattttttttcaaggatatcaagaaaacaattgcacctaaccattttggattagttccagtgcataaagacaggggaaattgatgcagactagctcatacatgtctcacgtaccagccagtgacccaagaagccagggacgcccattccttgccggccagcttggcgctccagtagtagaggccaccggaggtcgggtacgccgagcaaatctcggccatggacagggcgacgcagccgttgaacagcgccaccaccagccaccccagcgtcatcgacaccggcccgccgtagcgcagccccgtgttgtaggtcgccgtgacgcccgtcagcaccgagatgttggcgaacgagaaggcgaaattcgacagggtcctgtgtgtatatatatccagatgaatcgatcaagatggtcttagttttgaaaagaatgaactaattagcacggtgaatgcatgctaagtctgaataaactgaaacttgttgtgtgcatacgagaggccacgcttgagctcctgcttgtagccgagctggagaagccggaggctgtccgggtcgtcggcggcctgatcgccggcggccatcgctaattggacggagcgagacatggccgtggatcagttctctatctcctgtaggctgtttcctgggaggctagctatttttgacgctatcacctccatagctcactaatcctgcagagtatagtttacatgctcgctgtactagtcaacttcccaaaaaagaaatgtccaagtacgtacctctctcttatatataattcataatcaacgaaatggttggaaattttgtataccactgatgattgattgatacgcttatgtcacgattttcctgtagtattgccaactaccgttgactaactgaaggataagatgcaatatatcgctgtataccttatgcgttccaaaaaaaaaactgtataccttaggacttttggttcatgtttaaactatgcttgaattattgcacgcatgctgcttttttagtatagttctgtacctcatgcctgtctttttctaacataatcagccgaatcgtagaccgttgaatttccatccaaggacatgggaatacgaatcaaaataaagaacggcctcttactgggccgcccaacaaggctacatgtacgtgggcttccttgtcagccgtagaactccatgggccgtagcacacatgcatcggcccatacagttatgggccgtcacagcgggccgtcattagtgttagtaatgggcccttggaaccagaagcgggcacggagagcccacgcgccgacggtgagcagcagcacgccgccgacggccaccggcgtgtagttgaacgtctcctccgccaccgggtacgccaccggcagcgagaagagcacggtgacggcggccacccagagcacggcggcccagccgacgacgatcccgtacttgccaaggtgaaacggccccggaacgaaggatcccctcgccgtcgtcacccggaagaagatcggcagcgcgtaggagatgcagagccctatcgtcgcgatggacaccattgcttggaatgccacctggcttcccagcgactgtcataaaaataaagcataattctggttattctgaactgagaatcaagcatgaaaattaatcagcagtggtacgaattaactcactgtcagagccatgatgaacgccaccaccacagagagccatacggcgtttataggcacctcttgcttgttcactcggtgccagactttcgagaacggcattgctccgtccctggagaacgcatacgccatcctgcatgcagtggctaattaacctaggaaattatcaacatgtacgtagctaattaagctaagctaaattcctgaacacgtcagctgatcgatcgatctgacctcgagttgctagtgatgcaggcgaggccgcagaggaagacggcgacagcgacgactcccaagcagaggatccctcccaggccgctgccgtatctccggtggaaagtggtgtagaaagcttgagcaaccgcgttgccgccggcgtcgttgtcggggctcaacaggtagggaatgtccgtcaccgccgacgtgagtgacactatgtagatccacccgaacacggtcgagagagcaaccgaggttacgatcccgatcgggccactccaatctgcattcttcgtttcctctgtctgatgcatagaatgatatactgtcagagtgtcagtagtatttgcagtttagatatggactactgtgtctaggggcgaaatcgcaacgtaccatatgagcagatgtgtcgtagccggccatcgcgtactggctcatcaacaacccgatgagtaaaatgtaagccttgtcgcgtatccccatgccgttttctgtgttgaagtgagtgaaaatgaactcaacgctcgccctttccgtggcgacagccgggatcaaggccaccagcacaaagacacctagcaaacgaagaacaatagagtgatgatggaatcgatggtgacttaataaggagatcgattgcaagaggaggaaaaaaaaataatttcattacctgccgcattccaaaaagctccaagctggccgaaccaagagaggcactggatcgggaggctgttgatagcgccgtggatgacgagcatggcgccgtagatggcgagcacgacgtagttggaggccatgtagccaccgccgttggctccaccggtgctgagcaagacgatcacctggaccaactgcgccaacgcgaagtccacgctcgtggtagcggcccactatgtcatcaagagatccatatagcgtcagcccactgttaggcttttctgtacggaataagttcacattgagtccctctatttgtcactcagtccgattttcgttcttgaccgcaaaaccgggtatgacccatcccccaacttacaaaaaccgtgtagacgaggtccctcagcggttttgaaggtgattttggctgatgtggcgactacgtggcttgtttgactagatattcgtcccacgtggcattgacgtggcgcttacgtggcaattatatctcgaaaaaataataaaaaacatgggacccgcatgtcagctaaaaataataattttaaaatggtggcccacatgtcagctactcctcccttcttccccctcccttctctctcatattcatcgtcctctcttcttcatgtgcgcagggggaaggaggcgagggggtgcgacgcatcccccacaccgacaccacccccagcgcgccgccaccgccggcatcttcgtcttcctcctcgccgccgctgctgccgccagcatcttcgtcttcctcctcgccgccgccgcggcaatcgcggcaagcaggccggcgacgacgacgtggagatggccgaggggaggaacaacaaggtcgccgacggcggcagcgccgatgactcgacgaccagcggcaaggcggacaccaaggtgtagctctggcgtctcagtcaatccatgagcgatcgagtagctcagtagcatgcaatcggctaagatttcctgcatgtgttctagtactacaagtaataatattagctagcctaaaaggctaaaacacataacgtgcataaaaggaaagtactatcctaactgaataaaacagcttttgcaggcacaagtttaacataatatgtctgctttgatctttatttggaagttgtaattaaccatgtttgtaataacgagataattaaacgagagtatccatgtgtcaagaggtcaagcgtgacctctcccacaccgtccatggcttccccgccgatgagcaccacgtccgggaggtgattgcgctcacgctccactcccgcgcctgcgtcgcgtcgctgtcacgctgcctgggcgtcacgctcaagatgctggtgctcgtccaccgcctcctcgccgacggcgacccggcgttcgagcaggaggtgttctacgccatgcgccggggcacccgctccgtccacccccgcccccccagcgccgccacgccgtcgcccgctccagccagcctcctcgtcgctcggccgccgtgcgccgttccagccggcctcctcgtcgctccgccgcccatgagcgggagagagacaagagggagagagaggggacagagagaagaggttgtgaggatgacgtgtgggtccacatgggcccaccttttttattaatttgtgtgtgcaactgacatgtgggccccataagttttattatttttttgggatctaattgccccatcagcgccacgtcaataacacgttggacaaaaatctagtcaaaagaagccacgtcggtgccacctcagccaaaaccagagtcaaatactgccgagggaatttaaacggtttcgtaagttaggggatccgtcgtacccggttttgtgattaagggacgaaaatcggactgggcaacaaataaagggacccaaagtgaacttattcctttctgtactcatggcccaataaaaaggcccatcaattagcgagaagcccgggcccagaaatccgaatgtacctacctgtcccgtgatgttaaacctgcaaagcagaacacaaggaatgaaaaacagaacaagagataaaggtctttctctctttttttctttttgagaaaataaaggtctcttttggaatgtgcgagttttacaagatttttatatacgatcgatcaatttccgcgaaaatcctataaaaatatcctattttaaacgaagcctaaaagatgctggagtatgaaatttttgcaaggctttcctcatttcttggaacgagaagttcatgagagacggacaattcacaatacatacacgtactcaccagccagtgatccaagaagcaaagggagcccagtcgttgccggcgagcttggcactccagtagtagaggccaccggaggtcgggtaggcggagcagatctcggccatggacagggccatgcagccgttgaaggcggacacgacgagccacccgagcgtcatggacaccggcccgccgtagcggagccccgtgctgtacgtcgtcgtcacaccggccatcacggagatgatggagaaggagaaggcgaagttggagagaacactagctcacgaaggccaaaaacaattaaccaaagatgccaatgaacagtagtagtttgcgaggcttcgcatggtaaattcataagataagctgctccttacgagaggccgcgcttcagctcttgcttgtagccgagctgccgcagccgaattttatctcgatcgccatcgccggccggatcggcgggcacggccacctcgacggagcgagagagcgccatctgtatcgtgcttcctttgcagtagatttgcaaaaactttacaggctcagtgcatggtactagtgtctggtttaggcagtagcttctctacgatggaagaatcaagatgtggatggggatattatttgattgggtaggatagtagcaaaatttaaccgtcgcctttcatttccggacaataatgcaaattgctttgatatttttggattgtttcagcttgtgcattaattggtcttcagctcttcgatgtataccggatccctcgctgtctctgatcgatctgtttgttcacacctgtgtggcgggcgcggaggaaaaactccgaggaaaagcccatgaaattgatgagtcctcggcctattaggcccaataaacaccacaagaatatcttggggaaaaagtacacccaaggtccctcaacttgtcatcgggttacaaaaacatccccaaaccacaaaaccagatatacaacgtctctcaacttacaaaaccgttcgttttgggttcttcagtggtttttaaccctggttttatccaacgtgacggctgagtcagcgtaggacccacatatcagggtgccacgtcatcatctctttcctctcctttcccttcctcccctcccccccgggtatttaactatttgccacttttagatttgtcaattaactatttgtcacgtctatctcaatgacatatgggtccacatatgtctataacatatggatccagttagtttccacatctaaaagtggtatataattcagtatctcccccccccccccctccccctcacttttctgctctcgcagggtcgggaggaggtcgccggtgacgtgggagaaggggagggcggcggcagcggcggactctggtgtctacgccaccgagcgccaccgtcgctcttctcctctgccggccaccggctctgtagcatgatgaaggggaagggcatcctcaagccgaggcgcctaggatgcggcagcaaggacggcgacaagggttgtgcagcggcctcctaggattcggtggagatagcgtggcggcggtggaccaacggaggccgcgccacaggcagagcggggtggaggcggtccaggtggccagctgcgtgttcccgccttccctccgcagcgctggcttcacgcactgcaggaggagcgccacgtccaagttgccctcgcctgcaattcccccggcccccgcagagactaggaggcagcaaatcatgagacgcatcatcgatctcatctgcttgcttgaattgcgttggggcagagcatgtgaacacactggactggagcagtggagtgaaagagtgtgcaagtgaatcgagtgagaaccactcttaatactcaagggagggaagtgatgactgattgactgctccctctactgctgctcgttcgttccgccgacgatggatctgcagcgcctcgatccagggcagccgccccggctgcttcgaccttacgagcaactttttggagcgccgcgtcgttggccatcacccacatctgtctctctctggaatggcgctctccacgtcgtcggtgagggcggcgacgcgccgacgacacaccgctcggtgcccgcgggcctcctccgctcccaacctcatctactcccgcgtagtggccgagatccaagagcggcaccggcgcgcctccgcctccagatggtcgacgtcgaccgccgcccgccgtctctgttgcctctgcatacacggctgcccccaccaccccgcacatccttgctcacctcaccaccgtcggggtccacgacagtgagctcagggaccgcttccacgtcggcgtcggcgtccaacggccgcggcgatgacagcggcaggcgaccctcggccggccgtgtgccaccggtctccccctgccgccgcccgtcttcgcccagcgacctcctccgacccgtcggcagccagcacagaggagaaatgtgtgtgagagagagagagagaggaggaagttagatagaggaggggatgacatggcatactgatatgtggggctcacgctgacttagccgccacgtcggataaaaccggggttaaaatcaccgaatgacttaaattaaacgattttataagttgagggacactggatatctggttttaccgttgggggatgattttgtatctcaatgacaagttgagggaccttgggtgtaccttttcctatcgtgggtccccgtcgcaaacatcgtaagacaggtgcatccgcatcgatctggaccacgcagtttacatccgacggctcaagcgaatcccatgataggattagggaaaaagtacaccgaaggtccctcaacttgtcatcgagttataaaatcgtcccccaaccacaaaaccagatatcggacgtccctcaactaataaccgttcactatagatcctccggtggttttgaccccgattttatctgacgtggctgttgagtcagcgtggaacccacgtgagtcccacatgtcataatgccaggtcatctctctccccctcttctctcccttcctcatctctcacttctctccaatttgatggcgacgcgggcgacgcggctgcagtgatggcggcggcgggcgacgggaggagctgcgggcggagcgggcggcggcgggcgacgggaggagctgcgggcgggcggcggggggaggagcaccgcgcggcgggcggagtgggcgggcggcgggcggagcggctgcggcagatgcacccgcagcacgggcctgccggaggaccaggcgacggtgcggggagcggccggccggcggagcagacggggcgcgggcgtgcagcagatgaccgggcgtgcggcagacggcggaggttggcgtcggcgtgggcgaagcgaatgaccgggtgggactcgcgggcggcgatgtcgacgccgcggaggtggacgcgacgcggtcggggtaggcccagtggtcgagacggtagaagaagagcggcatggggtggcgggagcaatggcgctggtgcctggtggtcgcggtggaaggcgtccgtggcgatgaggtcgtgcagacgccgctgcagcaggccacctcggcggcctgcttgcaatcaaaataacaaagtattaccgtttgttatggacaaaagcatgaaattttattcagaatagctcatgattgtaatgttaccacattctgttcactcatagcacaaattgactctgcagtgcacacttactaacaaaatacagtaggcaatttcattgattttatccatgcagtttgcattgtttttttatcaacaacatctgtttggttctgcttttattttgaacattaacaggctaactctaactcatatacaatgtcaggccatggtggcagcgatggtctacatggtgatgtgccttcactagattatgttgtagaagatacagtaagtctgaatataagcaagcagtcttgcaattattccttcattcagttacttatgaaatatattattatcttcaaacaagatgtacttcttggtaaaattgtgcttgagaatccaggggtcctctgttttcttcttggtcactccactgggggagctgttgttttgaaggtatgccttgtaacaataagtagtttttctctgctctatttaggcgaggtttagaaactgaccctactcctttgggcctgtgaataatggataattggatatcctgacgggcagagcaatggtgcaaagcattaacaaaatagcctggttgaaaacttgaaatggtttggctgcagatatgttcattttacatgcttcatattcttctttcccttgtgcttgtcagtagctggtattttccaggcatcattgttccctcatatcagagcaaaactggaaggcatcatcctaacttcaccagcgctgcagcgggcgacctcggcggctggccgtttgccgccacagcctggttgcctccgttcgccgccgcagcctggtcgactccgttcgccgccggctcctggtcgccatgctcctcaacggcgcgaggatcatcgacggctgctacatggcgagacgcggccccgccgccatcggcatccccccgtcgagcggcgcgcgatggaggaagccgtcgccggcgactctgctcagcggaaagaggagaagaagaaggccgccacagcggcggcaacgaggatgcgggcggagggcgcgacgccggccgccggacctcctcctctcacctccctcccggctgcgcgcggtggagaaagccgccgctggcgactccgcctagcggaaagaagcgaagaagaaggacgccggccgccggacctctgcctccccgcccccgcgggggcctcctccccagtccccacccgtcggccaccctgccgcctggccagatgagcacagcgagagaaagaagaggcgaaataagagagaagtgatgaggtggcatctgacacgtgggtctgctgactcaaccgtcacgtcacataaaaccaaccaccgaagtaaacggttttgttaagttgagggatgtgatatatcttgtcagaggacgtttctgtaactcgacgacaagttgagggaccttcagtgtactttatcctaggattagcgactcatttcacggtggcccaaagtcaagctgttaaaccaatccggcccatgttgaccgctcatattccgtaacgggccaaatgcaagcccactttttacctgggcttggtaggaaagccacctacacagcccctttcgttgggcttatatcggtccaaaaggaacacaaattttgagtttaacggatcggtacggatccaattcgtggtcaaacccaaatacgcttcaaattgaaatttatcaaatcagggtacgcgcgttcaaatttacaaaaattcagggtacgttttacgcgtcaacgttggtgacaggcccttggaaccagaagcgggcatggaacacccacgcgacgaggctgagcagcagcacgccaccgacggccaccggcgtgtagttgaacgtctccttggccaccgggtacgccaccggcagcgagaagagcaccgtgacggtggccacccagaccacggccatccagccgaccatgagcccatatcgcccgaggtgaaactgccccggaacaaacgacttccgagccgtcgtcacgcggaaaaacaccggcagcgcgtacgcgatgtacagccccagcgtggtgaccgacaccatcgcctggaacgccacctggctccccagcgactgccatgagaaaacaaccaaatcagagcagctcgagaaatttacagcagcagcagcagcaatggacttagaattcaccgtgagagccatgacgaaggccacggcgacggagagccagacgacgttgaggggcacctcgcggctgtccacgcggtgccacacgcgcgacagcggcatcgcgccgtccctcgagaacgcgtaccccatcctcgagttgctggtgatgcacgcggatccgcagaggaagatggcgacggcgatgacacccaggcaggcgagcgctccggcgccggtgccgtacctccggtggaagctggtgtacagggcctgcgcgatggcgtacccgccggcgtcgttgctggggttcaggaggtaaggtatgtcggtcatgatcgatgtcagggcaatcaggtagatccacccgaacatggttgataggcctacggacgtgatgatccccatcggcccactccaatccgcgttcttcgtctcctctatctgaatgtgcagacaaaaagattcagtgattcgtcgatcagttgaatgcatacgaagagaaagtaggattgttcaggacattcaacaatcagatttattaccatgtgtgcagatgtatcgtagccgattacagagtactggctcatcagcaaccccacagctagaatgtaggccttctggtggatgcccatgccgttttctgtgttgaaatgggtaaagatgaactctgggctcgccctttccttggcaaccgatgggatcaagatcgtcagcgcaaacacacctggatcgtgtgttgatacagacaaacagaacaaagatcaaatcacgatcagatgatctgatgatgtaaatgttcagactgaatatctgaagaaacggtcgggacgttgagtcgactgtacctgcaacattccagaaagctccaagttgaccaaaccaggagagccagtgtatgggaaggctgttgatgagaccgtgcaggatgaggatgacagagtagatggccaacacgacgtacttggacgccatgtagccgccgccgttggcgcctcctgtggcaagcaagatgatcacctggagaagctgcgccagcgagaaatccacgctcgtcgtgcaagcccactgggatgagtggaggagcagttaacgagcgattggagcgtcagagatttctgcgctttctggaaacaattcgagagtgcaaaatgtactttttttatttatttttaagaaatcgtgaagtttgaacaacaattagtccaaaggtatattgagaaaaaaaaaggaataaaattatattcatatttgaaagcactttcaaaaatcatggctcattaattacttcctccatttcatattattaatcgttttgtctattttctaagttaaacttttaaatttataagaattttagcaacgtctacaaatcaaattaatctcactaaatgtaccatttaatatattttataatagatttgttttgtactgaaaatactactatatttttttataaacttctacataactcatggagtttgaatgcacgtacctgtccgacaatattgaacctgtaaaacagaagacaaaaggattaagcggattccatatttaaaacatgttaacgattaaattaaagcatgagagataaattaagctaggacgcgaagaacacaccagccagtgacccaagaagccaagggagcccattccttgccggccagcttggcgctccagtagtagaggccaccggaggtcgggtaggcggagcagatctcggccatggacagggcgacgcagccgttgaaggcggacaccaccagccaacccagcgtcatggacactggcccgccgtagcgcagccccgtgccgtacgtcgtcgtgacgcccgtcagcacggagatgatggagaaggagaaggcgaagttggaaacaaggctaacaaaggattgcaatatatgccaaattaacactcacaagcttaatttggtgaaaaatgatcgcaatgaagtgtggtaaaagaagggaagaagaagcacatacgagaggccacgcttgagctcttgcctgtagcccagctggtgcagccgggcttggtctgcatcggcgccggcggcgtccatggccaccacgccggagcgagacatcgccgtcggtgtctgctcactacttttctctatgatatctccgcggttgcgctgctcagtaattgaatatatataagcttcctagatgaagaaagtctttggtgtacagcgagtcaagggagggactggaaatcatgctcggatgcagcactccggcgtcttcgctttcgcatgcttcgccattttttattacttgcatgattgattgctatcgacgtttatcgtagccatccctttctttggtcttgcatttctccgtgcattaaaacagagtaaattgccctttgccctttgaaccgggagacggcagtaatatagctggtttcattttactaggtttgcatcatattacattattattgaacacgaggattgtaaaatatgagtaaaacatactgagcttcttaaatttagaccatatttcacaacatgtttttctttgattttatgaaattttataggcttgatgatgcatcccgatgttaagtgaaatttattttaaaataacttggtgtaaagtgaaagtataagcaaccccctgcaatattacttttgacatgtcgatggtgccacttgctcaagggcctacatgtcagtgattcctaccgcaggagcggtgccacatagcaattgagtccatgtaaaaacaagtgaaacacgatgcaatttacatagtgcaaagtacaatttactcttaagaataatgaagatgatgccatccacatgaagaaatttcttgttggccttgcatttctctgcactgcattaaacaaacaaacgatcgggtcatatagatctcggatagtaatagtacccttgatggtcatagagagtaggtgcacggtgcacccaaattaagcatgtgtgactggtcttggcgccaacgtagttgtccatgctagctgaaagtttgcattcgcccatctctgaaagccaccttggcaaaaggattgcatatcgtgtgccgctgccctgaaagttaaggtccatcgctcgccttcatgtcaacaatggtgctgctccgcccaaagcgcctcggctcattgacaatcatcactcatcagtgttgccctaatcgccaccgtccctatcgactatgcgtagggaggaggggaggtgaatggacattttaggtgtgtactatagggtgcagtggctatatgtaattgtttttccacaatggtttttagaggtcttgaatgtaatgtttcaactaccttggtcaaccaagtgggcacttgaaacgcgtttttatctgctctggtatattaaaccatgattatgaatctaaatatgtaatttacaagatcacggatctaagtaacactaccgtccaaatttaaagacatatcgcgaatatcgctcacaaggaatatgagtcatccttatagattaagctactcgtcccttctttcataaagttaatgccaaaagctcaaacctcatgcttccacgtcatcatcaattatgaaccattggatgaatgcattagattgcttcttagacgttggatggaacgcaacatagagcccaacccatcaagcaccgggtgagtctcttcgcctccttagtgccaaatgtagcccacatgaacacattaacccatctccacactcatctacatgtatccgacccatcaatccgtataaaagagcttcatggccgaatgcccattcagttaacattacaatttgttaacttacgtcagaccattttgcttctttgtagcttatgctttgaatgcgctacttaaattatctacaaattttggacagggttgctaaaaagaatttctctaagaaagtcatttgtttcttcctttcttcttgagattgtacctcctatctaacaaattgatattaaccaagtcccgcagcaacgtgtggggcatcctcaagttaattaagagacaatatacataacagacactacctaatttaaacactactaccttatagattatggaaaccgatatatatgtcgatcagctgggaacaataataatccatggccttgtttggatcctccgggctattaaatagccctccgaaatcttgctatttaggaatattaaacatatattactgacagaacccattccataacccctagtctattttgcgagacgaatctaacgagtaacgaggtatattaatctatgattagtggatgattattgtagcatcactgtagcaaatcgtggattaatatacctcgttagattcgtctcgcaaaatagcctagggattatggaatggattttatcattaatctacgtttaatactcataaatagtaagattccggatccaaacaggacccatgtggatatgcatagggccgtaattatcagttgatatgaatacatggtccgttggaaatagtccaggtggacgtgcatactatataatgatcagttgaccatacgatcggttaggaataatccatgtggatacgcgcatactttaataatcagtttaccatactatcttggaatatataatatatacatggatatgcatattcctacgtaccttagagcacgcgcaaattgttgatcattgagaaaagttcaacataatttctatactactactgtactacatgatgccttagtaattgccactgattgtctgattaagcactggcttttgccaacctgtgatgcccatgttctcttggttcgttgatctctccaataactaccgagtcatgtgcaatgtatagaagatgcgtccctttaggctgagcaaattaaacttgatgatcgttttgtaatttcagcctgaaagaccctcttctcttcctccgctctcttaatatgtaactcaaaaaacttgccccgcagtgaattttcccaaaaaaaaaaaactaccgagttatgtcggcgacaagtctattcaattcatcaagcacgcatctatctttttcctatatagtttatacctattaaaatattaattcctacaaagtaacatatacatagagccacatcatcaacaatattttatcattagattgaattagtatgaagatagtagttatggccttatgggatcaagaagttatctggggtgtgtttgattctaggagagaaaaagagaggattggaaagatacacaaaacaagctaaaccattagcgtataattaattgattattaactacttaaatttaaaaaaaaatgactaatatgaattttgaaagtaactttttttatattttcataaatacattgtttagcagttcgggaagtgtttacataacgggttttttcatcatgataattcttcactcatctatgattgttcagttaattgttgagtactaactataatttaatttttatatttttcatagtgggtataaatttattagcataagagtgataaatgtcaactatcttacttactaacggatgggtgttatggcttacgaatggcaactacctttctttctaacgacttggctctaatggagcaaacacctaaagttgaagttatgtacacacacacatacatacatacatacatacatacatatatatatatatatatatatatatatatatatatatatatatatatatatatatatacaaccgatcaaatacatatttttatccattgttttctgttttatcatagataggtttcgctgcaatgcgtgatgttctcgctagttttcctaactatcaataccacatctataaaagatgacaatcgatgacacagtaagctactcttctcaaaaaccatatctgctatcctgcctactattggtagagacccaatttggtgatgggccaaatagacggccaactttttttggtggagcaattttacagtatttgactaggtatcatgaggtactaaaattttagtgtaaaatttagtacctcgtagtacctaggtactaaaatgtaccaaatttacaattaaaaaaagtggtacctcatgtatcttctcaaagaatataaaattgctctttttggtgggttcgatggaggagccacatgtgcagcacccttcgttgggcttattttggtctttgtccccattacaaccaacaagatgcacatcttttttccctctcaagagaaaattgcacaaaatttaagttactgatccacctgtgctcgctagctaatccagggatacaaattcagggtacgttgtacgtgtcaacgttggtgacaggcccttggaaccagaagcgagcgtgaagcacccacgcgacgaggctgagcagcagcacgccaccgacggccaccggcgtgtagttgaacgtctccttggccaccgggtacgccaccggcagcgagaagagcaccgtgacggtggccacccacaccacacccacccagccgacgatgaccccgtacttgccgaggtggaacggcccgcgcacgaacgatctccgcgccgtcgtcacgcggaaaaacaccggcagcgcgcacgcgatcaacaaacccagcgtcgcgatcgacaccatcgcctggaaagccacctgactccccagcgactgtgccaaaaaaacgtacactatatgagaccagcacgtacgtacgcgcgcacgagaaatttgcagcagcagcagcagcaacgcgtgtgcaactcaccgtgagagccatgacgaaggccacggcgacggagagccagacgacgttgaggggcacctcgcggctgtccacgcggtgccacacgcgcgacagcggcatcgcgccgtccctcgagaacgcgtaccccatcctcgagttgctggtgatgcacgcggatccgcagaggaagatggcgacggcgatgacacccaggcaggcgagcgctccggcgccggtgccgtacctccggtggaagctggtgtacagggcctgcgcgatggcgtacccgccggcgtcgttgctggggttcaggaggtaaggtatgtcggtcatgatcgatgtcagggcaatcaggtagatccatccgaacatggttgacagtgcaacggacgtgatgatcccaattggcccactccaatccgcgttcttggtctcttctatctgaatatttatatgcgaggagaagattagtggatgaattgtatgtatgcaacgagaaactaaggattgttcagctatcagaaagttcagaattacgatgtgtgcagatgtatcgtagccgataagggagtactggctcatcagcaaccccgctgcgagaatgtatgccttgtcgtggatgcccgcgccgttttctgcgttgaaatgggtaaagatgaactcagggctcaccctctccttggcaaccgctggaatcaagatcgtcagcgaaaaggcacctggaattgtttgttcaaacagacaaaccgaagaatgagatgatgtatatatgggattcaacactgaatatctgaaaaatggccgggacgaacagcacctgcaacgttccagaaagctccaagttggccaaaccaggagagccatcgtatgggaaggctgttgatgaggccgtgcaggatgaggatggcagagtagatggccaacacgacgtacttggacgccatgtagccgccgccgttggcgcctcccgtggcaagcaagatgatcacctggagaagctgcgccagcgagaaatccacgctcgtcgtgcaagcccactggaggatcagttaacgagcaattggagtgtcagatttctgcacttttttccctcaaaagatttctgcactttctgaaaacagttcgagagtgtaaaattaactcttctttttactagttatatgcatgtatgttataatgaattagacccatataattagggatatgagccgcctatacgttaatgggccagcaccatataattagggagggatggtggttacttttcgtgaacagacgcgttatgcatattcggatgagagcatgaaagtagaataatttcgcttttaaaatagtagagatatacgatttagacttagtgtggaccagtgagaaacatattcatacttgtcccacaatattgaacctgtaaaacgttatgcatattcggatgagagcatgtaagtagaacaatttcgcttttaaaatagtagagatatatgatttagacttggtgtgaacccgtgagaaacatattcatacctgtcccataatattgaacctgtaaaacataataaggaaatattattaaattccaaaatttaaaacatgataacgattaaaccatgagagataaattaacatgttagcgaagagcacaccagccagtgacccaggaagctaggggagcccattcctttccggcaagcttggcgctccagtagtatagcccgccggaagtcgggtacgccgagcagatctcggccatggacagggcgacgcagccgttgaacgccgccaccaccagccatcccaacgtcatggacaccggcccgccgtagcgcagccccgtgccgtacgtcgtcgtgacgccggtcagcacggagatgatggagaaggagaaggcgaagttggaaaccaggctaacaaaggattcaatatggtaagtttacactcacaagctacggtgaaatttaaaatgatcgcaatatgaaatgcatgggaaaagaaacataaaaaacgaaagaagaatcacatacgagaggccacgcttgagctcctgccggtagcccagctggtgcagccgggcttggtctgcatcggcgccggcggcgtccattgtcactccgacggagcgagacatcgctgtcgatctctgcttactacttgctagttgctacagtagtacggagtatatagtatctctgcgatttactacttgtatgatcggtggcgtactggcgttgctcagtacagaatataagcttcctagaagaagcaaagtctctgtttggcgtacaactagtcaagggagggagtggaaatcatgcacggttgcagcacaaacactttgccatttttgactttatgatttatattgctatcgacatttatcgaagccatcccattggtcttgcaattcaccgcagtcatcccattggtcttgcaattcaccgcagtctgctggtaagtttttctgcatggaacagtgaccgggccatagaaatgtcagacaatgatagtcgatacagcccaagaaagcaaacacacacacagagagtatatcacgtggctcatggacaaatccttacgcgcaaccgcaagaagccgacgtacggccaccggccgaccggcgtgttgtagaaggcttccttcgccaccggcagcgggaagaacacggcgacggtggccatcagaggaagtagaagtgggaaacacaaagatagagaactgtactcacaatagcaattgtaaaccaatacagtagtagatggattcagacaagaaagcaggatcaggcacgagaggctcaaaaaccagaaccaccgtttacatgtgtagaagaaagattgttattacatatggtacttccacaataatgataactacactgctgcctcgatctcatggcatcctggcacagaaaccgcattaatgcgttctaatggcaaagaaaaatttacaggatgaactgaaatacagattccacgtatgtcccgtcccgcttaagattaacatagtacaacctggcattctttatggagttgttcttttctccgtttccacagttcccttggaggtaaactaaaacatcattaacagtaacaagacagcaggctcagtaaggtcggtatcgccaatcagcccttgatctgctactgctacttccgctgtgaccataaccgtactgggacatcaacaagtttttgttagatgatttgcatgagattcaacagataattggtgacaatcacaacgaaccaacattaagcctacagctctgttatcacaaatgtactcggaccaattaacttatatataagcctactgtgcatcataagcataataatgtatttgtgcacttacatcatagtcgataccactgcagaacctgccataagttcgcattgaaccataagccccataaagatccatgggttccatgtaaccaccaccagagtcaccctcaagtggtgcagcagtgtctattgcaacctgaaacattggaatggtatgattagtgtttttcttttccccaaagaaaagctaaggttgacattgtcactttggctttggaggcatgggaagcagagacaaggagacaccaacagccttacctcatgtcctagaatttcatgacttctgcgagctacccgatctgccacaccctcatcagcaaaggtgacaaaaccaaaacctcgatgtccacttcttttagggtccttcaatacaattagaaaaggttgagattaacatagtacagttacaaacaatgagaaagtcttaaccttacctttgggatatatgcatccacaattcggccaaatttgccaaagtaatgccttaggtcctccgtgtttgcctcttgtggaagcctgccaacaaatatctttttgttgcccattccttgggaggatccatagtatcctcctcctagtcaatgtaagtcaaatagaaaacatttaaccagttaacaaagttgctttgtgtcaaacctgtgatcttcgtagcagaagacttacttccataagctgaccctggatggtcatacagagtaggtgcacccaaagctgcatatctggtagctgctgaaatgtatgcattatatgcaccatagccaccctgagatgcccccctgcttggaggatatctgacttcttcatcctggttcagatggatttcaggtggtaacaagtacataactacttcagtaaatagaatgtcctactacagagcctactcaaagataagatactattggatgcagccaccaatggcaagtgctttggagcaaaggtaccttaggagtggcgcggtcaacaactactgttgtgccatccagttcatgtgaatcttgcatgatactgtccacagattctgtaacattacagttgcattgaataaggtaattacaaaatgcatatcaagcttaaagatcaaactggggaaaaaagcaatcatccctaaagaacacagacatgaagtaaaggtttcaggtcaagatgccattttatataaatgaagactcatctatgctaaaattattcttccccaacaacaaattaaaatgaacgcctgaataaatgatggaggatttctgcaaacgtacctgcactctgaaaagtgatgaacccaattccacgatgaccctttgaaccatgttcctacacacaaaacaggagggtggaagactcatttcagtaaaatcttatcatatttagcattgtagctccattcattaccatataatttcaataatcaattgtagcaccaaaacaaatactcgtaccaaaaaaaatccacttatgagcttaatgctgattgtgacaaacaagaagaatgctattttaaatgcttcgcctgtgctaacttaaattcaatcagcaccttctatatccagtctcttataagatgcatgcctaattagcgaaggccacaggagtccagacaatcctagcattaggattagtttagatatttgtccttatcggaaggaaatctagttaaactagtgataagcaaatctaggtaactatatagaaagagtgtatctacttgtattggtacttaattgtgatatcacagagaatacataaatatttttagcaatttaaaaataattccaaatttgctcacctttggcatgtaaagatcagtgatttctccataggcttcaaaatgcctatcaataaaatgttctgattagagtctttatgcaagctcggatattcaactgataagtgaactgagtgctgaacaaaaggactgaagctatagcttacctacgaaacatggactcatccacggactgcggaattcgagcaacaaatattctagtagccttttttgatccctgtgatttcatttcttcctattcaatgacaagatacaccatagtcaactacagcttgatgtgaatcaactgtacaacatactgctagcatatataatatatgtttgtattttatttaccttaggagtggctatcttcacttctagagttcggtttccgagaacatgctcacactcaagaacattctgaaaaaaatgttgcagaatgattcagaacgaataaattgcagcagtaccaaatatgttagaagatagggtattactaaaccatgttattataccacattaattagtaaacaagatattactaaaccactttattataccacattaattagtaaaccactttactaagcacctcttaaaaaattcgaaggttgatatttcacagttgatatataaactctaacaaaagatttaaaatacaacactagtcatgcaatgtaatatcaagtcagcaaatctgggagaacaggattactaccttggcatcatcagctgatgagaacgttacataaccaaacccacgagatcgaccagacgaacgctcctataattttaacgtacaagaaagatagtggtcagtcagtacacaaattaccaaatcaggctaataaattgatgaatacagtactgaagaagttatttaagatgtgcatccagaaattcaggactcaattttggcggacaaccccagaaaaagggagactaaatagaaatcagattctgaaagcgaaatacaagcacatagccatatctgttccaaggcaaactcattattgaaaggaatagattaccaacagtacaacatgtgaggctgtggtttcccaaataactttaaaaagacaagaaacatattctcctcaaatcttaatggcatgtaataaacacaaagaatatggcatctaatatcttattctgaatatgaaattgctacaaaccttcatgacgacgcaatcatctaggggtccaaacttgcccatgtactctcttaatccttcagtgtccacatcccatgggattccaagaacctaagtaaataaatctcatgtcatcattcttcatgaatgattaaactatgaaaggacacattcgtttatagaatcctaaaaagagaaagattgtccacttaccacaagttttgtggccattatagcactagctccagcagaacttttcagctctcaagcctcaagcctttctgggccaaggaaaactattaagtggtctttctgaaggttcccaagaatcaccaagatatttccctacagatatatgaagagaatccacacttataagtttcttgcgcatgaagtcaagtaagcacactagggtatgatggtttatatggtttggtaagaaaattaaattcatattcatactcgtagaactagtattactttactatccaggatgcaacataaatactatgtctgcataaataaaatcctgctatgcaatgtaaactaaatggtgaaagaaaaatagatctacttcccatgttcaatggcacgtggccatacagaaaatgcacatgtaagaaaaaaataatccaatgtaattatgataaatgtttcatttctcactaagataaggagcaagtttttccaggggatgtttggttcaaggattttgctcagtacaaaatctgatttgggttcaactgggctgtaagcactaagcggaaaatgcggaagggacacagacacagtagacacgtgttactactcagaattgtgtataatcagaaaacaataagagctttctccgcccaggaaacacgatcccctattcccctcacatcgggaggaggcacaaaactcctaaggtgtaggtgtaggggttcgtcctcctcacgttcccctccctacacgagtaacacacgtttctcgctgattcggaatctacgggatgagatggcggcgccggccgtccggaaggccagcacatcgagcgcgacatggcacggtcaccagaatcgacgcccgcagcagagcggaggcggacggcacgtcagatttgctgctgctatggcgtcggctgtgtgctcccctcctctaccaggtcggggactgcaattgacgggtgaaaagtgatgggacaaagggatgcgtacctcaccgaagacgatgaggctgagctgggattcctccgggaaggtgagctcgccggggtgcctccgtcaaggcggattcgccggggacgctcgccgttggggaaggaggagaggatttggtgggcggttagggttcgtcgcaaattggcttggatttctcctttcccttgttttaagagttttttcttttcctctctcttgcaaatgatatgatacgaagtagtaacatatttgcagtaggacccctgtgaattgtctgtttcaactctgggcccaaattcaggggaattccaggcttccggcccggctgaaaattctctggtgggcctacgctagagaagagggcccaatttctttgagcccatctatctcgttgccaaggcccgttttgactttttaatggtagtgtctgtactctgtactcctacggttctgctccatctcttggcgacttggcctgtttagtttcagagtttcagtcgtgtgaaaaaaaataaaataaacaagcactagtcatacgcattatcacacactatacgagagaacatagaggtagttggttaggcccatcgaaatttggaagaattatggccgcaatgcctgcttaaagcatagcaattcagactttcagagcttttctgtacctcgttgtgatacaggctctataggtgagcactataagaattatttttctcaactactcgagctgaacataagaaaaaaaagaaaaataagatttgtagctactccattggaagatcaactagtctctcattggaagcaaaaataaattactcctatgaagattgattagtgtatactcatgtcatggaacatatgaccaacctttttgatcaaaaggtgcatgctctctctccgaccaaagggcggcagttgctttgagcgtgagccacatatcctcaagaacaaatactactaccgtactgcaacttttgcttggaaacatataaaaatgtttgaaaactttttgaattagacctaccgcaatagcagcggcgttgtgcgttctccttttcttcattgatcccgtgcgtcggagtatcagaaattcatagcagcagacccccattgggtgctctctgactgcccgtccgtactgtcaacgcactaagtaattggctacttttctataaaacttctgtaattgcacatgtctttttatgaaacaccattggctattttacaccatggcatgagtgtttcttctgttcaaaaccaagtcccaacgaaaggaactactgagctaagacgtgaacagatttgcaagaaacttgccagcttacacatcttacattacatgcatgatgcatcttctcttcaagccaagctacgaataaaccagtactaattccactgcatgtattagaagaagccagaagcttcagaagcttaacatatactccctgttgaaaatttggtcataattcggcatattttaatctaaaataacaagataataaacatgatatttacaatggaatttgatccagtgatagtggtgaatataatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaaaatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcagcaacagctttggaaaatggatgaaagtgtgtcttcctcttctcgcgggagatcaaatccattctcattttataagaggaatggaagatgaagagtaagagtcatggaataggaagaggaatagagcaactaattgtcatcaactagccatgaaccatcctccactacacaaccatcaaccatccatcaattagaactaattgatataagttaccaattccttaatcaaatagattaattctcaaaactcttcatcccattgatatcccataaaagaatgaattcacatgaattcctagcataatgagccttggaatttatttggtttaattgatttaaatggatcaattacccaattaaatctaacactcccttcgtattttaatgtatgacgccgttgattttttaaccaacgtttgaccattcatcttattcaattttttatgcaaatacaaaaatacttatgctatgcttaaagaacatttgatgataaatcaagtcacagtaaaataaatgataattacataaattttttgaataagacgaaaggtcaaacgtttattaaaaagtcaacgacgtcatacattaaaatacagatggagtactctgtagtatatgaatatagcactatggaacgctgtctgctgactttggtcggtggattaatagtagtgttagtattagtagactgtatatatattcagcagtagttgttcagtacacaagaactagccttgaaggcacctccagccatagagaactaaaacgatggcagtacacaagagcttgctctacctaaaccatggacttgccttgtgcttcaagtgcatcatatacaagaaaaaacgagagaaaaatggttcaacctctaatgcaatcagacacacgagttgaaaatgttcgtcagtaatgagctctgaaacattttgggctccctgtcaaatgcttctagaacaacccgaatcaccagccttttttttttctttcggagtttcagactgtcaacgtctcaccgataattcgcgtgtctgattctgtcttggtttttataatgcgcatctgattcattaatcccattgttgtagcaggttgttactgttcagagtgcttcatgatgctggattgctggatactgcatcaacatcattaagcctgtttaaacatggacaagtgtccgaataaggggagaagaaacagaaagtgttatgcttagtgcgctcatgtgacctctaatttcttgctttactgcctattgtgcttgtatggttctgattatatgatgcgtattttccatcatggtagcatgtgcaatcagttggtcggcgttaattttgttttgataatgtaaagtcccgcaaatttttccatggattcaccgcttaatatattgaattggagaaaagatggcagattcaaaattatcaccgtgtagtttacagcaagaaaaacactgaaatcagcaaacttgtgcgaaatgaaggcaaacgctcgaaacgatcagacctactcacctaaccgtaataaacaaacgaaatctgtttccgttttgacgaatagaaaacgtaaaaccgtagtgacaaagcagcccgcgcctagtagccgttgaaccgcccctgcctcatgggccccacctgccattaactttttcgttttctcgaaagagggggggggggggggggggg

SEQ ID NO: 18747 - DNA, 4694 bp, Oryza sativa
cgccgttgctcccgcgttccgccttcgtctcctccgcatcgttctcctccttttcgtccgtcgcctcgttctcctccacctcgtcgtcgttctccgacccggccgtcccgtcggatgtcgtcgaggcgttgccgatgtcgagggactcgttcaaggcgctcgccgtgctgagggaccaccagggctcggtgtcgtccctctcgctctgcggggagttcttgctcagcgcgtccaccggcgcagacatcgtcgcgtggcagcagccggatctccgccgcttcgcgaggttcgggcatggggaggggtccgtcaaggcgctcgccgccgcggggggcagggtgttctccgcgcaccaggacggccgcgtccgcgtctgcgggtgtcgcggcggtcggagaacgcgttcaagctcgtcgccgcgctgcccaccaccagggactacctgggcaagatcttccgccacgccagctacgtgcagacacgccgcaaccaccgccgcctctggatcgagcacgccgacagcatctcctgcctcgccgtgcacgacggcgtcgtctactcgggctcctgggacaagacgctcaaggtctggcgcatctccgacctcaagtgcctcgagtcgatccacgcccacgacgacgccatcaatgccgtcgccgccgacagcggcaccatttactccgcctccgccgacggccacgtcaaggcgtgggggaaaggcaaggcggcgcacttcctccagggcatcctcatctcccgggacggcgtgtcgtggaacgccctcgtggcgagcgccgacgccggggctcgccgcgtgtacgccgccgggtcggacgggcacgtcgtcgggtgggacagggtaggcggcaggggcagccgctggagcctctcctgcgacgtgaaggcgcacgacatggccgtgctctgcctgtgcgtcgccggcgaccttgtcttcacgggctccgccgacaagaccatcgggctgtggcgctggcagacgagcggcgacggcgacggcgccgccggcgccgccctcgccagggtgggcgtgatcagaggccatgagggccccgtgaaatgcatccaggcgagctggtgcagggtcagcaatggctgcatggtgtacagtggagggctcgacaagagcatccgagtttggtgggtgcccaatggctggaaggccaacgagcagaagcagcagcaagaaaatgacacgaaagatcacaagaactgcgtgttcttgaggtgaatcgtgtcaggtcaggtcaaaatgtgttcttgatttgtgttgtgtttgtagatcgtagtttggattgtttggtagcacactgccttggttgggttgatgatctactctgatggatatattggaggatatgaattaaggagtcatgaaggtattagttttagatttgggtgtaaatggctgtatacttttatacctaattcatacacattttgattaaatggaaatatcagtaataatggttatcataatctcatattgttagaaatgtgtttgattctcagtatcacggtgtgtctctgattactgattagtgtcaatacgcatctatccaaacgtaaaagctcaaaattcaagcatagcaggtcctttacactgatcctgcacatcgctcactgttttctttccgaggtacctcaacattatccttgattatctaaaaagcgttaaattccttgaattgtacttaaaaatgaaaattttaatgtcctaaaaaagtatggagatgtatagatggtcaaatgggccgcccgaagtggcacggcccaagcacggtcaggcctgagccgacacggctgggctcagcccacagaatatgaagattccggactgaagaactcatcgcacttacgatgggctccattcgatggcgagataaatactggtggtccggagaaagaactcacgaggaacacacacacccctacccgtctctgttcatctccacatcttgtcttctcgctgttgacttcgagcggagactagactagctactactcggaatggggaaggagatgaatctgatccgagaagacgagtacggcggcggcggcgtcgggttcgagccgacggaggacgagctgatgctccacttcctccgtccgcagctgcgcgggttcgcgccgcgcgtggcgggcgccgtggtggaggccgacccctgcggcgcggcgccgtgggagctcctggcgcggcacgggaggcggaaggaggggttcttcttctcggcgcgcgcgcggaggaagccctcggtgcggcggaccgtggcgggctgcggcggcggcggtggcggcggtggcgcgtggatgcacagctccaccaagaacggcaagtccgtgaccgacctcggcgtggtggtgcggtggtgcaggatcaactactgcttctacgtgcgcggcgagatgggccagcagcggagcaccgggtggatgatgcccgagtacgagatcaccgacccgcggtgctaccgccgcgccgacgacggcgaggaggacgacttctgggttctctgccatgtcaggaagagctcgaggccccaagccgccaagatctctccagccaagccagcacggcggcgcaagcccgccgccgccgccgccgcggatgtccgggctgcgtgatccggccgacggcggagatcacgaggtttgcctcgcgttgggattcgacttcggttatacttttgctttggaattgtgttcctttgctttattcctcctctagcatctgcccatacattccgtgtgatgaacactgcgaatcaaatgggacgtttaagatgttgttgttgtactgatagcgtgattgaattcatggcctctttctgccaagccgcatatggagttttttttggtgtttcagtttcaagtcgcggttggtgaatccgaaatcacgtgattaaaacagtaattatcgagcacggaaggaatggaatttttttaaaaaaaatgcagaacggagtaatttcttacagatcatcctgtttctgcttgatgcgatagctaatcgctgtcggtgctctattactgctccagctcaagctcgaacagcattccagcttgtcggccaaattggacatatctttcggcccaattggtttaatccccatctcttttagccgggccgcaagttatcccctcctcgtcacgctatctataggcccattattatctatctgtgttatgttttagaacaagctggaaatgctggttgagctcgagcagtagtagatagggatgaaaacagtccggaaagtttccgaattcccgacgtgtttttggaaacgggaagtgtcggtcagaattttttcgaaaaatttggaaacggaaacgaattccgaattccgaattttttttctcggaaacggaaacaaacatgataaggctgctattcgttggaaaccgtaatccgacggaaattttcaagaaatgaattcaaaaacagaaatgaattcgttggaaaccgtaatccggctgtgggagaacttcacggcgctgcaggaggaccccgcgctctcgccttgctacgccgaccagctgcgcctcgtgtacgaccccgtcgccggcgactaccgcaacgtgcccggcgtcgacacccgcgtcgtctccttcggctccacccgcggcttccgctccgacgatcctgctcgaaagtaagcgatatcatgtcgaatttatcgtactccactccacaaggagatgaacatgcaatgcatatagggacgtgtgcatggagaggctcgtggaggcgctggaagaggagggatacgcggagggagagaacctgttcggcgcgccgtacgacttcaggtacgcgccggccgctcccggcttgccgtccggggtgttctccgacttcacgtcgaggttaaggcgcctcgtggagcgcgcgagcgagaggaacggaggcaagccggtcatcctcgtgacgcacagcctcggcggcctcttcgccatggtgttcctcgaccggaccccgctgccgtggagaagcaggtacatcaagcacttcgtcatgctctgcctcggcgtcggcggctcgccgctgaacatgtggcccctcgccgcctcctccatcccgtcgtcgtcgtcgttggtgggcagcgtgctgacgtacgggaacaggagcttcgcgagcatgttctccctcctgccgtcgccggcggtgtacggcgacacgccactggtgatcacgcgagccaagaactactccgccgacgacatgccggagtttctctcggcggctggtttctccgacgacgaggtggcgctctaccgggcgagggcgctgccggtgaccctggatttccgggcgccgctcgtgccgctgacgtccatcaacggcgtcggtgtgccgacggtagataagctggtgttctgggacggcaacttcagcgcgaagcctcaggtggtgaacggcgacggcgatgggcagatcaacttggacaccgtgttggcattagaaaggttgatcggtgatgacccggatcagggttacttcaagtcaattttgatccccaacacgacgcacaagggtgtcatctccgatgaattagcgctcaagcgtgtggtcagcgaaattcttggagcaaattcaattaactaaggggaaactgttttaatccctcgaggggatatcccctcgttctttgcatgtcacttaaatggttata

SEQ ID NO: 18748 - DNA, 3528 bp, Oryza sativa
  unsure (1)..(3528): unsure at all n locations
gcagctttcattttattctgaaataataaataagtaatcttgcatgtcatgatgtcaatgaacttcatcttgaattaatttctagagtcaaaactcgaaacgaaatctacatgatctgaaactatctgttaggaattttgcgtgtctatcagccgtgtttatcatcaataagaacaagtataatagcaggctacaagctagctatcactgcacataaaacatgatggatggagtattagcgatattgacttttttgctgcacatgattggcattgtagcgcccgttccgtcgtggcgcctagcgggaaaactatctcttaaaaaccctatttgcgaaatttgtttcttttcttgtcgtctagtgtccgtgccatctcagatctcaaatccccgatctatcgtcgaattcaatcccgaatccaaatccttccaaatcaatccctccgcaaaagtctatttcgcctcccccgggtttgatgggccgaatctctctcggcccatctccctccctctctctctttctctctctctccgctctgggcgcgcgccgcgcgcgcgtgcgcgtgaaccgcgccgagcgtccccccctccctcggtctctctctccccgctccatccctggcgagctcctcgcccgcgaaatcggcccccgcgcgccgttgttcgcgcgcgcgcgcccgcgtggtcgccgcccgtgccgcgcctgcgccgtttgcgccgcccggccccgctgccctgccacgcagccgctcggccccgcaagccagcacgcgtgcccgagccgtgccgctcaaatcgccacgccgcccgttgcttcccgcgcgcgcgtgccgtggtggccgaccgcctggtcgccgccgccgtcagcgcctgccgcgcctgcccgcgcctgccgcccgtgtcgtcgctccgctccaaatcgccccgccgtcatcgccgtcgtcatcgactcggccccgcctctccccgcgcgtgcttccaaggaaagaaggcagggctcctcctcatcgccttctctccctcttccttttcccaaagaagcaaggaggcaagccccctttccctcttcctttcttctttttcctcccatcgccggcgtcacctcctgtcgtcgttttggccgctagccgggcgccagcccaccggcttgaccgtccaaagtcggttcccctctcccaaaccgacattgtcgcccctttaaacccaagctcctccctcctccaatcttcctcgttttcgtctctcgccgccacgccactgtcgcccctgttcgccgtcgccgatcgtcgttgcgcgtgtcggaggagccggcacgagcgaggacgtggaaggggactccgggcgcgccctccccttcctcttcctcggcccgaggccgaaacgatcacgtttcgcgccgtcggctctcgtcactgcgcccgcccgcacggtagtgcatccctccattctccctcctcgttccatctcctccctttagactcgggtagtagcacgagtagcctccccgtagctagctggcgccgccccgacctttgccgtcgctcgccgtgtgctcgccgctgtcgccgcccgaactcggaaacgcctctcgtcgccagcctccctcgatgcgtttcctcctaatccggcgcaagggacggattcccgtagccgcgtagatgctctcgccgccgggaatcggcccctcgtgacctcgtcaccgttttccccttttctctccgncggtggccgccgccacaatccgccgccgtcgagctccctccggcgaatccgagccgttggctcgtctcccctcatctcgtgcaaccacccggtgtgctcgctttcgcctgtatcgccgtgattcgctccgccgctcgccgccgccgcccgccgtccattcgcggtcggcgtcttcgtcttcctccagccggcccgcgaggcagccacgtaggtgccacgtcggtgccacctcggcacaaccgagtcggctgacccggtcagccactccctccgttccaccctccccgtgcgcgcggtccatcgcgagccgtgaggctgcgcgtgggcccgccgcacccgcatcccccgcgagccgcgcgcgtgcgccgccaaaccctagcgccacatcacgtgctccctccgcacggtgaaccgtgccaccgacaagcgggtcccacccgggaccacgcaaggtggacccgacccaccggctccctctctcctctccgcccgcgcgcgcgctttgggccgccttcttggcccggccggaccatttagctcggccgaaccgccccttcctctcggtccgcgccctagccgcccgaggaaagtctgatttccctccctccttcttttcttttctttttctttttcaaaaaggatttaaataaatcatttttcctttagaccaaaaatctaataatcttagaaattcaatatcttccaaccgtaaatccgtttgactccgttcaacttccaaaatttctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcgaggcaagccacccttgaacatcttgagcctatatttgaacttaattatgttgcttgaaaaaatattatgcattgataggatcacacttaatctgcttgtcccgtctgcaaggcagattggcggacctacctatttgttgcatttgatccttcctctgttaattgttataccatgtttccttgtaaccacctagtcgcgcctcgaaaatcgtgcactctgcacgagtatcgacggtcgccttcaaacttaaaatctgagtaacttcttgggtaaaacttgggttttacaaaagacttggaaaacccgacacctgggtcggtgcttgtgaactaaatgaatttccaaaaccgcggaccggggaacgtaccgggtgtacggtttcccgctcttgcacttaaggaccgtttccttggaatttcatccgaacataggacaagtacgaccacatgggtggaatgggacacccctggctgagtaactagcttatcaggggagccttgatgccgagagacatgtggattcgccggggtggtgtcggggaggacccccgggctttctggcacagtatggtctgggacctaacctgttgttggtctgggacccctctcgtcggcatatggtaaacctgtgtcggctttcgaaatgccttgtcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18749 - DNA, 652 bp, Oryza sativa
ggtaggtttaggtagtataaggtttagttgtttgctagtcgttgctagagttgggtagcataacgacttgatttggtatcttctttagccggtgtcaacagacagcatgacggttagaggaataggaagtttagcggtgtggaagtgttactccgacaaccgtgagtggcggcggagtggttaggatcacacagagctcaagaactaactgtgcggcgtgctgtaaaggtcgagggaatagtgagctccgaccgttgtacgcatcgaggcgtggagtgtcgagagcagcacttcgaccttgggtttgggttttgccgggctttacaaccaacggttcaacgtcggggatagtaaaccgcgaacgtccccatggaaggcgtaaagattcaaccggcggctttttagtggcttaaggggtagtttgggataaaagaaaatatttgaaagacaaatataaattcaaaaaaaccggggggtatttgaataaattcaaataaaatagcaaattgcgtttcaaaatgaagcatttgaaattagatgaatttatgtccaagttttactggaatcggatctactggttaggagatatgggcttctaaagaatatgatttgaaataaatctaaaaatgtgaaaatgcactgtgtataggcc

SEQ ID NO: 18750 - DNA, 1002 bp, Oryza sativa
gccgcagcaggagtcgcacttcgtcaccaagtccgcgttcctgaacgcctccgcgctgccggcctcgctcgccgcgaggctctacgacggcgagaccgaccaggtggtggtgcaggccgtggcgtcgctcagcttcaccatcggcggcgcgcgcggcgtgagcgccggcaagcgcggccacaacttcaccttgatccactgctggccggtgtccatctccagctactacgaggtgtccggcggcaaggcgtcgtgcagccaggacaccaccgaggcggcggtcgccggcctgacccacgaccgctacatcggcggcccttgcccggagacgtacaagaactccggtaagtgctccaggaatagcaccggcatcaaggggtgatcagctaagttcatttcgcggggtgtaatttgatttccaaatgctactgtaattaactaatttattacaaattgaagaaataattgtattgaaattgtgcttaaacaatgacaaagtggaaactaaaggctttttgatttgttgccacatttaacccgataacatgtattgtacacatcttttgttttagtgaggctatgcctcctgcgttgtaaactttgtgtttgggatgtccccaaaacaacaccttccccacccccccccccccgggcgcgcgctttcaatataagccgggccgctagtctttttctaaaaaaaaaaaaacatgtattgtacccacaagttttgagtgcactctcagttaccacacacaccagctaacaaataaaaaaaaaatctagacatacttacaaatacgtgtacacgtactacaactatgcataaagtgtcaacttcaagtttaactaaacataaattgatcactaccaaaatatgccaattcaaaaatttccgctcttgccaataaattaggcgtacctattataaactaaatatttatatacatatgttacgtaacaaatcaacgaggaaacccatccaccatgatcctatatattttg

SEQ ID NO: 18751 - DNA, 6203 bp, Oryza sativa
  unsure (1)..(6203): unsure at all n locations
nnnnnnnnnnnnnnnnnnnnnnnnnnnnnnnnnnnnnnnnnnnnnnnnnnnnnnnnaaaaagtattttaataaatccttttcctttatttcaataaatccttcaatcttagaaattccatatcttcccaaccgtacatccgtttgactccgttcaacttccaaaatttctcaaatcccgagttctatctaatggcacacttagaggtcaataatagggccttattttcaccgtttgttgagtcgtctcgttcgcgtatagcttcggagcccgaagacccgcagtgcgaggatttcgatgatcaagctcaagatctcgagcaaggcaagtcacctttgatcatcttgcacctataatttaaatctaagtatttcttttccgcaaatattgcatgattaggattaacacgagtaattcggctacggcttgcaaggtagcctgccccccccaatcctaattgttgcaatcaccctccttaatgatcgaatacttaaaactcctttgtcaaatgtggtacttcgatgtacgggccttcgggcatgcacatcggaggcctcccctcaaatttaaaatatccaacgatgggtaaaacttgggttttacaaaagacttggaaaacccgacgcctgggtcggtgcttgcgaactaaatgaatttccaaaatcgcagaccgagggacatgccaggagcacggtttcccgctcttgcacttaaggaccgtttcttttggaatttcatccgaacatataacaagtacgaccatgggtggaatgggacacccctggctgagtaattagctaatcaggggagccttgatgtcgagagacatgtggatttgctggggtggtgtcggggaggacccctgggcttcctggcacaggatggtctgggacctaacctgttgttggtctgggacccctctcgtcggcatatggtaaacctgtgtcggctctcgaaatgccttgtcatgaaagcctcaaggtcaccagacgtggctgttctgcacgggctgggtgatccgggttagtaatgtcgtgtgggtaaagtgtgccccctctgcaaaggttattaaactattcgaacagccgtgcccgcggttatgggcggatgtaaggtgattccttagcgtagttttgtttgactactgctttgtgaaattgctgttgtggaatgggttcgttgtttggaactctgccgctggtgggatcagccaggcctgggtggccgtttgaaagctgttggccgggtgccaaccttgagaaaatcaaagactgatacattgcacatactccgaccggacgagacacactgtctcatccgtgttgtttgagaagcactcacctagttgtttcagaaaggagtttaactaaaatcaattgcaaaaacaacagcctctcccttgaagcctgcattaaacacttaattcccatgacttgctgagtactcctgtactcacccttgctctatataaataatcccccccagttgccgaagaagatgaagtggatcccgcggatgaggagttcttccaggagcaagtcggcttcgatgagttttagggtttcgatctagttcccaagtcgcgcctgtgatgattggtccaagtcctggcttccgctttcctcttttgtagtgcagttgtgagctcggggtctgtccacagcccaacatgactgtaatcctactctataataaagagacctctgtggctgtgatattctgtcttcctgtgataccagcactgtttcctgggactggtatcgattaacaggttaatttggagcgtcacgggctggttccgctcggggctagctcgggcgtgacacatagccatccaaccgaaattgaatacggaggaatacccaaaccagaatatcaacttagcagagcaagcagctagggttacatcatgtacttgggctgcgctgcctccttgcctccttgggttgggctggctgggctggatagctataaggtctgaggtatagcttggatatccgaaggaaaatagtggatagtttccgaccgaattccgattccaacggatatcacctctacagtattcgttttcatttctgaaaaaaataatccgaattcgtttccgaattcaaaaatttccagatattttcgaccgaaattatctgaatccgaaaattggtccgttcggacgaaaattatccgaatcactttcaaccctatgtaccagtagtctttggtttttgttttttagcgtatgttagtaggcgcactcttgaatgtttagtgtggtgtgcgctgcatgtgtaaatcttacatctctactacttaaaaaatttaacatgttttcatcgtccgttaaaataaaaaaaaagcgaaaaaacaacctaaaaaatccgattccctagcaaaaaatagaatcgattcccacctaaaacgggaaaaaacagaaaaaaaaagtccgatacctggcaaaaaaaaagaaacgtagattcagaaaaaaaatccgattcccacctaaaacagaataaaaaaaagtccgtttccttgaaaaaaacaaaaaaagaaacgtagatccgattcccacaatgaaaaaaaagtccgattcctatagagcgaaaaacaaaaacaaaatccgtaaaaaaataaaaaaaaccaaaaaaaatctagaaagatctgactctataagaaagtggcgaaaaaaaccgttcataaaaaaaacgcacgagaaaaaaaaaataaaaagggcagaaaaaagcgcggcaaaaaaagtctaatttctatttgttgttttagtagtccgtacatatctcttctctatctctaatctaatctaatctacctatttaaaatgagaaatttccatcgtatattaaaaagaaaaaatgcacgggaaaataaaaacggtttaaaaaaacgcgcgaggaaaaaatatcaaaaaaagcgcaaaagaaaacgcgctggaaaaaaaggtttccgtagtccgtataaaaatcatgcgagaaaaaatatttctattgttatttagagaagagtgcatagtgactctattttgtatagacttgaacatgcgaggcggtgtaggatttgattggttgcaagaatgagattaaaagaatattttagattatatgcatgttgtcatatgaataatccaattattttaggtaaagcaaacatcggtaaggttgtcatcattgaggttgggccattaagatgttccaattttctgattttctgattgtcatcgatatggttatgcatgaaagccgtatattatcattatgtttttttcacccgttgcaatgcacgggcttgtttgctagtataataaaaaaatacgttacagaagaaaaagagttgtatattaaatatcatcattcttttaatatctgttatatacataatataattacgtatgtgagttaggaatctaagagttaattgtatagcaagtccggtactattagataaagataggatggaatggagttagaataaaaatataaagaatgcaattgttaaagtagtgggtagctcacgtttcttggagaggagaatatatatttaaagagcttaactagccaggtttccgagttgccgacggacatcatatcatcgttgttttgctagctcatacagtatcttcaacacgtgaaagctaccagcttttttggtttcaatctttggtatttattccttaatctcttttttcttttattttatttccttttcttttttttttcttttcttttccaaagattggtcggaatttattccttaatctctttttccttttattttatttccttttcctttttttttcttttattttccaaagattggtcgtcggaatcctattcatgtcctccttattagctgggtgaacgtgcgcgacgttatatatgtgcgtctcttttttgctttactacttctgttcatcattattaaagtgaacgagtttcacatgcaggggccgttgtatacgcacctagattgtataaaaaagaatgaagcaacctttctttaatttgcagcgcatgcatagttatattctttttaacttaatagaagaatgcgcgtatgctttccaatctactaaacgattttaaaaaaacaaaactattatatatataaattttaatttcttagaatatgtaccccaacgacttttaacattataacagttaagtagtcatttctaccttcaaataattatcacaagttcacaaccacaaccacacgctatgttcgttcccacttgttgggaaccctaccctcccacacggaaaacggcgcagtccattagcgcgtgattaattaactattagctaatttttttaaaaaaatggatcaatatgaattttttaaacaactttcgtatagaaactttttgtaaaaatgcaccgtttaaccgtttgaaaaacgtgcgcgcggaaaataagggagagaagttgggaaccttgaccttagaacgcagccaatatacgttggttttggatcctttttaatttgtcaggcatggaaaatagggtgttttattagcgcatgattaattaagtattactccatccatttcataatataaggcacaactactttttaaacttatttcataatataagacgtgtatgcatgcatgtcattaactagcacatcttttccactaaaatgttactatttaaatcctccaccatcaacatctctaattttactgggtgcatgcattttatttattagggtaatccaaactatgaggtgataacaattatttcttggtctttgagttaagggtggttgtgacttatatttcggaatggatggagtagctataaaaaacataaaaaaatgatatgatttttcacagaaattttctaatagatttttttttcaaaaatacatcatttagcaatttaggaatcgtgctcataaaaaggatgaagtagaagatggaaacttggactgtcgtgataaagtttataaaaaaatgtacatgcatgtgtaatatcaaattaaaatccaccataaattttgtattcatagtgcatttatttgttttattatatcacaatttataactaagagcaaactgggcgtagcttagctagtaaggtaccttgtggtataatatgctcatccaggttcaagtttcagattttacgtaatactcgtatttacggctagttatttttcgagtggtagctgacatacctgttgatattgtgtcgtccgtagtgacttcgtcaatttcaaaatacgccggactagtctctggaagtgtttgtaaagtagagcgtgcatgtgtgcgttcttaaggtactagtcttcggaggtgatcataaaagtagagtgtgcatgtgtgcgttcataagataaccattcattttatattataagtcgttttaacttttttctagtttgaccatgtttataggaaaattttgcaacatgtacaacaacaaactagtttcattaaaactaatatttaatatattttgatagtatatttgttttgtgttgaaatattgctatatgttttttttataaacttggtcaaacttaaaaaaaagtttaactagaaaaaaaatcaaaacattataatataaaacggatgcaatcgtagggataggaagcacatgtgtgctctcatatgggtgattgtgcacagatgtgtaagagtgtatgtgtttctaatgtgattaaataaaaatctataactaatgtgttttagtttttcttctgcgtgaaatttctgactttttaaagaagtttatagaaaaagtgcataaacatttatgaaaacaagctagttttattaaaatccaccgtattgagaatatatttattctcgttacatttatttttcataaacttgaaaagcaggtcaaattaagctgaagaatttttagattaggagccatggaacggaggaagtagtcgagatgcactactagtataatactcctatataaggcaagctagtagctggaatgaattgaattgaatgaagtaataaacggaagggagggatcgagatgagcaattattactgcaactcatcctcaatcggaacaagcagcgtcgccggcaacttcacctatgccgacgcgagcagcgagggcagcatggtgaccggctccgtgctcatgttcgtcctcgccggatcttcttcatcctcaacttcttcggcggcctctccaacgtgggcgccatactcagcccgggtgt

SEQ ID NO: 18752 - DNA, 7195 bp, Oryza sativa
  unsure (1)..(7195): unsure at all n locations
catgatgtccacctcgccgtcgctgccggtccaaggcgacgccatgctaaagggttgcaggtacatcgtgacgggagaggaagatgcgcgtgttgaaaccaccgccgacggctacaagttgaaggaggacagcaagtcgtccctcgtcaccgtcggcaaaatctgggtggagcaagggctacctggaacgggaaataatggtggcgacgagaaggcggagctcaagaggctgtgcctctctttcgcgctatccaaactgctgcgacggaggctggagcagctgccggtgccggagccggagatgagcagcgcggagaccagcgagtgccgcgacgtcatcttcaacgggctctacaagagcggcgacgcggtggcggtgttcgaggtgatgaacagcgagatcaacttcctgagcgagtactaccactccgtcgtcccgtcgtcctggccttcccattcttcttcgtcgncaactacttcctccttcccgtcgtcgtcctgtgcgtctgcgtcatgaccatcatcctctgcgccggcggcgacgtgctgtacgcgttccggagcatcaagacggacaacttcaccatctcctcgggcatattcgacaccaccatgtgcctcctcctgaccgcgcatcactcggccgccgcttttttcgccaccatcaacttcgccgtcaccttcctcctctacatcatctacatctacgaggaggtgtgggagttgttcgtcttcctcctctccaactggttcgcggtctcgctgctctccgcctacgtcgccaagacccgcttctgcgacaactccgccttccgtgctttcgcccgctgcatcctctccgtccggacatggctgggcttccatctccatccccaagatatgatcaaccaattctccgcgctcgacctccgttggccgccgctcaccctcgccatgcccatccctctcatcaccttgctcgtctccaccaagcccgtccccgtccccgtcccagtcaagcactccatcctcctcagctccctcgcctccgcctccgcctccgcctccaccaagtctgctctagcgagcttcgacgagctcaagacggcgtgcgagaacggcagcatcgcggaggtgatcctcatatgccacatcgccaccggtctcctggaacgcctcaatcctccgcctgatccggaggtgatgatcaccgagtccgacagcaagcggatgagctgctgcggctgtccgaacaagaagaagaagaacactagtagtgacaatttcaccgtcgcgacgacgctgtccagatactgcgcgtacctggtggcgttccaaccggagctccttccggactaccatgagaaggcggaggatctgttcaaggccatgaaaatggagctcaaagacaggctcggatgttaccactactacttctcgtgcgggcgtgagcgagccgacgccatcatcaacaacatcaacagcaagaataacaacaaggagggaaccgtggacaagggcgcagagttggccaacaagttgctagaaaaatacacgaatgatcatgattcgatgtggacgcttctggcggaggtgtggacggagatcatcgtgtacgtggctccgtccaacgaggagcgtactatcatggcgcacaagaatgtgctatggcagggaggcgagttcatcaccgtgctttgggctctcatgactcacaccggcattacccgacaccgccgcctccgcgaaatcgctctcaaaatttcccaagacgacgccagcacgtcgtcgtcccaacaaaaatccgcaccggaccggatcgataagcagcacgaaatcgatatccatcgtcactagctaatgtgtgtaaatttgcttgcttgcttgatcgattgattgcttttggatgcgtgaatgtgtgtttgtttggcctgcagctttctcttctttaatgttattttccccttctctttctttctttcttttattcatttgttgtgaaaatgtctctactactgtaagtgcatgagtatgtgtggttatagagtctgctatactaccgatcttcatgaattaataattccatgcatttttattctgtccattggtcggaaaatgtttgtaacgctgaatatgtaccatacttacgttaccgaggtgtggctaagttttcactgaggtggaaggggaaattcttcaaagttgttggcgcaagatgacggtgagagacattatgacttcatgacgaggcagatatatagactggttgcagaaaggtgggagactattttcatctctagagaggatgtcgcctcgattatttacatgtcacttaaataattatgaaaaaattgagaagatgtattaacatgagatcatatatcactctataaatatgcaagttcaaattcaacatctatatctcgtaacgaaaaaaacaaagtaaacaacagctagttaacgcatatttacagtcaaatttgttttttcgttacgagatgtgaagttgaatttgaaattgcatgtttgtggagtgatatatcacatattaatacatattcttaatttttttaaaaaatttcataactatttaagtggtaagcaataatgaggggacatcccctcgagtgatcaaaatccactcccataaaggtggctcggttgcgtcaaatatggcctactgggcaaagcgcccgcgggatgaatcaggaaggcaactcaagatggagagcaatcaaaggataaggagttatgactcggtagacgaaaggaaaggagcataggggaaggaggggttgggcttcttggggagaaagaaggggataaattaacggcctagatgaatagtgacacttcggaattttcatgatttatttgagagggatggtttgaatacctaaatggcatttgaattaaaaattcatatttaggcacgggaaaagaaaggagtagtcaaagatgagaaccaaatttccattggttcaggccttcagggtagtacaaaagttccttcgccagttcgtgctttgacaccttataatgcgccgagcagctgatagaatgtgaatctcgtttatatttctccgacaaacgttggggctctttcctttggtagtaattgtcattgatcagtcatttcaactttatatgggaagtggatttttatccctcgatgagatatcctctcattctatatatggcgttcaaaatgttatcaaaattttttttaaaaaaatgttaaaatagatcaatatataatatatcttttcgcaaatatgcgagttaaaattcaacttatacaattcaaaaaaataacaaatttgactgtgaattacgcgttctattcattgtcaaatttgttatttttgtttctacttgtataagttgaatttgaatttgcatgtttgtgaagtgatatatcacatattgatatatcctactaattttttttcaaattttttatgacattttaagtaacatgcaaaaataggggatatcccctaggatgaattgtgttttccctttatatgtatcatgtgcgatgttgatgccattacactattcaccattgagacgttatttggtttggaggggattgaagagaattgaagggaaataattctccaccataatagatgtagaataaatcctctccaatctttttttcattgggattaaccgaacaaggcctgtatggtacgtaattcattcaagcatcttattaaatgtttgatctccgatccgtccgtagggggaagaacttattctgctcatcacacggatggatataatgcatggattatatatgcctgtgtggatcgtcactgctgatcgaattgacattcaccctcactagctaatgcaatctgctaatcactagtttctgcagctgcaagaacctattctgctccgacccggcgaaaaaaaaagagaacctattctgctcacatgtcgcagctgagatacaaaaattgctcattaagctgtctcatgcattgtcctactagaaaattttagttatacgaacagctaataataagtttattcgaatataattcctactgacatgcatattagcgttcctgctgccgatcagaattcagaaataatgcaattgcctaactttattcgatcgaatccatgcaactgaactgatggaggctgtgatcagctgctggttcaatggcgccttttaattctagttgcatgcaacgtcgcttgcacattaggtagctagctagcaagaactagctgtgtcaagatgggcgccatgaccaagatccgtggtcatctaagccggtgtctcctcggagccctagttggcgccatctcagccaccgccctagtcatagccgcatcattagtcctccgtcagccgccgctcgccttttccgtcgccgacgcgaggagcggcgccaccgacgagaacaaggcggcgttcctcaacctgaccctggtggccggcaacccgagcgggcgcgccgccgtggagtacgaggcgctggacgtcatgctctggtacggcaccaccgactacatcgagaccaacaccagcctcctcctcgtcggcctcgccgccgccgacgaggcggcgctgctcctgcagccgccgcgcaacgcgacggccgtggaggtgacggcgcggacgctggacgacaggtttgtgcaggagatcgtcgccggcgaagggaggagaaccgggccgttcaacgtagcggtggcggctcaggtgcggttcaaggtcgccggcgtcgtgtacaccaggccgtacaacgtcagggtgtcctgcagcgacgtctacttcgtcgtcgccgacaacaagagcgccgccgccgccgcttcgtctacgcccattgattgccatggctgatttcatgtgtttgtgttgtaaatgcgtgtgcatatggtttgattttgggttgtgtgattggtgtattgcgaggtctggtctgaaccgtttgtgacgctacctcatattttgcaaatatgattgaaattttaatatgtataacatcaataacatgtttggtgtaatgcatgggttgatcgatgatgtgtaatgtctacatttgtacgaattgtagtgtgactagtaactccattccatgggtacaaatgtaaatcaattccattaaaacacacgcatttatatgtacgtatcatcaacatataacatgggaaaactcatttcatcccttagagtatcctctcatttttctaggttattaaatagtcactatttgttttttttttaaaaatagaatgatagatatatttcattacacaaacatgcaaattcaaattcaacctacaatacaagtacaaaaaactgtgaataatgtgtataagttaaatttaaatttatatgtttgttgagcatatatcaaatattggcttatcttgtttttttttcaaacattttgatggcttttcggaacatacacaacatgatctttacatgaaaaaaaacacagtaacacacatcatgtatgtatgtatatatcacatgcatcaacacacagatatatgatgttacaccaatccattgggatgcaaattaatcataatgaagtgattaacaatcaatcaatccaaaaattagccaatccatgcatgcaaaccaatctttactgtaccactccaaccatcagtatcctcaatcaccatccgatcgatgccgcgatcacaccgacgcggcggcggggcgggcaatgccggtgtgcgtgacgagcgcccagagcacggtgacgaactcgccgcgcgcgccagcgcctcgccgtgcgccctcacctgctcggcgtccctcgccggcgccacgtacacgacgatctccgtccacacgtcggccaccagcttccacaccgccgcctcgtcgccgccggccgcctcgtccatcagcgccttccccagcctcgcccccttgcgcaccaccgtcgtctcctccgccgccgcctcgtcgtcttcttgaccgccggcgatagccatcatcttcccgtaccgggtggcgtccgtcgagaagtagtagcccttgagacccagctcccgcttgagctccgtggtcatggtgccgtacacccgcgccgtgcagtcgacgtcgtcggggagcatctcccggcggaacgccaccaggtaggcgcagtagcgggacagccgcgtcgccaccgtgcttgacctcgccgccgccgccgcctcctcctccgcgtgcggcgggcacctcacctccaggaggctggtggcgatgtgccatgtgagtataacctcggcgacgctgccgctctcgcacgccgacgagatcagccgggacgcgttgcacagggtgttcctcgccgccaccgccgacctgccggcgctgagcggggcgacggcgccgtcgtacgccgcgaggtactccacgatggattgcttcgcctcctccggcacggccgccgccggcagcttcagcgggagcctgcagaaccagagcacggagtactgcttgacacggaggtaattgcggcggctcatcctgttcgtcacccactgtacgccgcggatggcggagcggcggagccggctcggcggcttgacggcgtagtcgcagaccatggagtcggtgagccagttggagaggaggaagacggcgagctcccacgcctcctcgtagaggatggtgaggaagaggaggaacgtgatggagaggtcaatggaggagaagagcgccgacggcgaccggaatactctgctcaggaggcacctcgtcatcctcagcaagccgaacgacacggcgtagttgtccctcttgatgctgccggcgatgaaggcgatgtcgccgttgccgcagagcacgacggtcatgaggcagaggccgagcacgaggacggggaagacgatgtagttgacgaggaggaagaaggggctcgccagcatcacggggaggacggagtggtagtactcggtcacgaacccgagctcgtcgtcgaacacctggaacagcgtcgccgccctgtcggcggcggcgccgccgtcgttgcacaggcctctgaagatgagctcacggcagtcggtggtctgcgcggcggtcaacggcgtctcctcgaactcgcggcgaagcagcttgaagagagcgtacgagaggcagagccgcttcagcttcgggttggacaccagcagctggtcactctcggcgagcgaccacaccctgcccacggtgacgacgacggcgtcgtcggcgttgtca

SEQ ID NO: 18753 - DNA, 1200 bp, Oryza sativa
agtttgctttattcgatttttgtatggtgatcaggcccaggtgaacaaattcctgggctggattgggctggatttttgaaggattctgctgcagctgtgctctggctggcactgggccttgtagatgcctttaagcccaggcctcagtacacgtgcttccaaaatgtatgccacggacctctctttgagcgtgttttagggacgtatttgcagatttgtgagtattttttagtgggtgtatgcctaccgtataatcgtataaaaaagaccttcaggatacgctcaagtcgtactacactcaatgctgctttgtattctctggaacatttggaaatgccgcaacaaagttgttcaacgacgtggatgagcccggtagcgtgtaggttttcttttctcaaactctacctctgtgatcttttccgtaaccatactgtaatacgggttttgcaaaaatcttcttcctcaactagaatgaacattccgggcccggttttctcctagtcagtccaatgttttttttgtctcccccctgtaaccccatgaccacgtcaacgggtcgcggttgtgtagaagtcttttttttatactaatatattgacaagcaagactcttacgttttaaaaaaaaaacaaaacaaaatgaacatggtgacacgcatataaagtgacaaagaaacatgatccttttttacttcgggaattatggcgggctatgcttcagcctgaaccttatgcgtgtcagcatgttcattctggttctgaaagaagatttttgcacagtttacttttagagtaattttatactccttgagaaaataccatgaggggccactttttctattgtaattttggtatctcttagtatttaattactataacgtactaaattttacactaaatttttgatacttcgtggtacctcctaaggactttaaaattgctcttacttttaaaattaacatgcgcaagatatatacatgatttccagtacagaattgaaacttgaaagttaaaaatgagagcatattctttagagatcggctagaagtgcgtaagccaatttcgaaggcgtattttccacgtgtttcgaattgcagaggtgcgcggagatggagcatcagccttaattcggaaaggaaatgaagactgagctggtgatcccctccatttggaaacatatcatatcattatcactacacta

SEQ ID NO: 18754 - DNA, 20514 bp, Oryza sativa
tgtggacggtggcgacgtcggcggatgcgggttgctagcgaggtggctgggcgttcggcagcaacggctgcggtggcggtgaccgtgtctgcggtcaccggaggcatggcggactcggatggctagccgagggcgtggcagacggctgcttttggccggcgtggtgtcgtttggtggaggggtcggagaccggcttggcgcagagaggcgcagccgatggcagtggaggccggctcggcgcgagaggcgcgggcggcggagatgaaggccggcttggcgcgagaggcgcggccgatggagggaggctggaatggcgcgagaggcgcatccggtggaggaggccggtttggcgtgagtggcgcggccggcggtggaggaggcgacctaggtgtgaggaggagctgccagtgggagtggcgcggtcttcggcgcacgaaggctggccggcgggggacgccggtgcaggggttccacatgtcggcagagcttgtgtggtggtggagcatcggtgtatcagccgtggtttcacaagtggtgagcggcgggtgaaaacctagtctggcctcggccggaccgacaacgattctgagggagttgtcgtgctgtctaacccctcaagggtggtagccgggcgaaaacccagtcttggctcctttaagcttcgacggatgtcggcgacggttttctgtcgcttctcttcttgaagacgtcgttttggcatcccctaggagggcgatctcgtctgtgtccctttgttggtctagtggcggtcggtcacgcttagcggcggccgttccggtgctagccttctcctgggttggtgtgttggcgatgtcgatgtgtgggtggtggttttttttttcctttttcctggttacgaccctccagggttgtaattttgtaattttttcctgctctatcaatattacctcgcaccgtctcgtgcgagttgttcaaaaaaaaaagaaggagatcccataaatacgatacctgctacatacccccaaccctcccatgcatcggaatatctcacctcctcacccaactcgccccaatcgatcaaccgtagcagccatggccgccaacttcggaggagagtttccggtggacggccaacccggcgagccctgccaaccaggagagctggtcgcagcggctgtggtggccgcaacgaccgtggaggcgccggcggatgtagaggtattggtgggtgcctcggcgtccgccacggccaccgcggccgccacacggtgacgccctcagaccaggcggcgtcggtgggtacggtggcgaagtagtgtatgtcggtgcagaagtgtacttccacggcgtacgcataccacatgctggtgacggcggccccgatggtattagcggccagggtggccccggagccagctgcttaaacctatggggtcaagctgtaaaattcttaagttttttattgttgcaacacaaatatcaatagtttttgagctattttgcaaaaacctgtgatgtcagctgaccccacagattatacgtagctccgccattgcctgaaggggacggtggcccccatggtatcggtggctgcggcagggacagtggccgtggcaggggcgacggtggccatggcaggaaaggccaccgtagtggccatggcagggacaatgcggaaagcagagaaggaggccgcggaggggacggcggagaaggcgggacacaatatatagagtaaattaccaactttacctgatgagcaaattaagcatttatattttaaagcaatacaacaccaagtaaagagttgcaaaatctcctctcaagatgatcaacaaggtccttaaggtaaggtattttctgttgagaaattttaccatccttaaggtaaggaaaataccaaatacaagccgtagatactagaatcaaacggttgagaggtaccgcctccaacgcgtcaaccaggtactccgcatggatgagttaattgaggggtaaaattgtattttttgcgttgaatctcctttgacaagtctactccgctcgtagttagcggcgccgcctgggcagcccattcccttcctcttcgcacctcaccacgccgagatctggttgagggcggcggctgggaggcctcctcgagtttgcaagcggccaggcaacaagagcgacgaggagatggccacagtgacgagctgagcatggcagatgcagcagtggccggaccagctcaacttccctccgcctgctccgctcctcccgctgctggttcagtaccgagctgatccccgccgccctcaatctctggctgatctcttccgtggcggacaccttgaattgttcttttttccgccggcccttcttgctgctacgatttgtgttgtggggtttgctgaattaaacgtaaatggttgtatgctaccagctacaagctgaattggcagcttggtattgatgaactaaaaacaaggtaaaaaattgaggaattttacgatacttgagaaaataccttaccttaaggttatctagaggtaccaaattttatactagaaaatatgatacatctagataccttctcaaggatggtaaaattacccaaaaattttggtctaatgtaaataatatcgtttcatgagagtttcgttctttgaattaggcattatttcctttcaccctcctcccaattcctccccttttcagatcaaagcattaaactcaaattgtgtgccgtcatgtgagttccccttgcaaggcatcctacaccttgatcaatctaatctcacatgtaggaaagaaactctatatgaaagttgttctaaaatatcagattaatctattttttaagtttgtaataattaaaagtcaattaatcactctatactcgttcttgcgttgccataacgcacctgtaggtacctgggtagcctcctatccgctcatcccgttcccacgtctgccgcaaggaacagagaaagataccgagcatcgctatttttactcttggcccattgtgtatctagcaaatcaacggttaaatttgaatggtatatgttggtaccttcttaagaatgataaaaattcacttttctacaatataaacatttttgagagaaacaggggaagaaataagacaatgtcgtatttctgtttctatggctgaaacaagcagcacagcatcagggcaatctatttcttctgtatgttctttctatggcagtaatgcgaggagataaaagttaattcagaaatcagaactaattataagattacaacttgttcaaacaaaaaaaaaacttttccaatcagtacaggtccaagcatggatagatggctcagtgcatgcgcaatgcaatctcaagtggaagttcagcttatcagaaataaaatgtactccagaaagccagaaattaattaaattcatatgtccaaaaactatttgcccacaccttgttgagattaattaggaagcgcatacaaatcgggtagaatgaaacacaatcaaatcacattataaaatattttgctataacgtataaaacaacggttttgaatatattgaaacatgaaacaaatccgaatacatcgaggaaaagaatgaaacaccatcaaattaaaaatatttcagtgctgaaaattgtgaaacacaatcaaatcacacaatgaaacatttttctacaacgtataaaacaacggttccgaatgtaccgaaacatgaaacaaatccaagtacatccaaaaaaagatgaaacaccatcgaaaaacccactgcaacgtttcaaatttaactgataaaacatcacggtacatggattgaaacataacaaattcaagaggaaaacctagatctacctcttccaccactcttatggttagcaaccacatctgcgtccatgccatgctgagctccaccacatccatatagccgccgtcgtcgacgccgcggagcttcgtcagaccgtcgccgacgtcggtggcaggggcgtcgcgctgcgagggtggctgtggcctctgccacggtggccgcttgctcggggaggtggcggcattcggcggcgtcgccgtcgcagaggaggagcaattggcggcggctgccggcttggggaggtggcggcgttcggcggcgtcgccggaggaggcacgggggccggccacagggtgctgtcgcatctcctcaaggcgatgctgctcgccatgctcaagcggttcgagcactgcgacgagagaaacgagagatagaagagagagcgagagaaacgagagagagtcacggaaatgggtgggggtagttggaagagcgcccgatattttcctaatccgtcgggcactcgaccgataggatttttggattaattatgacatgtacagagccttatggtaaaacagttggctgaaaggttgaagtatttgaccctttaaatggcattgatttcctgtaaatcgataattaagctaaataacaaaaagaaactcctttgaaagtacaactacaattagacagagatcaagtggtttatctctataccaaactacaaatatgtatgatccaacatgtactagtgagtggttgctttaatttaatttataagtacttgcctagctaccaccatacaggcgaggccagagtgtgttttaaataacatatactccctccatttcataatgtaagactttctaacattgtccacattcatatagatattaatgagtctaggcagacatatatgtttagatttattaacatctatatgaatatggacaatgctagaataatttacattatgaaacggaggaagtacatacaagattaaatttgctcagttcactccttgcctgttgtctgctgataattccatacacaaaagtaaacagttcactacttggtttcgacgtgatctaaatatatatactgcaaataattttttttcgaacggtcaggccattgctgacgttttatattaagaagaaggtattccattttaaaaagaaaacatgactaaaccttatagtgcctagttaatcagagaaaattgagcgaaaaccacaactacaacaccacaccaattatactgcaaataataaagagatagcaacccgtgactttctattggcctatggtacctgcagtacctagctttaaattcttttcaactgaactatttggataattaaaaatattgtacctgtccgccacggagattttgccatcgccgtgctggtcgaacgccgcaaacaaagtacattgtcacgctcgaacttgctcgcccctttctaaattcattttagtggtgattgtgctttatatattaggacggaggaagtagtaaattcacgagagaacatgacaaccatcccttactcatgattcatcctctttcatactgtttatatttaatttaacgtataaaaatgtaggatactaattaagaaagaacttattatcatattcttgactgctcagttatgtggttatgggggtgatggtttgagtttttttcatattcccctcccagctggacaaaggattaggcatgaccctagggcggccttggttaaaatatctaatggtcagatgacagttaaggctgttgtatctgaattggagaggttaattcctggtaaatggaggtgggtggtacatgacaatggtgataacacttttcgtactatctttccttctgctgctgagctgaatcgcatggtggaatggggaaaggtgcacactaaagttggtgaggctgagatggagatcatataaagaggtgttgggaatgaggtgaaatatgtcattccaaaagtttgggttcagtgtaaggggcttccttctgagttgagggaatatttaattatttgtgcagttggttctattcttgggattactaaagttattgatatgttatttactagaaggtatgagatagctcgtttacaagttttggtccttgacccatctctaatccctgatgttgttgatgtggccattggtgatcatttgtattagctgtcttttaaagtggagtcagatattggtgctggggatcctgttcctttggatatggataattttggggatggtgatgggaagagaaatgacgatggggaaaatgagaaggacatgggaaataagtctggaccgggtgtctctgatgtgagtatggctactgatagtaatcttactgagaggggtggtccttcttttacctcttctcagttgagtttgataccgtagtcagaaggtttgactgcgtctgacgaagattttgacgggttggatgaggagaccgtgttggttgagcaagaaaatctggttgaaaaaatctctgctattcccgaggcgttaatttctccatccaggaaaagccagaggagagcttctgacagtgatcagcttgtccttgaaagagctgaaaggttgaaggcggaaaagaacttggagaaaccccatgctaaaggtaatatggatgttaatgtttcttttttacaatttacaaatgatcaaatttctgcttcccttaataatctaggtgtgattacttcaaataaaaatgttattctcaataatgttatagaagatttaaagtgtgtagagaaaaataggttgagtgaatagattagttcctctgttaaccaaattcctgatgtaattgttgaaggtgagttagacgatcagttcgatgataatactctactacaacatttatgtggtgaaattatggaggaggtgatggatttaagtgggaatagtggtaatattcagtccactttggattccatggtaccttcttctaatagtatttctaatggtaagaagggtaaaaagaagaagaagaataataaaattagttttaaatgaaaggaatcttttggaattgtgatgggttcaaggacccgaaaaaacataagtttgtttctgatttaactaaagaacatcaacttgattttattgctttatctgagactgttaagaaagaattttctacagctgctcttaataatctttgtgctggtaaagattttttgtggcattgtaaacctcctagaggcagatctagtggtcttctgttgggtattaatttattaaattctgacattggtttgattgatgagggggatttttacattaagtttcatttgcgaaataaagctgataattttaagtgggccttagtgttggtgtatggacctgcacaaaatgagtttaaggaccaattccttgcataattagttaacatgtgcagtcatgagaccttaccaattcttattggtggtgattttaacattattcgtagtcctaatgaaaaaaataatgataattatgatgatagatggcccttcttgtttaatgctattattgatgagttgtgccttagggagatacaaatgactggtaggaattttacttgggcaaataatttggcacacccaacctatgagaaactggatagagttttagtgtccacggaatgggagcaaaaataccctttatcctctgttgttgctctcgatagagatatttcagaccatactcctttgctcctaaatacaaaatcttcctcttttagtaacgctcaacatagttttaagtttgaacttggttggctgttacgtgatggatttgttgatatggtaaaagaagtttggtctggggttgatgagggcaatactcctatggagcgttggcaagcgaaaattcgccgcctaagacagcatcttaggggatgggctaaacataccagcggtttatacaaaaaagagaaaaagcagattttagataagttggaggcactggataaaaaggcagagactgttctcctgtctcaagaggaagttgatattagatggtttttcaggagtaggttatctgtcattctaagggaagaagaaattaaatggtatcagcgggctaagactaaggatattttggagggtgactctaatacaaagtattttcatttagtggcaaatggaaaacataggaaaactagaatttatcaactacaggagggtgatcatttaataaggggtgatgccaatttaaagtcgcatattaccacttattataaaggtctttttggccctcctgatgagtctgaccttcagtttgatgagaattatgttgctgacattcctcaagtttcatatttagagaatgaagccttaactaaagaattttctgaaaatgaggttaaggatgctattttccagatggaacataacaaagctccgggtccagatggatttctgctgagttttaccatgttttctggaatgtcattaaatttgaccttttagaactatttaaggactttcattctgggaagttgcctttatattcgctaacttttgtactatcattcttttcctaagtgtgctaaggctttaaagattcaacaatatagacctatatgcctacttaatgttagctttaagatttttaccaaagttgctacaaatagaataatggatgttgcccaaaaggtaattagtccttctcaaacagcgttcattcctgggagaaatattatggaaggggtggttattttacatgagactttacatgaattacatcgcaaagataaaagtggtgtaatttttaagattgattttgagaaagcttatgataaagttaaatggccttttgtacaacaaactttgagaatgaaaggcttttctcctagatggtgtgaatggatagcttcttttgttcaaggtggtcatgttggtataaaagttaacgatcaaattggtaattgttttcaaacttacaaaggtcttaggcaaggggatcctttatctcctattctttttaatatagtagctgacatgcttactctattgattaagagggctaaagaggcgggactcttgaatggggttattcctcattttgttgatgatggtttgtctatcttgcaatacgcaaatgatactattatcttcttggaacatgacttgcaacaggcaaagaatttgaaactgattttatcggtatttgaaaagttatctggcctaaaaataaattttcacaagagtgaattattttgctttggtcagacaaaggaatgttatgaacaatattatgatatttttggttgtaagttaggtacctttccttttaaataccttggaattccgatgcattttaggaagctttctaataaagattggaaacttattgaagagagaattgagaaaaagcttagtagttggaaaggcaagcatttatctgttggtggtagactggtgttgattaattatgttctttcaagtttagccatgtttatgatatctttttttgaggtgccgaaagtggttcttcataaaattgattattatagatcgcggtttttttggcaaggggatgaccataagaaaaaatacaggctcactaggtgggatgttgtttgtcaacccaaggaccaggggggtcttgggattcataatttggagatacaaaataaatgtcttttaagtaaatggttgtttaagataattaatgaggaaggggtttggcatgatttattgaagaggaaatatctttataataaatctataacccaagttgacaggaaacaaggtgattcccatttttagtctggtcttatgaatgtcaaaagtactttcttaaatatgggttcttggattgtcaataatggggaacaaattagattttgggaagatagatggattggtaacttggcttttaaggataaatatccatctttgtacgcaattgttcggacgaaaacatcttctattgccactgttatgggatctgttccgcttaatgtttctttcaggagagctttagttggtcagaatcttgtttgttggcatgagttgtgtgcctctatagtacatattcagttgaatgattcgtctgatagttttagatggaatttccatcagaattgcttgttctcggtgaggtctatatacctagctttaattaataatggctatatcgagagaaacaagtgtatttcgaagcttaagttgccacttaagattaaaattttcatgtggtacctgcttaaaggggttgtgttaactaaggataatttggcaaggcgtaactggaatggtagcttgaggtgttctttttgtttgaagaaagagtctattcaacatctctttatggattgtcattttgcgaagtttttatggagagcagttctattctcttttggttttaatcttccagttagtatatctcatatttttaatgtgtggcttttgggagttgataagaaaatgagtaaactgatacttgttggagcttctgccatttgttgggcaatatggctgagtaggaacgatatggtttttgacaaatcaccatcattttcctatatgcaggtcattttcagggcaactcattggctccggttttgggcacaactacaaaggtgtgatgaagatgaagagtttctgaaagttgcgtgctgaaagttggagaccacggttatgcaactatttgccaattatggttggagatttacaaatagacttcaataattgtgatctccttacgttaggctggtttctttgtttttctcttcggtgcgttctattcatttagatttacactatgttcatgaaaactactatataataattggctgtagctcttttgagtaaaggccgggatattatattccattatctaaaaaaacttgatccatcatagccataaaaatggtgagatcgatagagatacagtgtcaggtgcagctctccaaaactagccataagcatgaaggcgagttaattggcttatcattgagccatgtgcacgttctttcgcttttcggagaaagagacggagtgagatcctcttttgtaactatgtatgttggtccatagacgtacactttgttcggacgcattttaaaggggcagggtgtagagcaccaaagctggtcatatataaatgcaaagcactgtctgaattcagggtcctaggccgtgtaaccgacactaaaaatactcccttcagtttttagtccaggatatatcctcggagacatatttgattattctcgtctttttaagaatttctctctctaattatgtcgaaaatatcctcggtaaattaccattttttaaaaatatcgtttagccatgatacattttttacgatgtctgtaaacaaattacataaattttaggtgctatgtaggaaaatttaccattaataaattatgttattatcattcattttgttgtgatttatttcattattaaagatactataaacatgacttgtatattttacataaaattttaaataacaaaaatggtttaatgtatgataaaattaaattaatgaaatcatgcattaaaacctaaaaatgagtgtaaaaaggctagatatgggaaaagtagtaaagtacatgacttgataagatggacataactcgatattacaatctcacacgtacgtacgagcacaaatcacatcaagataactaattattgcagacaacaaaagagctttgctagctaccctaaactttagcagacaatgctgcaagctagctagctactttaatccctttccatagagatagatgctctctctactggagtagtactgtaggataaacatggcatcagaagaaaaacaaattaaacagcgattgataagttgactaattatttcatcaactagctaggtagcttaattatattcgaataaaccaagatagctagtttggcaggcaagcaaattagaagcagctagatcgatcgattagcaggcggcgctccggaatcgaatggccttgccggggacgtcgtacaccacctccagcgtgcgctgctgaacgttgccgatgaaccctggcatgcggtcggtggcggtgggcgcgaaggcgaggcagccttggagcaggatccccgccgcgtcgaggttgacggtggccccgccgtcgaataccagggcgatgctgggcagggtgatgctgcggacgccggtgaagtcgtagcacgtgtcgaggatggacaccggcggcgccgtccggtacatggtcatcgccctcctgaacgccgcgcgcagcgcctggtacgccgtcggcggcagccgcgagatgacggtggtggaggcgatcacagagctggtggagaagacggtgggtggcacgggcagcgggcgccccgccacgatgatggcgcggaggagcaccctgtagaacgtcggcggcatgctgctgctgctcagcaatggcgtggagaccaaggtcgggacgagcgcggcgcgctgcggcggcacgccgagcgtgatgaacccgagggagctcggcgacggcgggatgcagtacgagaacaccctgccgtactgtgtcgccgtctgctaaacgaaggactgcgcaccgccgccgagcgccagggtgccggagacgtcgaagttgaaggtgcttccccggtcggcgtgcgcgcacccgaagaggaagaccctgacgatcgacgtcgtagggacccagcgtgaggtcatcgaagctgtacgtcccggtcgccgtcgagccatcgccgtagttgatgccgaactggcactgcgcgttggcggagcagccctaggtggacgtccacccgggagattagaatctatctctagttaattgtgtgcgcacaaatagtcaacagattatgcataaaatgctagatatggaaaaagtagtacatcacttgacatgcaagatggagatgcataactcgatattacaatctcacacgaccgaaatcacatcaagataacaaattattgcagacaagataaataaaagagctttagtagctagcctaaactttagcagacaatgctgcaattaagctagctactttaatccctttccatagagatagatgctctactagtacgccatgtaggataaacatggcatcaaaacataaacaacaatcactttgactaattatttcatcaactagctagcttatattcgaataataagctaacaatacgctagtttggcaagcaagcaaatttgaattagcacttagcaggcggcggtcctgaatcgcatggccttggcgggaacgtcgtacaccacctccagcgtcttctgctgcacgttgccgatgaagccgggcatgcggtcgctggctgtgggcgcgaaggcgaggcagctgcctaacaggatcccggcggcgtcgaggttgacggtggcgccgccgtcgaagacgagggcgatgctgggcagggtgatgctgcggacgccggtgaagtcgtagcaggtgtcgaggatggacaccggcggcgccgcccggtacatggtcatggcgctcctgaacgccgcgcgcagcgcctggtacgccgtcggcggcaggcgcgagatgatcgtggaggagtcgatgaccgagctggcggaaaacacggccggtggcacggcgagtgggcgccccgccacgatgatggcgcggaggagcaccctgtagaacgtgggcgccatgctgctgctcagcagtggcgtggagacgaagctcgggatgagctgggcgcgttccggcggcacgccgagaacgaggaagccgagggagctcgccgtcggcgggaggcagtaggagaagaccctgccgtaccgcgtcgccgtctgctgcaccagcgactgcgagccgccgccgagcgccagtgacccggcgacgtcgtagtcgaacgcactccccctatcggcatgcgcacagccgaagcggaagcccctgatgacgtcgtaggggcccagcgtgaggtcgtcgaagctgtacgtcccggtcgccgtcgacccgtcgccgtagttgatgccgaactggcactgcgcgttggcggagcagccgcggcggtaggggccgagctgcgcgcaggcggcggaggtgcaggggacggcggcgtacgtggtcgacatggccgggtcgaacagggggtcccgttgccggtggcacatcggcaaggggcatggcttgcattgcacccatgaaacgtcgctgccggagtcgattatcaccgtctgggtcaccgccgacgtgccatccggcgccgaattcgtcgtcgccgtcgttgataaactcttcattatttattaacaaatcaattagtataatatacacacttaatttagtactcctactatattgacagatcaagcaagctaattaaggagagacgttgcttactttgaggtgaggcacactgcctaagccaccattagtggcgtactggccgttcttctcgtattgcgaggttctgctcgaaaaggccatcggctgcttgtcgtcggtggcgccggtgagcctcttttggatgtagtccgcgcggcgttggtcgtcgtcgaccatgtcggccatggaagcggcgacgtcggcggcggtgctgttggccgacgacggcgccggcgagcatggcccatacaggtgatgcaacggtgcccaagtgctgttcggcgacggcacgtcccctggagcaactgtggtacaagcatgcggccggtgatgagaggttcccttgtaattaataaaaccgtatggagatccaagtgataaaaaaagaccataatttatgcggagattttgcgcatatatatatatatatatatatatatatatatatatatatatatatatatgcgcaattgtttggatgccacaatttttaattatttatttattatgtcaaatgttaggtacgtcatatatagttttctagataagtatcaatgtagtatgtttgattcagtgtcacaactatgacctgccatttcatacttttatctggcgtacgtatcaaacacttcatttttccaaacctaccacaagtgtggctatatgttaaattgtaaattgtcagtcattcttgtgacaagatttggaaaaagatcgaagtgtggcaatgtgtagatgccatccaaacatacccgtatgtcacataactccgacctctcagtacgttgggtatagtatatacatgttcatacacatcaaatgacgttgacagcaaagctacgtttattaattccattaaaaaatatgttggctttatatatttacttaaaaaaaatacccgtacgttgtaacgggtaaagacgtttttcaatgatacaacaactatttaggagctataatgagattaattttacatgaatttgtaatttacctttgagaaaatacaattcacataataaaaacatctgtctaaatttctcgttggatctcaaataccttatcaaacactgatgacgtaccaaaattctgcgaaaacattttcaatatttataatagtagagaaaaattagagatgagaattactttgaccaatattttaggagcatatgatatttatacaaaagtgtatattttattctggtcccccatatatatatatatatatatatatatatatatatatatatatatatataaagttagaaattcaataatacccttgtggccggagcagaaagttttcggtttcatggtgctggttgctatgaccatataggcgccggctgcagcgtctcctccatgggcaacaagaatggagctacagaggacgagaagcactagcagtagtccaagaggagtcatggcgatcatttgtacgtgctagctactatgttggcttgctgctgcttgctagctaagctgtgggttaccctacgatttgagccttgccctagggatgtggctatattttatagggctatacgcaccgacacagggacggtgccttacattgatactcgctacatccaaacgtagtactgcctccgtattttaatgttgacaccgttaatttttttactaacgtttgactattcattttattaaaaaatattattattatttatttattgtgacttaatttatcatcaaatgttctttaagcatgatataaatatttttatatttaaaaaaaaattgaataagacgaatggtcaaacgttgattaaaaaatcaacggcgtcatgtattaaaatatggaaggagtaccatgtagtagtataaatgacgggttaattcctaatgcatgcatatctgttaggtgcaggttaatatgtttagcgctattcacgcgcttaatgcttgaaagttttaaaatataagatgaaagtttcaaatttaagatttaaagttttaagttttgcattcaaagttttaaattagagttcaaagtttcaaaatatggggactgtttttctaaattttgagttgaaagttttaaattttgagtataaagttttaaatttgagttgagattttcgaatttcatgttaacagtttttgaaatttgagatgaaggttttgatatttgacttgaaagtttcaaaaattaagttgaaagttacagaatttaagtccgcttgaaaatatcaaatttgattcgaataagtttcaaattttcatatagatttcaatttatttagcaaaaaatggtaacaaccatttgaggaaaaaaaagttgcatggagggttattaaaatcacgcagaatcggtaattagcgccaatcatgattttgattcttgtctgttttcaacggtggcccaccaagcccacatgaatggaagaaaatttggtaggactaaagtcttatgcttatcataaagactttgtttcaaaacgtgacaatctcaaagcaatctctcagttctcctctgttggcacatatgaaatggcacagcagtgattccttcatccagttcagtccggcggcaagctctcgctcatagagaacaggagatcagcgggaggcgattcctcactcccattcagcgtctcaacgagctcacacaccttcttgttcagcgtagcagcaacgccacactggtggaggcgaagcggtggcctgcgagaggtcagcaatctcctcaccctacggtcagactcaattgcccatcaatttactcaactactcaagcttgctacaaattacttcatctggactgctggaggttcgccactgctcccccaatggcctgctgtgagccgctcgcagaccaaggaagggcaagctcccatgtgcgtgctcctctgtgcaagctcgctaggaacatgggggcagacaaggactgcaagattggtgcccacacatgtcgtgaggcgtgaggttgaagaagaggatgaaattgctttaggattggtgctcacacgtgtcacgcttggaaatgaagtctttcctattagcgtaggacctccgtcttaccaaattttcttcccacatgaagtacatgtgacacaatgcgtcatatttaacgaagtcgtgtgtctgtatggaatagctttttgatgaatgtcattggactatctatttcaaaatatataaacctagttactaaattagacaccacctaaaacttttaatcatgacaatcatttaatttcaccatattcttttaatttaaaaagtctaaaggtatatatattttaggattgagagagagtaacttattgtatctgatagacacatttaacaaatcccaaactaacacagaagtacaatcatatatggaaaaataagcagatagtaattaaatacaaaagcatgaatcttcgtgaggccccttcatcacttcattactcactattgatgtatgatgtgttaacattggtaaatgcaaatgtgatgtagcagaaaaaaaagaacacctggcaagctcaaaagaaaagatttaaaggaatatataaatagacctttatcaacttttcgcttaggaccactgcttcctttactatcttttccaaagcatctcacaaaactttagttagtctactttaatacacctccaaagcttacatctactttggatctgtttttcttttagataatcagctttggatcgatcggcaccatcggatctttttattttttgaaataagttttgcatcgttaaacaatgattgtaccatctcacttttctaggtccggacagaccaattcagagtttcagatatatttgttcatctcgacgaaaccaaaataaccaactaaggcagcatgaaattagtgcacaatcacacgaagaaaataccgtgcaaaacattaaaaaataatttgtgcagtcctttcattttataggcggtttaaatttttaaccgcctatgaagatggctaagactgctgtcaaacaccgcctataaatttgggtgattctaaagagtggttttcttaagaaaacacctaaaatatttgattttcagaggccctctgaaaatggaaacaggagattatggataccacatacctacatggcatggattgtctgattacaagtaggggtagttcatgtatagatattatacggataaaggcccaagttacgtgattccttatgtattaaggtaataacttaggagtccgagtcctatactattgtaacataggcaatacaataccgaaccgtatgaggtgaggtattttcattgtaatcctagctcctccgactatataaggagggcaggacgcccccaaggggcataagactttttccacaatcaatacacccggcggacacaatccccgaaacaggacgtagggtattacctctcaagagagagggcctgaacctgtctaaagctttgtgtctgtcccaatcgcacttttcgagctcatacgcaacccccaattcatattgccgaaaactagtttcgacagttggcgcgccaggtagggcagtgtcgatttcttcaccgactagtggaatgggatctccatcaagcgtcgatgacttcgtcttcccacccgggcagacatacgtctttggtagccttgagctcgtcaccgatgacttcggcaagctttctctctccgacttggattcgaaccagtcggggagctcttccgactcgatcccgttcgacctaccgaacacagccgagtcctattccaagtgatctctgtcagggttacggataaggcatacctcctatcctacgactcatagaatatacggatacggtataccatgatggacgggtattgttcccgtatttgttaaggaaatctatagatattatggaaaatacctcaacgagtctgaagacaacagagtcctactcggagagggtttggctctttctatatcgtacggggtctgatatctccgagtcttacttggagatcaaggtgatatacggtataaaaggagtaccccccgaggggttacaggcatcgaatcttcccaccaacaaatacaccatagtttacgaagccggagcacgtcaagccttctcgccggggcatctagtcgaaaccatcgactacgatctcgctggtttcatcaagtttggttgttctatttgtaatctgtggttttccatatcaatatcatataaactggacgtagggttattcttgataaggggtctgaaccagtataatccttgttttcttgtttgcttgatgtcgtatcgtatagattctcataccaacgtacccaaataccctattcagctggtctacgggtatcacccgtcgacagtggcgtgccaggtagggggacttggtgctcaaggttctgccgacatgacttcaaaacgtttcgacaacaatgtcaacatcaatactgctccaggagttccgaccatgacatcgctgatgtggactcaagtcggatcaattgtctttccgatctatactgtcgtaccgatctcatcgaacccaatctctgtcgggaacgagaacggagcagtcgtgacttcgagaaacgaccccccaacgatgattcctcccgcggcaaaattcaagaaatcagaatcaggcgccgacaaggatagctacgcagaaatcgagcacttggtgtcacattcataagacatccaagcactctctgtcggattgctcggtggtacgtcatgtggcggctgaactcaaggcatgcaaagagtgcggaattcaacatgcttcaccaaccgatatcacctggtgtccgatacataaatcaaagaagcatgatctctcaagctgcaaagtctttctcggtacggtcaagcctcagcgacctcagatccgacaaccacgagctcaacctcgatgtgttgcagaggaacgggacacagagacaacacccgatcggtttgtgggattcgttgatgtcgacccccacgaaccctcggttctacacttctggcagaccaggaatcttctccgagttcaccgcgagatgtgaacgtgatcgagggagctgaagacagcgcgacgattcacggcgacaatggtgcccgatacacaagactaacacgcataccatggaggattgcaacgtctttaagaaggcacttgcaagacaattggcggtcgagaagagaaagcgagtacgagtagtcgaggcacctgctgatgcgagtaccccgaattccgacttcgcgttctcagagtttgacctccacgtcacgcacatcttcggcggttctatgtcgtactcctcaaaaagagagtacaaaaagatagaacgcgaagtttgctctacatcacaaggaattaccgccaagattaagtggtcgcagcacaagatcgagttcttggaggcggaccacccgaagactacaacta

SEQ ID NO: 18755 - DNA, 11367 bp, Oryza sativa
cgcccctcgccacccggcgcacggtgaggcctccctcctcctttccttttcccctctgcctcccgtgtccggcgccacgacgtgccgccatcagcggcgagtgtccggccgggagccgccgccgcctggtcgggtcggccggcgagccagccccctccctccgttgccaacttttgggtgctgcccgtggaccacccgtggtctcggtccacggtgccgcctcggccacggtgggccgtgtccaccgtgtgcctgcctccttgacccgctgacgcgttcggcccgcctgtcggcgccggcgccccttgctgacgtcagcgaatgccttttcctttgagaaaataattattaattgcgtcataaatcggtaataattgtataaatccattaaaatggctcaaaacttctaaaattcatatctaattcattcgaactccaaattgggccgttcaacttgcaaaattcatctaaaattaagctctacaagtttgtttactttttatgtactgttttcttggtttttattagtgtttttcctcgttttgcgtgccagcgtgtagaatccgtcgtttcggaagtccgcggtcacgaggaaaagagttcggaagattgttttgaagaagcaaggcaagtcacacattccccttgagcatgtttatcccaatttataaatgttttaccgtttgcaaataaatatgcatgttttgctaattacatgggatctggatattacctatctgctcacttgtgccatgtttacttgatatctgttctttgtcaaccttgggtaataaatcgactagctcatgttacttatgtgacctagctagaactatatgcttagccatgcttaattaccactagctcagttgatgggataattgcagtattagacctttttagtatcagaatgggctgcgtgctcgagacatctggccatgcttcatggccgtaattatccaactaaaatgcgactgaatggtgggctgtgggtgcatggttttgctagtcgcacccatggcaattaaggaccggttcgcgggatgccctggaagaacttatcgtacttaccacaagccagcgtgggcaacggctgagcttgtagtgtagctttcctctagctgacgcatccaggcaagggtgggcgtgatggagtttggataggccctgcgacggcctatgcagcttccggattcacctaagcacgagaggggactgctcgctgccttgcgaggagtggaggtgaaacctgaggtgtggtgtgcttggttagatggggttatgcgaaaggtcttgtcacggcctctttccggtatgtcgtggtggcatgtcggcgcacggaaacgtgtcgtggggctgtgtcttgtgggtacagttgtacacctctgatcagagtaaaactattcgaatagccatgcccacggttatgggcggtcgacctgattcaccgtgattagtcccatcctaataaatcgacccaatgcactgtagttcaagtgggttggttgggcctgtgtaacgtaatgtagcgttaatcagtggagatttaatattactttaattactcaacagttttactggtttgctcaataaaatgttttacaaccgcctttatgcaaatagccacaaaccgtccttgtatccccttgcacgtctgcatcattggtgtggcttgctgagtacggtggttgtactcagccttgctattatttcccccttttcagaagtgtagtgcttctgagctgaagatgaagttagaagaccaaggctcagaccccagttgagttttgcctgtggagtggagctgaagccccgttaggatcacctttttccgctgctgtcgtttcttttcggtgcgaggactaagagcctcttctgtaagtattttacgctttatttacgtttggaactgtatattacttgtcgttttgtgtaccctggctggtcctggatagggatttaatacacaaaatagtatggaaatttgggctaaatttctgggcgtgacacactatcaggtcaacctttccacgggatcactccagaatcatcgtccaagccactgggcaaaatcacgctacctgtcactttcggacaggccgataacttccaaacatagcaggtcaccttcgatgtcgccgagttcgacacggcgtacaacgccatcttaggaaggactgcgctcacgaagttcatggcggcatcccactacgcgtatcaattgctcaagatgctaggaccaaaagggaaaatcactattcaaagaaatgcaaagctagcagcacaatgcgacaagcggagccttgacatggtcgagcaaactcccaacctacccaccacagctgtgccacctacgaaagtgagcaagcccaacaagacgtcaagacccgacggggcgatcaaaatcgtcccgctgaccagcactaaccccgacaagactgtcaagatcggggcgacactgaccagcaaataggaaatcgagctcatcaccttcctccgcgacaatgcagacgtgtttgcttggcaaccgtccgacatgccgggggtccccagggagatgattgagtacaaactcatggtgcgacccgacgccaagccagttaagcaaaaactgcggagattaacacctgatcggaaacaagctataagagaagagcttgacagacttctcaaagctggcttcatcagagaagttctccatccagagtggctcgccaacccagtcatggttcgcacttagcaagataattagcaccaacactttgtgtgtgcatggaacttgcatatgtggggaatcttctacgaggctggtttgggacgtatgccatatagacgcattgtgaatggtgttaagagtatacgtggtgtgaaggatctagcgagaatacttatcatcacctcaactgcagttggggttttggaggggatgatgctattttttttccttctagagtgaagtgcccgaacagcgacgcccaaaataattactccttttgttaaaataagttaatctatgacgagcactaaggataaatgctacattccgtacttgattaacttatttttggatggaggaagtaaaaaaaaaagctagctagtggctgcctttgatttgctttgggctcagtaagcagcagcaaactggctttgggccgttggcccatgcgtgtgcttggccagcagtggcagctaactagcagatcaatcagccgcatgcatgcagcagtagcaggccagcaagccagaggcagcgaagcagctaggcagcagcttgcaaacaggatatagcgcttgaccaacttttaccgatcgataccaagtttaaactttttgtttgaagcaagtacaaaagcgtaatgtgttatatatatatatatatatatatatatatatatatatattaaatttgtttgctgctccatggtgcccgggcaccatgattaaaattgagtatatactcaatttaaatgggtatgaaacttttataaatgtttgggtattaacattaactactttactaactagttcaaagcaagtttgaactaaatttgaacttgtttttgttagattttgattctaggtatatagcatccaaacatataaaacatataattagttaggtatgcaattatggattgtgaaataaagctaaatttgagttgctttgttgataggtatagatatgaatcgaattcttataactaggtatatactcacaatttaaaaattttgaaaaatttgagtgaatttatgtatttaataccatggtgccccatatgagtatcatatatatatatatatatatatatatatatatatatatatattgtggtcgaacaaattgatcaatccaaattaaaatatatccaaattaaatgggctctaatccgctccacgtactgatgtggcatgcaatggtggctttcaaaatgtatttttgggtctctaaacttgtctaaacggtttcaatccactcgctgaactctcaaaatgtattttcggatcctcgaacttgtccaaatgagctctaatacgctatgtgaactgatgtggtatgccgcgttggcgtctacatatcagtgggatccaatgtcaatcacatggggaaaaaataaaattgaaaaaacaggttttctcctctctaccttcaaattaaaaagaacatatatttttaaaattttatcttttctcctctcaacctaaagaagggggagggtgaagaaaaggagaaggttttaccatatgcacaaatcttaaagcgcatccgacgacacaacattcaaaatgatttagtggtttttgtttctatcattttttttgaacggttagacatttgctgacgttttatataaaggaagaaatgtgtcccattttaagaagaaacaagaccaaaccttatagtacataattaattagaacaactaagcgaaatcatgactaccacaacaactccaccaacaacactctcacaccagcctactaacaactataagaacgatggaggtttttatttcagtcgaattgtatatagaccttccctactaaaatatgcaattccatatttatataggtgcaagtgcatacatttgtcaacaaaataaaaccgcaccttataccttgtaacagaacttgaaacttcactcatcatcgaaatcaaaacaaacattacaaaatagtctttaacgtgtcacaaccataactcattatggatgacatcacatttacggcatgtcatatttcatatccacattctaaatggactatatttgcacccataagagatgatggcctcggtgacctgtaaccttttcatagatgggacatcaatgttggccggatctgtaagtagtgacgagtgtgacaacacagtgctagctagtactcccttcgtcaaaaaaaaaaaaatcaaatcctggatatatagccagattcaaactcaaaattgaattcttagagagtagctcattaattattttttgtttattttacgtgtgtatgtatatatatatctacacacgcgcggcacgcatacatacatacatacatatgtatgtatctatatgcagatatataagtatatgtatatagcgtacgtaggtaagtacagtaagtgataggtacgtagctacttgctggcaggggcggattcacaatgggggcggaggggttttgagaccccactacctacccagggatagtggagacccccctaagcccccactaaattttttttccatagatctataggatgtggggactgaaggctcgatttatgctgatgtagtttattcagcccccactactatttttttctagatccgccactgcttgctattgcaagaaacgtcgtcggtggagttcaaggacttgtcgacgccgagtttaacgttgaagcaagtgtaggtgacgttggccttgctggtgtggaccggcccgtcgccgttgagggtgtccaacctggtgatgaggatgccctggactcgcagggtgacggccatggtttccccacgggatagcctcctcacgaagtagtcgccgacctccgcctccgggttggtcgtccactgcgtcgtcaccacatgcatcatcttccccggctgcaagtccgtgatgttgggcaagtagaagaggttagccatgctgatcacgccgccgccggagacgaagacggccaagacggcgacggacatgtcggtgaagctcatggtgtcgcgcccgcttgggttgtcgacctccagctggaacgtgaacgtcaagctcggcggcggcaggtttaccaacatggagccgtggatgaccttcatgacaagcgcgtcgggccggagcaccaccacgatggccccgaccagcacccccacggcgagcaacgccacaaccccggccgccgcgtatcgcaccacgtccagccaccgaaatttcttctcctcctcctcctcctcctccgccgcctcctttttctcgttgcgcatgctgtggtgtggtgtctacctagctacagctagctagctcacgacgcgaggatcgtatacaaattagttaaagctagtaacgtagtagcttaattaacaaaaaaaacagcttaactaaaagttaattattccaattcccgctcacccacctagctagcgtagaaatacaagctactttattcgaattcgaccatgcatatcgcagtcatgcagctcgatcgtacgtagctagtcatcaattatttatactcactttattcgaattggcgcatgcaagatagccaagaattaattatttctactttattcgaattctttttctagagaaaaacaaatactttattcgaattcgcacacgagctatctggttcaatatgaaaaacaaacgagatagattaaaatgtcatatattattccataagtatttgtgttcaaattcaatttatacaactagctagaaacaatttcgagattgcatgttcgtgaaataacgtattacatattaatttattttcaccaattttcttaaataataacaatgttttttataacatgcacaaacgagaggaagcctccagtcaaaaattcagctccattcatatatacttcctccgtttcacactacaagtcattctatcattacacacattcatatagatgttatatatctagatgaatatagacaatgatagaatgatttatatcgtgaaacagatgaagtactatatagaagtactcctatcaattatctctcatttgaatttcttatgctgtcttctatctcaagctacccttgcatccgtcctcatcggcacgaaagtatattctttataaaccttaatctctacttaaaccatttggaaatgcttcgatatgatggagagagtagctttcttcaattaattaaacaagtcgatcacacacgcatcactagctagctagctaactagtaaggaggtacacgtaggtagctagataattaagcaggcatggcagcaatggcggcggcggcgacgacgacgacgaagaagctgcaggtggcttcatcatcaccaaacacacacaaatcatattggagcacgaagcagtacatcctcgtcgctgtcgttggaaccctcgcggcgaccgtcattgtgatcggcatctccgcgctgctgagccccggggagatcgacttctccgtcaccaaggcctcgcgcatgatcctgcctctggatggaggtgtggagctgaacctcacagtcgccgccgccaaccccgggtggcgcgccgccgtggagtaccgcgggttcgacgtgaagctgcattacacgccgttcgacggcgagcccacgctgctcaacgaagacgacgcctcgtcggtgcggacgccgttcgtgcagccgccgcggaacacgacggccatcccggtgcgggtgttcgtcagcggcgactactgggtccaaaacatgatgagaggcaacgacatcccgatcaccgcgcaggtgacggccaccgtccgattcctcatcgggaaggcctgcaccaggtcctaccacatcgccgtctcctgctacctcggcctcgacttgttcaaacgccctaccgtatcattcaatcataataatacagccgattgcgtcgcagctgggccggaaacagtctagcgattgctattacctgctgctctgctgcctgcaattctactagtgtctctttaattatttatctgctgctctctctgtctattaattaattatgcatgtaaaatcctccatcaaaacaaatgtaaggtatattttattttctgatttttctaaatgagatggatatatttgtagtctctctatgtactaaactaaattattgatcagtgtaaaatcaaagcgtgttttgattattattctgtgatgaacaattagcatctgtgattaacggttttgatatttggagattattggcgaagtggttttggagatgattggatttacaggtgatatgcaggtaatgctatgatttgggtccggtcagaccgggcagtggttgccggtcagaccggcgtgtatcgcgcggcggtctgaccggccgacgctgtgtcggtttcggtttcgggttgtttatttggatatccgtgattgtttcatgtttatggcttctagatggatactatatgtatgtaatactgttgtttgctaacaatgagtcaagttggagatagtttggtttcggaatatggtttctttgtttgattcatgtgtaggtgatttgatgcctcaggagagtatttgcagtgatggatcgggagtcgacttggggataaggcgatgtccgtgacggtcagatatcatgcgggatacttttgctagagttcaatgcacgtggttggtaaagattccatatggcatacgatggaggtattgtgtgcgtatgggatgtggagtcgaatttggaaggagttcaaatttggtatgattggagtttgtaaagtttgtttcttatacgagaaggtttcctaagtgatttaggacttctagtatgagtttggttcgcggctttaggatgcctacctcatgtataaatagagagggagcgtgaggcttcccggtatcacttttgagagcattgagttgatagttttagttagggtttcgagtttagtcgagaatttcgtgaggagtgttgttgttgcactttgtaaacacagagagaaataataaagttgtcatctactttgagagttcttcgattcgtgttttctcgggtgcagcggtccaactgacgggacaccggtggtcagaccggcggtatcgcggtggtccgatcggcggcatacctgcggtcagaccggcgacggcttcaggaggcagggtttgatctcggcggttcgacctgtattactacctcggtcagaccaacgatctttgggcagtcaaaccgttacgactacttcggtcagaccgcaatccgtcgaatttgaggtaacttttatttccactaaaagttttgggtttttgtgtataccaaccattcaccctcccctctggttggcttagttcttatgattcgatcctacaatcagaatccaaaaaatcatattaatactcattgactatatatatatagacacacacatgtttcttggtttcatcacatgatggataagttaattacttctcaatattattgacaaaagaaatatatactttgggatggagggatagcgtatacgagatttaattagttatacatatctctaatatttttaaaaaccaactcttcgttctccttcccaaccatcgcattttcccatataaaaagcccacactagctacctcaaaatcctaacgcaccaaaaaacaggtaatcccacgaaaaaaaaaagatagaaaaaactaaacccctctttagatcttgttgcatagacagacatagcactaatatatattacctccatcttaaaatgtatgatgttgttgattttttaataacatttaaccatttatcttatctaaaaatttagcataataatatacaagttaaaattatatgtagtttcttttatgataaaacaagtcataacaaaataaattatactcttttaaataaaacgaatgattaaacgttatatgaaaagtcaatgtcgccacacaatgcagagagtattaaagtgtgcctgggtgtgtgtgtgcacgtaaacagtgttcaagcgcacgcactcctacactatatttcaaatgtgtttatagtgggaatgctatatttcaagtatattggaactcacacaggttatagggtacggtgtttgtttgtggcgcatgttattttggggattttgctcagttttagttcgtacattaccggtgttggtgacatttggaaacatacacgagagtagtgacactagtggagaaatgatctttgatcggttggataaaaccacatttgtcctggtttgtggagaaatgatctttgatcggttggataaaaccacatttgtcctggtttgaatagtaaccattactaaagatgcacaaaatctttcaaaacatttttagtcccaattggtattacgaaccgagattaaaaattgatttttagtcaccaaccgggactaaagatgccttcagtgctagttaaaaagaaagcacccctatctatgtcagatgagtgtagttggtgggatggttgcgtgcgtgagggctgaagtgaaaggccttgagtttgaatcccacacctgacatatttttgcaacttattatacatagtcccggtactaaagatggcgccatctttagtaccgctttctttgtcccggttcacttaagtcctagttatataaccgggattaaagattgctatctttagtcccgttttctctatcccggttgctataaccgggactaaaggggttataaactgggacatttttagtcccgcttttttttcccggttgctataaccaggactaaagagggttataaaccgatacaaaagagggttttcccagcagggtccggttatataaccggaactaaagatcgtcatctttagtcccgcttactttgtcctggttcttattatacatctttagtcctggttatataaccgggattaaagatcacaggtaatcgggactaaagatcgccatctttagtcccactttctttgtcccggttgctataacctggactaaaaggggttataaaccggggcatcttaagtcccgcctttttttcccgattgctttaaacgggactaaaggggattataaaccgggacaaaagagggttttcccagcagggttgctataaccgggactaaagggttataaaccggacaaaagagggttttctcagaagtgtgagatatgatgtacgtacgtgtatatatgtattattaattattactacatatggacttcacaataagtaagtagcgcgacaaaatgacttcaccctatagcttcctactcaaagattgcggtatgtatatactccctccgtcctttaatatttgacgccgttaaccaaaaattatataaatcttaaaaatataaatagtgcttaaatttcatttagtgataaatcaaaccacaaaaaaaaaacatttacttaaattttttgaataagacgaatggtcaaatatgatgtaaaaatgtcaacggcgttaaatattaagggatggagggagcacgtattactagtatttatcactccgtactacctatgcgtctagattcgtggtgagctgcatgaggccggtaacaagaatacactaaaaagggcttctttgaaagggattcatccaaatgttagttaacccgcgcggtgactgtgcggagtacttaattaaaccctagtcgacatgtacacgtacgggagtatgggactcccaaatgaggcctaatcaaaaagagatt

SEQ ID NO: 18756 - DNA, 5830 bp, Oryza sativa
  unsure (1)..(5830): unsure at all n locations
ttgaataagacaaagcaattggtgagatctgacctaatttcatggagggcaactttgacttgcggtcaagagctccaaccaccagtgcatggcttcggtgaacggtcgaagctcgacgcatctccccaccgatgtgccaggtcgtaggtggtggccggttcatgaggaggcggagggggctcagtaggcctctagcgagaaggcagcaagagggctctgatggggccaaggcctcctagatgcggcggccctcaacggagaggctcttgggcttcagggtgtcgacgaagccaggcagacggagtggcttcatgtatgagctatcctcgctggtgtcgtggatgaggatatgccgtcgaagccttaccgaagagcgcccgtgccatcggacttgtcgcccgcgcctgtcggatttgcgtcctaggtcaccgccgctatcgtatccatccccaacgccccgagccgacgccggatccatcgtccgcgacccaagccgccgctggatccgccgcccgctacccgagctacactgccgccaactgtggaaggaactctgcccacgactccccttgccgccgccacccctcccgtcgaatcgagagagggacgagaagtcgaggttgaggtggagaggaaaactagatcgagaacgaggggagagctgagctaggagacaaaagaagaaagagagcgataaaacgagagatctctgcgcctcaccgatagctcatgttggtcacttggtcagagcgaccgctcacctttttttccttttttaatttattgatgacaaaaaataattgatttctatgtttattatttccttagatgaaaatcataaattgtgaaaaaaataaattataaaagtttcataaaaataaatacatataattaataacttttagggccttttggtttggtaggaatttcaacattacatgcaaggttttaagaacgccgcttgaaaaaataggtttttgagcccttatattttttttataagcggggttttttagttcaccaataaaaataaaacacaactgtcatgaaagaaaatgtttttatagtgttgtggcctctggcatggaagggttggatggccaggacatcaaaggggaaaattaaaaaattattataggaaaagaaaaaactaataaattagaaaaaaaaatggactatggcaatatatgcagagtgagatgaacatgatacaaaaatatagcaatataaatatttcatatatggtaatatttatcgatagctgggataaatatccatctcttcatatccatatatatacacacacatatactctccgtagtttttaatatactattcccggttttcaatatatggcatcattataagtaaatttataacaaaaatgataattacataatttttaaataagataaataatcaaccatatataaaaagtaaaagtatcgtacattaaaacaagaggagttatctacttaaagaaatcattttttttttcaatcggcacatatacacgcatcttggtcatctgcgtgtcttttgttttgttatcattagctttctctttgtatgtcgttcgattcacacgtcgagtctgggtattgcctctctaagcttttactgaccattaatttcacttttcacgctactgacttgctcggcttttactgatcacacactctcttttatcactcatgtcccctaatatgacgcacaaacatatttttcaagtaatctttaatactccctccgtcctttaatatataacgttgactttttacgtcatgtttggccattcaacttattcaaaaatttaagtaaatgtcttttttttgtttgatgtatcactaaatgaaatttaagtattatttatatttttaagatttacaaaaattttttaataaaacgaatgatcaaaggttgtaacaaaagtcaatgatgtcttcgtgtaattaccaagtaacatagtatatttgcgtgcgctagcgctgctagcaggcaacacagctcagagataatatgcacagacaagtttcgatcaatccaaacggatttattcttcgcgtcatttgctttctttcaccaaagaaaatgattgaaagcaacaggagtataggacatcaggaaataaagctagcacaccgctcgtcaattatggaagaataatcaatatgtataacacaagcatgcgcacgattcttaagagaattgatgcagggcacacatgcatggcatcaattttgtggttttagtgctttgcaaacacacttctacaaagcaaaaagaacaaaatatatgatacgatctttgtcagtcagctggtatatatctaatatattatgcattatactagttgatgtgccacacttttactgcagaatgcatgaataaatatgtattaaatatcataccaattatgtatgtatgtatgtatgtatgtatgtatgtatgtatgtatgtatgtatgtatgtatgtatattgaaatattgtgtaatggtgtatgtatgtatatgattatttgacacatatttttatgtcgagctgtataacatattagagttctataatatactccatccgtttcatattataagttgttttgacttttttctagtcaaatctttttaagtttgaccaaatttataaagagatataacaatgtttataacacaaaacaaacatattatgaaaatatattcaatgttacagtcaataaagctaatttggttttatcaatgttgctaattttttctgtaaatttagtcaaacctaaagaaatttgataaaaaaaagttaaaacaacttataatataaaacggagggagtaataaattacagatgatgcgtcatgtatgcttcgataagttttaagatgttttgaaacagtacttacttgtaggtatatgtatattgtgggttctaactatatatagataccaaaagatcgattaaacgtccttcggaagtcagaacgctactaagatgtcacatgacgctccaataaattaaaaaagtttaaaatgttagaaaaagataaaatatctgaccgcaagttttcacttaaacaagtggtcctattatttttaacctttagatttagaactatttgtaagctaaagggaaaaatgtcccttccacctccccctccaatacgtatgtgtgcactccggcccatgccgtctcggactctcgggctctttcatatttcttcttcccaactttcttaatcacaggggtgggcctacaacaattcaagggtattcaaatgaatacccaataattttatcaaaaaatagatatatatactatgtattttatatgtgtatttaaaaaattaaagaaaaggcatcaaacaactcatcaagcagagaaatcatcctttttgggccgcctcctcccccttatctgttggcctattagaacaattgattcctcattttacccaaccaaatattttggccgtgatgacgaccacactgccccgctcactagaccttgatgacgtcctcctcctagtctcctctatctcctgcctcccactgtaccgcaacccgcatcagcttgactactttgagggattgaggttagaaataattagcttactctagaccaacaaattgatgatttaaagttcaattttaccgattcaatttaaattttaatacttatgttgactcgacttcacctttaaaaagtactatagataccacattttacagggaagcggagtataggacatgtatatctccttcgtctctatgtaacaaattgcgtcaatatgaaccaattaaagcagggctagcttgatcgtataaataaaacatatatagtagaaataatagttttttgagatatttttaagaaaagagaacatctacacattcaagtaaaaagggaaaaacacattacttttgatttaaacttaatccatgggacataatttctaaacaaattaaatctactttcattttagatgatgacgtagattataaaaaattgcttatagggatgaagtacatattatatactataaagataacaaatagcttagaaagagttatctcaaaaatgtccatgaagaagaaagttttccaatgcatgcccacacatttttatgggctatcttcctagttctataaaaatcagaattaataatgactgagttgtagagtttaagttacatactttttatgattattgatttataaattcataattaatatatatgaattaatttgaaggtgtcataagcccaaaactcgtaagtagatggacttacatgagtttttaatgtggcttacaaatgtttgtgttgacttctaaatatttgacgccgttgactttttttaaatatgtttgaacgttcgtcttattcaaaaacttctgtgaaatatgtaaaactatatgtatacataaaagtatatttaacaataaatcaaatgatagaaaaagaattaataattacttaaattttttgaataagacgaacagtcaaacatatttaaaaaagtcaacggcgtcaaatatttagaaacggaaggagtatatggttacaaccgtatgatctatctgattgacggccaactctttctggttaacaagggagttcattgggaaatgcccaattaatagagaagtatacattggactttatgaattggattttagtaataagaccgtaaggtatatgccctcagctcgcttgttatgttggtgctaataatcgtaaattttcaggaaatatgcaagattgattgttttgttccgctgtttcatacacatgtaaagtcaaaattgatcgatatatacagatcggacaaataaaagtaagaaatatatatattactccctcagttcacaatgtaagtcattctaacatttcttacattcattacatcaatataaatgtagaaaataatagaatgacttacattgtgaaacggaggaagtagcctcttacatatatttgtagcgtgacatgcatatgggacacaattatccgcgtttatactttttttaatatagaacgtgtttattattgtccctcattacaaagtatattctcggcttcctctcgtaagcttgagatcatgggtccattggcgcanatatatagctagctagcgaccaatttactcataggtaggcaggtggcaagatcgatcgagcgatgacgtccgtgacctcagatntgctgcagtcgtgttcggaaaccatgatttcattcgtccacaacatgacggcttcctacgccgacaagagcaacgagtcctccgtggtgtccacctccgtcgtcatgttcatcctcgccgccgtcttcttcaacctcaacctcttcagcggcgtctccgacgtcagcgccgtgctcaaccccaccgtccgcatcttcctgtccagcgcgctcaacctcttcctccccgtcatgtcctacctcttctccgaggccaagcaagcgccgctcggagtcggcgactccactaccaccaccagagacgcccactccgatgacctctcgctgctggcgcgtgtcatcctcacatggatgctcctcgtcgagctcctccgcaagaaggtggaggccatcctcatcaccaccggcatgcacgtctactccagcctcatcagtcacgccaccagcgtcgcctggctgggcaacctgtcttcttcaacctccaggccgccggcaagaaggcgctgttcggcgtcctctgggtgctctgcgcggccaagctggtgcagcgcgtcgccatcaccgagatcgggaagcgctnnnnnnnnnnnnnnnnnnnnnnnnnnnnnnnnnnnnnnnnnnnnnnnnnnnnnnnnnnn

SEQ ID NO: 18757 - DNA, 731 bp, Oryza sativa
tggtgcagcgcgtcgccatcaccgagatcggatagcgctccttcgcccatggcaagaacgcccgcctcatctcctcctacatggcgcagctgccaaagctgctcgaggtggatgagcatgtcgccgccgacggcagcaggatggagcggtgcaacttcgccgtgatgggggaagagaacatggtgctcaaggccggaccacacggctacgagctcgacctcggcctcgccgccgccgttgtcaccgtcgggaaaatctggcagaccaaacaacacccaaggctcaagaggctctgcctctccttcgctctcttcaagcttctgcgccgccggttcgagaacctgccgccggcgaccatgaaggagaccgacgagtgccgggacctcatcttggacggcatgtgcaaggatgctcaggccaccggcgacgtcccggcggaggtggcgctgttccaggtgctcaacgacgaggtgaacttcctggccgagtactaccactccgtcctccccgtggtgctcgcgagcccctacttcttcgtcgtcaactacctctgcttccccgtcgtcgtgttcggcctctgcgtcatgaccatcgtcctctgcggcaatggcaacgtcttgtacgccttcaagagcctaaccaacgacaactatgccgtctcatccggcatactctcgctgacgaaatgcctctggaaaaacgtcgtcaggtctccgctggtgttcttctcc

SEQ ID NO: 18758 - DNA, 643 bp, Oryza sativa
  unsure (1)..(643): unsure at all n locations
nnnnnnnnnnnnnnnnnnnnnnnnnnnnnnnnnnnnnnnnnnnnnnnnnnnnnnnnntcatatgccctcttcttcctcataataccaatggctttgttactgtcatactttaaaaaacacatcggctcggctccgaagggcttggctgtagctccaaaggaagggctcggctccaaaggaagggcttggctatagctgcaaaggaagggcttggcggtagcaggacatcggatcggggacgcaccgcagagaattttatcccaatagaactgcatgtgtaattgttttggttgttgcaaaatctcttaaattttgaacgcacatctaactaacatgaactaactatcctattttttatagctcttcctacatgtatatattcacgtatggttacaacaagctacgatcatcacttcatattcgtagtggcggcgatggagttgccagggaagaagagggcagaggaatcgtggttggagaaggaacggctctggaggaatatcgtgctatcgatggagttggagtgggctggatataggcccaatatcggtgtactaaaatacccttgattaagtgctaatcctatttttaatctcagctactgatgatctttaattttcgtgcaactttttttagagcacat

SEQ ID NO: 18759 - DNA, 1318 bp, Oryza sativa
gacaacttacagagacaagattagagtatcataatgatggaagcactaatcccgagaacgcaagccgccataacaagtcgtacctctagttgaagatcgaaaccgatgcagctcaacccgaaagcaagaactagtcgaaagcaaaacaaaagtaaagggtggcaatgcgccgagattgttgttgaacatgtgttaattgaatacatggggttcggggtctatttatacccgagattacaaaatatgtccatatcggacacgactgttatctctaaccaactctaagataccataagtctttgcagcagacttttgcccaaacttatctctaaggaaattatataaaatatcctaattaatagatacaattgcctattcaggactcaatccgagtgtggcaatccgtgtgaagcacattaactcaacccgatgacacacaccgagtcgtattgtcggaatcggcttaatcggctaccttgtccgactcgaactcagctgtctttgatcgtagccgatttggatttcagccgaatcttgctctgtttcagaaacgatctttgtcttcgattccgcatcgatctaatcttcttcttcgatactcagattaccaaatttggttgttaacaattggacacttgtcaagcggatcctccgttatgttcgtggcacgacgcacaaaggtctgcaactccggcgttcttctacaccgtcgctcaccgcgtactccgacgcggactgggccggcttgcccgacacaggccgctcgacgtccggcttttgcgtcttcttcggcgactctttggtgtcgtggtcctccaaacgacagtccgtcgtgtctcgctccagtgccgaggttgagtaccggggtgtggcgaacgcgactacttgaatagtgtggcttcgtcaccttctcgacgaacttcacaataagctcgacaaagccacgcttgtgtactgcgacaatatctcccccgtttacctgtccaagaatccagttcatcatggtcatgctaaacatgtggagctggatgtacacttcgtccggaaaaaggtggctgttgggtacatccgcgtcgtgcacattccgactcgacaacagctcgccaatatcatgacgaagggattgcccacagcgctgtttgaagatttccgatacagtttgtgcatcgtcgacgacgcaccaaccgccggggggggggggggtgtcaagatggctgatcatgtagataaggataggctagattacagtttctttttgacctattcttccgccgtgctcagtctacgatccattttatcaggattccgttggcactcg

SEQ ID NO: 18760 - DNA, 754 bp, Oryza sativa
  unsure (1)..(754): unsure at all n locations
nnnnnnnnnnnnnnnnnnnnnnnnnnnnnnnnnnnnnnnnnnnnnnnnnnnnnnnnnnnnnnnnnnccatatgtagtaataattaataatacatatatacacgtacgtacatcatatctcacacttctgagaaaaccctcttttgtccggtttataaccctttagtcccggttatagcaaccctgctgggaaaaccctcttttgtcccggtttataatcccctttagtcccgtttaaagcaatcgggaaaaaaaggcgggacttaagatgccccggtttataaccccttttagtccaggttatagcaaccgggacaaagaaagtgggactaaagatggcgatctttagtcccgattacctgtgatctttaatcccggttatataaccaggactaaagatgtataataagaaccaggacaaagtaagcgggactaaagatgacgatctttagttccggttatataaccggaccctgctgggaaaaccctcttttgtatcggtttataaccctctttagtcctggttatagcaaccgggaaaaaaaagcgggactaaaaatgtcccagtttataacccctttagtcccggttatagcaaccgggatagagaaaacgggactaaagatagcaatctttaatcccggttatataactaggacttaagtgaaccgggacaaagaaagcggtactaaagatggcgccatctttagtaccgggactatgtataataaagtgcaaaatatgtcaggtgtggg

SEQ ID NO: 18761 - DNA, 1633 bp, Oryza sativa
gtggtgaagccagtaggcggcgccggtgcggtcgagacaggaggcgccgaggcggcgggcagagacggcgagcgcggtgactgtgagaagggagtgcggggcctgagggagcagtggtagggattgtagggttttttttactgggcttattgggcctctaggcctattgggccagttcggtcatctcgggtatttcggttaacggagcccaataaccgaaatactcgaaataaattcggtcttttgctagctgggaccgaatagctactcgaaataaattcggtctcggtcttttcggttcagtctaattcctgcccaccccctatacgtagtatatattattccacatacttacatagcaaatgccaatgcacaagctgagattaactgccagatcatgtaactcattaactcaatagctatattatatttacacgatataatatatgtggaaggagattaattattacgagatacattgccaattaaaccagttgtacatgatttgaggcaagattgcataggtaataaaacatgtagtgcatgcatctggcagccctgttgtaaaaatattcaaaagtatactacaagtcacgacaagattaaatagaaaagttcgtataatataactttttagtaagacgaatgatcagacataataataataataataataataataataataataataataataataataataataataataataataataaatcaacggtatgatttattttatttaagaaaacaaaacattcatgaaactttttggctgcgaagaagaatatataaattggcgtttttttccccatcatgtcctagtacgtcagccggtgcagatgggcggtggatgaggcggcggctggttgacggggaggaagacgacgcgagggcagcgcacggcgatgtcgtacaccctgctgtagacgacgccgattttgaaggacacctgcgcggtgacgacaacgttgatggaaggtgttgtgctgatgagctgggaggcgaggaggttcgactttgtgttgaggctgtcccccaccaggagcagcgacgccttgatgctcgcccgctgcgtcgcggcggcggccggcacgtacgacgtgccgttgccgggcagcggcgtctggagcggggcgcggtacatctgcagctgcatcttgtctttctgtatcgtcttcgccaccaggtccacgaacaccttccggtactgcaccatggcgcggctggtggtgctcctggcggtgacggtcaggttcaggtagatgcccgtgtcgttgctgccgatggcgatcttctgctgcgtcgctctcgccaccgcgaactcgacgtgcaccggccggaggatgacggacacggttatcaccacggcggtcgcggccacggttccccccagagctgccagcacgatcaaatggcgccgggcttgccaagatgatgatgctgctgctttattgtcttttcccttctcctcctcatcatgatgatcacccatgcctagctagctagctatgatcactatactctgtgtgtgtgtgtataagctagctagctactagctcaaatgaaacgggactcatcagtagctactacactactactatatataaacgtatgcatgtat

SEQ ID NO: 18762 - DNA, 1101 bp, Oryza sativa
  unsure (1)..(1101): unsure at all n locations
atttataaaagcctggataagatggtttgtccctcacacacacacacacacacacacacacacacaacaaaaaataatttcacaccaacagaaactgggtcttctcgtggacaggccaccagcaactacagctagcagtacatcttggactgtgttgaacacaatgtatgccctgcgacggtttacaatattgccataacgtaatcaccccgctctaaaaaaataataatcacgtaatcacttggtacttcgaatattaactaaaacacatgcgcttgaaatatgtatacttattatcatgaaaaaggatttaagtctcccattccagtaatttctgttcatacgttgtatcagctggtaatctgaaatctcacattccagcgttacaggaatttcagttcatacgttatattcaaacgtttccaaattccaacacagaccggtagtcgtccttgactcctctcgccatttttcgagtatgcctttgagtcataactgcagcatactgatacgagaggatacattgacaaaatgaatttgtcagatgcctgatacacagagaatataattgtgatggagatgcaaaagaaaaatactacatgattgctaatttgatatatatgttccgggaaagccatccttaaccatatagtactagtatatgtcctctgggtttacatcctcctctgatgatgtagacacaagatcaatctcaatgtgtccaatgtgcatgcatgcatgtaagcaccactaatccttgaagttgcgtttaattccctacaacagatcctagagatagtagatccaatcactctttacacaaatataactcatcgatctctacccaaatagtaaattaaatataggtcttaatttatacaatagctagctagttacagaatgccgtaagagaattcattaacaaactgccaacttctgaattaactgacctgaagaatctgagtaacagaaagtcaatgtttagctggctagctgcccctgaaagtggatttcggcaatgatctcagtaaaaccttctaggcctnnnnnnnnnnnnnnnnnnnnnnnnnnnnnnnnnnnnnnnnnnnnnnnnnnnnnnnn

SEQ ID NO: 18763 - DNA, 628 bp, Oryza sativa
gaaaacctacacgctaccgggctcatccacgtcgttgaacaactttgttgcggcatttccaaatgttccagagaatacaaagcagcattgagtgtagtacgacttgagcgtatcctgaaggtcttttttatacgattatacggtaggcatacacccactaaaaaatactcacaaatctgcaaatacgtccctaaaacacgctcaaagagaggtccgtggcatacattttggaagcacgtgtactgaggcctgggcttaaaggcatctacaaggcccagtgccagccagagcacagctgcagcagaatccttcaaaaatccagcccaatccagcccaggaatttgttcacctgggcctgatcaccatacaaaaatcgaataaagcaaactgaatctctctggtgagccagcttggcagatcacctacctaccaattcgaacaaaagcatcccattatttgatcgatcgatcgatcgatcgatcaattagctcgatatccattagcaagctgttggtgcatcgatccatggttgtatccattgattaatttgattagctgcaagggcaagaacatcatatctggtagctagcttgtcgtcgcaatcaacgatggactacttcaacgggac

SEQ ID NO: 18764 - DNA, 1733 bp, Oryza sativa
  unsure (1)..(1733): unsure at all n locations
nnnnnnnnnnnnnnnnnnnnnnnnnnnnnnnnnnnnnnnnnnnnnnnnnnnnnnnnnnnnnnnnnntttggcaagggaccaagcccctttcccccttctttttccttttgcccgacaccgccggcgtcatcacctgccgccgccttggctgcacgcgtcgacgaccgccagctcgccgcccttgcatccttgaccgcccacgaggtcggtttcctccctccccaaaccgacattccccgcgcctataaagcccgagcctcctccccatatccctctcgtttttccctcgccttcaccgcgccattgttgccttcccgctgtccttgccgtcgccgtctgtcgccgagcaccgagggagccggtgcgagcgtgaacgcgtgacgaggagctctgggcgccacctctccctctcttctcccccggcgcactcgcctcgacgccgcgccgcctcggcgtcatccgccgtgcgccgccgctcggtcgcgtgccgccatcggccttccacccctttccatccccaaatcgccgccgataccgttcccgcacaccggtgagctcctcgcccaaattctcgccatctgcatcatcttggataagccccgagccattcggttgctcgctcgtccccttaaacatgccggcccgccgttgctctacttcgccgccgccgcgcccgcctgcgaggccgcctgggccctctcgccaatacctcgcgccaccaccgtncttgagctccctagggtctccccaaaccattccctagcgccgtcgccggccggcacagnctcgccgncattggcgtccgctcccgaaggccgctgctcgtcgccagccctcctcagtgattttcccgcccatacgacaccggaaacggattccttgaaccccggagatgcctcactccttttgaatcgaaccctcatcgtctcgtcgtgattcccctctttgctcgccggcgattgccgccgccacaatccgccggattccggccatcctccggcgaatctgagccgtcggctcgcttcgtctcgtctctccccttcccccggtgtgcttactttttccattgaggtcgcgccttgctcctgcgaacgccgccgccgtccgccgtccatcccggccggcctcgtcttcgtccttccgccgacccgcgtggctgccgccacgtcggcgccacctcggcacgaccgagtcaacagacccggtcggcccctcctttccgtttccccctccgtgcgcgcggaccacggtgtgccatgcggctgcacgtgggcccgccgcgcctcgatccgtccggtgcacccaaaaccctagcgcccgccccgcgtgcgccgcttccaccgtgcaccgtctagccgacatatgggccccacccgggaccccgcgtggtgggctcagtccaccggaccgcccccctcccttccgcgcgccctcatgggcagcccctcgcgcccgcgccggtccacttggttcggccgagccgcgttagcctttgggcagcaccaatgccaccgaacaagtctaatatacatccctccatccttttctttttccagggatttaataaatcctttttcctttgtcccataaatcaattccttattccaaaatccaataagccatttcctttggtcccgcatgacagtgactgttaataatattcttgggatattatttcttcaaaccccataaaccatttctcgtattccagaaaaatccgataaatcatttcc

SEQ ID NO: 18765 - DNA, 4088 bp, Oryza sativa
  unsure (1)..(4088): unsure at all n locations
nnnnnnnnnnnnnnnnnnnnnnnnnnnnnnnnnnnnnnnnnnnnnnnnnnnnnnnnnaagtctaatatacatccctccatccttttctttttccagggatttaataaatcctttttcctttgtcccataaatcaattccttattccaaaattccataaaccatttcctttggtcccgcatgacagtgactgttaataatattcttgggaatattatttcttcaaaccccataaaccatttctcgtattccagaaaaatccgataaatcatttccttgtccggaaaatcccattcgagcttccaaaaattcatatcttctcaaccgctcatccgattgactccgttccacttccagtaattccgtaaaattgagatctatttaatggcactactaattagtctaaataggatctatcttttggtcttttgtttaggttttcgattgtttgcgtatagttgcggttatcggactttcgtcgatcgcgggttttctcgaagattcgtgaagcttcgtgaagaccttgagcaaggcaagtcaccctttgatcaattgctcctataattgaaaagtaattattatttcgtttgcaacttgcattattagaatcacacacttaacttgcttggcctcggtttgcgtgccagaccgacggacctacccagtagtcacactaatttccgtaggtcgtactaccctgattccttgtcgctccacccttgtggtacctcggtattcgtgctctctgagcgcgtataccaaatatcccacatacaccgttgcttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaagtgcaaccacaaggtggaatgggacaccctggctaagtaactagacggttcagggaaacctcgcatgccaatagttgggaacgccggggcggggtcggacaaaccgggttcctggtaaggcaagaacgagaagcttgctcacttaccgatcaaggtggttggagtttgatttgtgcacgcctaaaaaggcctatgtttatgagaggatttgatccttctatgtggcatgaggtaaccctgggtcggctggggaaaggctttgttgcgaacctccgataccgacgggtgttcggaataagttcgtatcttgtgggtaaagtgtacccctctgcagaggttaactaactgttcgaacagccgtgcccacggtcatgggcggatgtgaggtggttcccgttgcgtagatttgtttgcctgtgctttgtaaaaagttgttgtggtgtgggaatcgtaaccagaatcagcctatgtggaagatgaatgacctgagtggtcagaaacgaatctgtgtgattcgggatgtctgcgggcatcatagactaggcttcccgagtgaaagcggattgttgtgctgctgggcagctggactctgggagtccgagaaaatgaataaggctctgggagccgcttaattaagtgaaatggctctgggagccgagaagtaatgatctgacccgggaggtcggtacattgctaaatgagctgttgaaaagcatctcttaaagtcgaatcgagacgcaagtctcttttcgcccaaacatagaaagaaataaatcacttagtgatttcaaaatgtcttcaaacaaaagatttgcaaaacaaccttgcctctcttccaagcttgcattaaacacctaagttcccgtgacttgctgagtacgaaagtactcacccttgctctataaatatatatatagttcctccgccctgaagagaagataaagtgaagtgaagattagggtttcgtcctggttcccagccgtcgcctgtggtgttgggtgttagtccgttggttccgctgctgctgctgttgttggtgtttcctcgtctgtgtcgtcggttgtattctcgggctgtctgagctgcaacctaagttaaggtaaataagtcctctatttatattaaggattgctatgattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacaaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgactgaacctgctcctgctacaacatttgcacatttggatgctactaccgtactttctagaggattagcttccaaagggatttatcctgcagtagatcctttagattcaacctcaactatgttacaacctcggatcgttggcaacgaacattctgaaactgcgcaaagagttaagcaaactttacaacgttacaaagaacttcaggacattatcgcaattcttgggttggatgaattatcgcagnaggatcgtttaactgtagcaagagcacgaaaaattgagcgcttcttatcacactcatttttnnnnnnnnnnnnnnnnnnnnnnnnnnnnnaaagtatgttgtcttgcagaaactattaggggatttcaactaatcctttccggagaattagacggcctacccgaacaggctttttatttggtgggtaacatcgatgaagctaatacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaatggtttagttgatacaaagaaaaagggaagaggggtagaaaaaattattagatagcgaagtaaagtagggccaatgctatctagtaatttttctacctacctacctactattggatttgaaccaatgactcccgccgtatgaaagcaatactctgaccactgagttaagtaggcaatttatcaccacaaaggaagaccctttacttcgatcgattatagatcgaatcctttttataagcaaataccgcttcgttattggtatgttattatagtataaacagatcaaaggatatcctctactattagagaatattcatcttgccaagaaattctctatatattaagatatctctgacaagggctatagctcagttcggtagagcaactacacgtgcgccaatgcttttcaaggtatatgtgagggaacagtgtccgaattccctgcagatggattcggatcctctgcaataccgcagagaggtactttaaaatgttagttagcttaaatatcgatttataggaaatcgatgccaagggctaaatacttcaaactttcagccaactgttttaccattaagctctgtatacagattaatctcaaggtgggcaaatagtttttggacagatgatgtttctgctcgcctnnnnnnnnnnnnnnnnnnnnnnnnnnnnnnnnnnnnnnnnnnnnnnnnnnnnnnnnn

SEQ ID NO: 18766 - DNA, 600 bp, Oryza sativa
tgtatgcaacttggacttggtggtttagaggcaacaacactcaagactaaaggatctactgtcggcagtggccgcaacgacgagcggcggcaacaggcagtggcatgtggagaccgcgacgagtggcaggcaggtgacgacctgcgacgaggaagacggatgacacgctcgacgagcaacaggcgtgggacgacgacttgtcaacttgatgcggcgaatgagggcatacaacgacgacggttggccctgcgaagcgcaccggtgaggatgacgacagccagatccacaacagccggcgaggacggagttgcgattgacgacgagccgcagctgggggacgactgggctgatgacatggacggggttgccgtcgccgatgcgcgtggatgcatgtggacgaggcaaggacaatgctcctggctgctgcctgcaacttggcggatgacgacttgatgagacgacgaacgacgatgctgtgcctgcaacttgacgaagatgacggatggcgacttgacaagaggacaagacgatggctcgccgacggcgagcccgccgccggcgcgccggcgagaacatcagatcgacaactagagtttggat

SEQ ID NO: 18767 - DNA, 783 bp, Oryza sativa
atcatgcaatatttgcggaaaagaaatacttagatttaaattataggtgcaagatgatcaaaggtgacttgccttgctcgagatcttgagcttgatcatcgaaatcctcgcactgcgggtcttcgggctccgaagctatacgcgaacgagacgactcaacaaacggtgaaaataaggccctattattgacctctaagtgtgccattagatagaactcgggatttgagaaattttggaagttgaacggagtcaaacggatgtacggttgggaagatatggaatttctaagattgaaggatttattgaaataaaggaaaaggatttattaaaatactttttgaattagaaactaaagagggaggggatttagacttcgcgggcggcttgagcgcggcccgagaggggttggcgtggctcggccatgctattgggccggccggccttgagaggcggcccaagggggctcgcggggagggtgaggggagagagaggttcaagatggacgcggtccatcgtgcggggtccggggcgggcccacgagtcagggactcggtgcacgagggagggggttcacgtggcgcggtgctaaggtttcaggagggggaggtgtggcgcacgcagggttcgcggaggaccgaggtgcgccgggcccacgcgcagactcttggctctccgtgggttgcgcgcacgagcggggcaacggagggaggtggctatccgaggtcagcccgactcggtccgaggccgagctggcaccaatgtggcgccttcgtggctgccacg

SEQ ID NO: 18768 - DNA, 843 bp, Oryza sativa
  unsure (1)..(843): unsure at all n locations
nnnnnnnnnnnnnnnnnnnnnnnnnnnnnnnnnnnnnnnnnnnnnnnnnnnnnnnnnaataacttccatataaataaagtaggtacgattttgatacaataaattaagaagttatgtgacaacttaattatttggagcattttttatataaatttaattttttaagtatttattttgacaatatagtagcgtggatttgtataagcatatttatatttttatcctaataactaataactaaaagttaataaaactggatgtaggaattattacattttggttgatatttgagaaggtgaagaaaacaaaaaattcttaaaggtaattggatgcaaattttatgtgcactataattcttaaagattaagttcaatattataaggtaatatctgattgatatttgagaaggtgaagaaaacaaaaaattcttaaaggtaattggatgcaaattttatgtgcagtataattcttaaagattaagttcaatattataaggtaatatccgtaggaatactgtgtaatggcatattaacatcgtgaaaaaaactcacctagcatatgcttcgccaagttgatgcaccaaaatactaaattgttaagttcttgtactagaatgcacccacttgtcaagttgttgtactcggacgtccaattctcaagttcttgcactatatcgttgttataccgtgggtgcaatttactaaaaaaacaaaagcgcccgggaggcgcgcagtgaacacatcggaataaaaaaaagacgaaaataaccaaaagccttagcgtgtgggcaaaaaaaaaagtctttcgcgtgcaaaacaaagtcgggaaaaaaccggtgaaaaa

SEQ ID NO: 18769 - DNA, 855 bp, Oryza sativa
aaagagagtccttataataacccaatacgatattaattaaaatttagaataaaaataaaataaaatacaaaatcagaaaaaaaaagaacagttcatgtaggaatataatttgaaaataactaaaattcgaaattaaagttaagcaatattgaaacaagagtccatataagaaacaaatatgatattaattaaaattcaaaataaacaataaaataaaataaaaaaacagaaaaaaataaaaaacagagttcatgttggaataaaatttttaaacaatttaaattggaaataaaattaagaaatatcaaaagaatagtctatatagaacacaatacgatattaattaaaattcgaaataaaaaataaaataaattcagaaaatagaaaaataaacataagagctcaagtagaataaaatttataaataactaaaatttgtaataaaaaaataaatactattgaaataagagaatctagaacacatgacaagattaattgaagttcaaaaataacaaataaaataaattttaaaaatagaaaaataattataagagttcaagtaggaatataatttatgaattaaaaatatcggaatgaaagatatgcaattttcaaaaaaaaaagtcaatctagaacacaacgatgacaaatgacaataaagagggaagaagcaataagcctataaaggagtagagtactagtggttgatgggatatctaaaaactataatcaaaaccccaaatagaatcccaatgatgattaagaggagtgacaatgggtatgtcgttaagcagcttggtcacgacggttggcgggacttatcgagcgtaaaaataaaccccaatgataatcatg

SEQ ID NO: 18770 - DNA, 588 bp, Oryza sativa
cggcctaaagtcctgatttaggaaaccgataccgtattggttaaggtttctatcttgtaatcctgccccccatcctatataaggtgggcaggaggccctctatggggcatatatgagacaacctgatcgtcagatcaatacacactcggcggattcaaatccccaaacaggagtagggtattacctctcattgagagggcctgaacctgtctaaatcctttgtctacacatacatccacttttaggtctcgtgcgctaccccgtgttattattgccgaattcatgtttcgacagttggcgcgccaggtaggggttgcgtcgagtttcctatcaacgagcgcgatggaatcaatttcatgagtcgccgacttcgctttcgctttgggagttttcacttactttccgtcgaccacttcttcaagctcctcttctctgacttgatccaaatcagtcagggggaaactcaatctgatttttatcattatttatcatattgatttttaatctcagattaatttcttgctattttttgttggtggtcgcatataactacgcggcactattgaggcgattgatgctggtcatgga

SEQ ID NO: 18771 - DNA, 785 bp, Oryza sativa
caattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagataagataatttattttctgctcttaataattgcaaaagtacccgagtagtaaactccgatccgtgaaactttgttccattaatgacgaacttatgtcactcatatgcatgtttggaaagtgcttaggccgactcccagtgcttggtggctatgactagtcgggcagagtgtttaaacgtaatgagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctacacggctggcctattatgccgccgttgttgggcgtctacgtcttcaccgaccggcttgccttcgccgccgccgactggtgt

SEQ ID NO: 18772 - DNA, 858 bp, Oryza sativa
  unsure (1)..(858): unsure at all n locations
nnnnnnnnnnnnnnnnnnnnnnnnnnnnnnnnnnnnnnnnnnnnnnnnnnnnnnnnnttgccaatcatgcacaccaaggggtgatcgatcaaaccatgcaggtggatcagttgtattcagctgaaatgacaagctagagcaagtaaaaatgatcataacagtagcagcccactcagcaagtatgttgcttgacattcatcatggccaacccatcatgccaacaagcaatagaggtgttcatgcatcctatctccattatgattgcattgacataaaaaaaaggaataaaaaagtttatggctggttaatggtaatggataactacagctcataagttggcaggtgatggagggtggtgaccagttgttgcaaggatttcctttaaccatgtattagtacctctttccgtcttctcattgttaaccttatcctccaattgtgcttctagcacaatctagaagcgaaatgggagagtgaacagatcaagcataccctattcaagtttcagttcatcttaagcccaaatctcgcttctagaatgatctagagacctttggattagactagcctctcttatcgcaattcaagccacaactggattcaggtacggactaaccagtagcagagaagggcggaaacggaacaattgaccatccagtgtgtcagtacttcctagtccaaagtaagaaagcgagctttattgaactagaaactcgtgatctggaagtttctagatccacgcaccgagatttgctcaagcgacacaccccggatcccgattcctctcgatctacctcggaaccagggagcctattgcctagacgcttggactacaaaattctcgtcccagaacccgaa

SEQ ID NO: 18773 - DNA, 2946 bp, Oryza sativa
  unsure (1)..(2946): unsure at all n locations
nnnnnnnnnnnnnnnnnnnnnnnnnnnnnnnnnnnnnnnnnnnnnnnnnnnnncattaaacacctaagttcccgggacttgctgagtacgaaagtactcacccttgctctataaatatatatgtagttcctccggcctgaagagaagatatagtgaagtgaagattagggtttcgtcctggttcccagccgtcgcctgtggtgttgggtgttagtccgttggttccgctgctgctgctgttgttggtgtttcctcgtccgtgtcgtcggttgtattctcgggctgtctgagctgcaacctaagttaaggtaaataagtcctctatttatattaaggattgctatgattcatatttgtcaccgtgggtaccagcactatgtcctgggactggtaccgagatcgcggtttcgtaggaagcggttcgcgccgtttttcctacgacacgctcctatcaggtgccgttgtacggcggtatcagattggggtgtgacaagagatggtatcagagcataggttggccctaggatcgaaacccctgaataggatggcattatctgaatacaaaaactatttgtgaaagctaaggtgtcgttgtcccctttagctctagttttgcgaaaaatcttttgtgtccaaaagtaaaagctagtcgttcgttttgacttttatcctagagtaaacctatcttcacgcccagttgaagaaaggtgtgctcaagcctttaggagtcttagttaagcccttgttggtaggctaaccttagtaccgccacccgctcggtaggagttgtggtgaactagtgcgtgtgtgagttttgtttggtagtccgtgttcaggtgttaaaccaattgggttaccggctggaacacaccacctatgtcttctgtgatttcaaaaaccgtttagatgtagggttttgattcccctcttttttaatcaatttctgggtgggcagatctcagcccttaaaagcagatgggacgtgttccacccgtaagatccgtgcccctaaccgctttggttttgaggaagagccagtccagccagaaattcccgatcaaccagttaaccaggcagatgagcaagaagctgagagtgatcatatggctgtttccggatcagttaatgatgtctcaagaggtaaccgacccccgccagtggactttcaccaacacatggccatgcaaacacatataatacaaggaatggttcagaatataattgctatgcaacaacaacacacacaagagcgtcaaccccatatggttcaagatgatggccaatcgaaactgaatgatttcttgggatctcgtccaccggagttctcccaaacaaatgagcctattgaagctgatgattggattaaagatatggaaaggaaattaaatctggtacagtgtactccgcaagagaaaaccctttacgccgcacatcagttaagaggacctgccgcagattggtgggataactactgtgctacccatacagatgctagtaccatcgtctggacagagtttgcaggagcctttcgctcagcacacatccctgaaagcataattgatttgaagaaggaagaatttgcaaatatcaagcaaggatcctcttgcatcaacgagtatttgagtcgcttcaatagattggcccgatatgccccagaagatgtagacactgataaaaagaagatcagaaaatttttaaaaggaatggacgcgaaactgcaagtgaaacttttggctcacgactttccgacgtttcagcaaatggtcgataagtccttgttactagaagatgcagaagaagagatgcaggaatacaagagacgcaaagtaatgtccctagagattcaagcaaaagaaggtttgtgtcgaaaaacaaacttgccagcacaatactatcagagagcatctcagcattcaaatggttccggttctacgtctcgttcgactatgtcagaacctggtcagcaagccacaatgatcaacagtaatagccatgaaggaagcaactccgtaccatgccctacaccttcaaaaagacgtggttataaggcaggagtcgaatgtttcatctgccatgagatgggacactattcgtgggattgccctcagaaagccaagataaagtgccttcacaaagtcaagacaaagccagtccaaccaacgacaattcttcccaacatacctggatcaaaaggctcgaagtcaccaaacagtggttctgcctcattgacctcactgcccgttggacaaggtcgtctgaaccatgtgcaagtagaaacaaatgaaaaggttgtgaatctcgagcaagttgaaggagcaggagaagaacaggttccacaggcaagagcaaagccacagtaagatgaagaatgctaagtgaatcaagttaccagaccgttttgtggcaagtacgcaacaataagttgaagaaagactagcagagtctgaagctgtgaagaagtctgaagatcccttttggtttcgtgtgtgtggtccaccttcgaatctcggggtcgagattcttgtaaggggggtggatctgtaacgctccgtttttcgtgagtcgtaaaaaaaactaatttggcaaaatcctaattgcgaaaattttcgttctttgtgtgcgagtctaagttgtgccaagatctcaattcaaatcccgttgttccctctcatcgaaatcaaaatcctccgccttaaatctgctatgccaattcaagtctccgttatctaaatccgaaagtcaatcccttcctttgaatcctcgccaaatacatttccaaatcccaaaatgtccaaacccccgttttgtttcctttccttgactccaccctatgttcccgagaacaaatacccaagttttccttttgaatctttcccatgacttctccttgaattccccttgatacatccctaaaccctcgagttcgaatatcaaatttgaattcga

SEQ ID NO: 18774 - DNA, 1750 bp, Oryza sativa
ttcaacctatatgtttgggtttcgagggttaggaggtgatgaaggtagtaggaagtaacaagggtggctttagaggatggcctaggacgtggtggacacaagtagacaacaaagtgaagccatgagtttggagaagggtagtagcaggggcatcatatctacaaaaggttaggaggcagagacgtctccacggcatgaactttatgttgctaagacaacgaagaacaacaggggctagggcaccttgccacttattagcttcaagagaaaggcgcctgggggggaggggtaagtcgagatcggtttggtaggcctcgctggtgccatttgcaggctcttgcactagctaggcagaaggaggcgatgcatgtggggaagagacaatggattacaagggaaaatgtgattacgtcgatcgacaacaatataggaaaataaggagatacagttagagaaacatgtgttacatgaatcttaaaatatcttcctatctaaaattggatgaatttaaaataggtatataaacattggacattctctagatttaatcattctcaaatgttggactgccgttttctttttactaatggaaatggcctactgtggtgtttgaatcttctgaagatgaagataaagattaagtatttcacgcaaaacgaggtggtaataatatgtgattaattgagttttaattattacaaacttgaaaaatgggttaatatgatattttaaaacaattttcatatagaaagttttcgcacgaaacacaccgtttagtcgtttgaaaagcgtgccacgagtatacaaaatttaatcctttacttgcagaagaaatgaacatggcctttggccaagatacataatagtggtattgttgcgctccttatgccctatttaattcagcttaggattattataatctggattattaggagtaagctgaaacaaacaagtaaattattatgctagattattataatctataagtcagattattataatctaataatctcctctagagaagctttttctagattattgagtggctaaagacccagtacccttagatgcctctaataatccagagaaacaaacaactcgtagtttattttatatcagcttattataatccagcttagagtaatctgatttaataatctagattacaataattttaagctgaaacaaacatggctttaatcacttctgtattaagagatgaaagctgtattaacaattttccactcgtacgtggcgtgcgcctgcctgtttgcccattgccatgagcccttgaggccttgacaggtgaaaattggttagcatgttcggactctgggtcgtggtggtgagctagcggccgacccgtttgcagcaattggatgcatcgatattaccaattcagtcaagggtcacgcgggtgctagtcgagtcaaaagaaagccggcctaataccgtgcagggcccaagctaacagcacagcactggaccatgcgtcaatcctaaccacgcagtcagatcagctcatcagcaccgtacaagtacgacctcaccaaaaccatctcgaaattcacgcacctctctctcgagcctgaattggctggcacaaaccatggcacttgagtcactctgccatactgataccgttttaagcgtaggagtagttagaatgcccaagctgtttcaagcctgaattcgcagtcacagtgttgtctcacacatgcccatagtcatggcaacagcatggcggatg

SEQ ID NO: 18775 - DNA, 339 bp, Oryza sativa
gagagtagagtaaaaactcaggaaagaactgagggccaggggggcattcatatcccggtggagcggttggaatgctcgtctaaaaggcagctactagtaatttacaagggcgaatacagtgacaaaatcgtacctaatacttcgatgttaatcgtgcgggcaggttgagcttataaaattcaccaggccacatgctgcgtttgagcacgaacggcgggagggtcaagtcgttaagattaccttgcggctacagcatcagtcgccagaccagagcccaggagttgacgaagcttgggcgtggcaatggcatgatccatgtgcccgctgcttctcggcgtg

SEQ ID NO: 18776 - DNA, 656 bp, Oryza sativa
  unsure (1)..(656): unsure at all n locations
ctatagggcgaattcgagctcggtacccctatgatgcccgcagacatcccgaatcacacagattcgtttctgaccactcaggtcatccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctctcataaacataggcctttttaggcgtgcacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18777 - DNA, 380 bp, Oryza sativa
tgctgttattttttgggattaattctcgagtcgctagtatggttttgctaaatagattgctggagctctttgcattctttttcttttaaaaaagaactacacattcattccagagagaaacagaacaagacccgtcccagaaggacaccctgagatagcaacaaaacacctcaccaaacaccactgtcaggacacctaaatgcaaagtacctagatactcaataaaaaatgagattcactcttgagatcaggaattttcagctttcgattcatgggatcgtttcttcttgaattaaactatagacctataatccttaataaattgtcaggatgataaggaatcgaagcgcgagagaaggaagcaatcaaacagggagtct

SEQ ID NO: 18778 - DNA, 404 bp, Oryza sativa
accagcttaatttggcagcaattttattcaccattggagcaccgcagaagcccttggccttcaataccaatcgatataaagaatcaggccacgacgatcacgaatgctgatcagcatctcctgatgttccttcgtgagatgggacttccaatccagctgaagttgaaaggtttgcagcatcattagagctctaggctttcaacaatgatagtacccaaaaaaaaaagaaaaagaagctggacacatgaagcatggggatgatgcaatgcaatggatggcactgaccggactgatcctcagagtcaccatcctcagcataggcgaatgccggacgaatcgacgtagaggcgaaaacatgttgttaatgcaccatagacctaggctcaagtttctgagattcttga

SEQ ID NO: 18779 - DNA, 670 bp, Oryza sativa
agctgctgtctaataatgctaattcagttatgttgccagtgttctcgaatctttgtagtatataacaaagctgtttcctggactgtgctatataaccgaataatggtttggtagtgattgtcttctcacttatcactaaggtgttcttttacttcattctgaaagaatatcacttcaattataaattcttatggtttctggttttcagtctgaatatccattaagttctatagctttacaacagcaccgagactgactgaagaatgtgacgtctatgatatgcaatatgcaggtggcgtttcgcaccaaggttttccatccaaacatcaacagcaacgggagcatttgccttgacatccttaaggaccaatggagcccagcactaaccatttccaaggtttcctttctcgcttaacgctattttacttttgcgaggcggttgcttggtctctcggcgttgggctgaacgaatcccgcaaaaacatgtgctctctgcttgctttcaggtgtggctgtcaatctgtccctgctgactgatccgaaccctgatgatcctctggtccctgagatcgctcacatgtacaagacagataggcacaagtgctagaacacagcgtggacctggactcagaggtacgccatgtagcacctcaaatctctgtggacatgt

SEQ ID NO: 18780 - DNA, 806 bp, Oryza sativa
  unsure (1)..(806): unsure at all n locations
actactttgtgatagaaaatggagaaaactgatgaagaaatcctatagtgatatatccgatggactttgcggatttatgcgctggacccatcttctcctttaactctcgtgattccttcaacaacgaaacatgacaataagattttacaggtaaagctagtgtaggacgtgggggtggatagagggaggtcagtgcaatgacggcccaatggcgggcaataggggaatcaagaaaacctcagttaatggccgctcggcggtgatagaagaagaacaatgtaggggcacctatgagaaggggaaataacagataaggagaagaagttaaatcaggctaaagtgacggaggaaggaggggcatagtttgagaggggtgctacagttgggcaataagactaaccatgaattgacggaggggttagtagtgcgctagataggggccaccgggccaggttgtggcctaccttactgtctagatatatagcaccttattgaaccatgatttggcggaacaacgatattgtggagattagagaggattgttggtcggtatgacgttgccaaaatgatattgtttgataatgggtagttttctaattcattacagattatctatgtgtgttcccattggtttcttttctggtatatgatgctacgactgaagggaaaagatttatgtgtaatggaatgtgttaattaggatttttttttgtttcactttctctctagatgacatagttctcttagatttnnnnnnnnnnnnnnnnnnnnnnnnnnnnnnnnnnnnnnnnnnnnnnnnnnnnnnn

SEQ ID NO: 18781 - DNA, 4722 bp, Oryza sativa
gaaagtactcgtggtctttcattatcagctgctgctctctgctaccaaattggatagaatcggttaatctgcagttccttggcaaccaccattatatcttttgctagcatatcaatgtcatctacaaatcgattttctttgttttctatctagtgtatccattcaagttctgctgcagccacgagcctcttctcggcagttatcatccacctctgctctgctcattctctatccattgctttgcatgttgcgttgctttgaatttattttgggatatgcatcaatgtttgattattcatcaccttcatcttgtgccaccactattctccatcatcttcagactgttgtcctgagtcttgctttgtccaatgcacatgtggcttgttggtgattgattggttgtgccaccaggcacatcaattgttgctactgctgtggtatatcaatatccatgtgtcttttgctactaaattagtatcatttacaaatcaatttcctatgttatccattgaatccagcaaattccattgcatatccttcattttgtcaaagttgtgccagtccatctcttcattgtcatttcatcatgactagctccacagagttggccttcatcatatcaccagctccccatcggagttgatatcaacatcaatcaatgaaggaccgaagaacaatttgtgaaggtccttcatcatcaccatcgtcatcgtcatcaaatatgtggagatccgaagaacagtttgtgaagggccctccatcatcatccacgtctctgaatcaatgaagagccgaagaacggtttgtaaaggctttaaggtactgagaactgaagaacagtttttgaaggctccgaggtccacttcattgaggaagagatacatcttttcttcttcatcatccaagaattgacacacttcgacgacatcatcaagactttggagatagaccaatatttagcttgtgttctcatatttattttacactccaaatgcaatgtgtatacacattgcatttgagtgggggtgttaagatattaggggtagtttagtattttcgcatcacttgtatacatttatatttgccctttagggttagatcaatgttactgttgaatccccaaattcttctcctaaagtcacaatggccagcaccaccgttgccggcaccgtcgtcgcgagcaccgcggtcaccgcgtacctcgccacgcccagccacggcaacttggtgcgcttgccgtcgccacccatggtctgcactgtacactgtcaagcacacgcatcgcctatacttgtcgctagctttatatatgtgcaacacgttgatgcaatcgccaaatcgccattgtcaccgctatgtcatctctccaatgttcgatctctgcaggaggaagaacttgttctgctcacatgtcgtttctgtgactgtgatcgaattgacagtccacccactaatgcaatctgctaatcacgagctgtttctgcatgcaagaacttattctgctcacatacattgatttctcagcttaggatcagagtattggtcattactccacctcatggtcctaatcgaaattatacgcactgctaatatacagtaatggctttattcgttgtcgctttcatcgggagaggtccaaattttaaaagaaactccactactctttgagtcccactccgatatgctctctactggtagtagaaaataatctgaaccattaatttcatttgatcgaatggttcatatttatttctactaccacctcacttaatggtagttgaatcatagaagggtattattgtccagggaaaattatttacagaggggtataatcatcttttagactcactaacccaagctgccctctctcctcgcactcgccaccttagccgccctcgatgactcgtccgccctcgccgccttcgtctcactcgcctcttccgacgcctgcactgccgcctccaccaccgtccccgtcgagcattttgtttgcatcgtttctgacatacgaagctgcttgcatgccattgaaattgaacaggctaagggagagcttgctgaagaaaattgacagcagcaaaacctgacaacccattcattgcttagccctaactttctatctaaaatatagtatggtttgtactgtatcactgtcagtgcatttagcaaccatcgagcaagtctacagtaaaacgatctattatattattaaagaaatagaaaaaggagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaagaaaaaggagcctccacgttcgctctcatggcctagaaattctcacattaatcagagaaaaagaaaaagcagagtccatatagaaatacaatttacaaatagctgaaattcggaattaaaaaataaggaatattagaagaggggactagagtccatatagaaatacaatttacaaatagctgaaattcggaattaaaaaataaggaatattagaagaggagactagagtccatatagaaatacaattagaaaatacctgaaattcggaattaaaaataagaaatattagaagtagagtatagactccatatagaaatacaattaggaaataactgaaattcggaattaaaaataaggaatattagaagtagactatatagtccatatagaaatacaattaggaaaaaatagaaattcagaattaaatatataatttaaggaatagaaaaaggagcctccacgttcgctctcatggcctagaaattctcacattaatcggagaaaaagaaaatacagagtccatatagaaatacaatttaaaaatagctgaaattcggaattaaaaataagaaatattagaagaggagactagagtccatatagaaatacaatttagaaagaaatttggaattaaatatataattaaaggaatagaaaaaagaacctccaagttcgctctcatggtctagaaattctcacattaatcggagaaaaagaaaagacagagtccatatagaaatacaatttaaaaatagctgaaattcggaattaaaaaataaggaatattagaagaggagactagagtccatatagaaatacaatttagaaatagttgaaattcagaattaaaaaaaggaatattagaagaggagactagagtctgtctatatagaaatacaattaggaaataactgaaattcggaatgaaaaaaaggaatattagaagaggagactagagtccatatagaaatacaattaggaaataactgaaattcagaattaaaaaaaagaaatattagaagtagagtatagagttcatatagaaatacaattaggaaataactgaaattcggaattaaaaataaggaatattagaagtagagtatagagtacatatagaaatacaattaggaaataatataaattcggaattaaaaataaggaatattagaagtaaagtatagagtatatatagaaatacaatttagaaaaaaaatagaaattcggaattaaaaaaataaggaatattagaagtagagtatagagtccatataggaatttaaaactaactaaaatttggaataaacataataaaattaaaagtagagtttagagtctgtataaaaatacaatttacaaataactaaaattcaaaattaagaaaaacattggaagaagaatttaaggtcaatataggaatacaaatattggaatataatttagaagcaactgaaattcgaaattaaaaattaaagaatattgaaagatgagtttagagtccacatagaaatacaattagaaataataaaaattcataaataaaaataaataatattggaagaagagcatagactctatataaaaatacaatttacagaaaattcggaattaaaaaaagaaatattaaaagacgagtctagagtccatataggaatatatataatttacaaataactaaaatttgatattaaaaataattaataactaacacgtatataaaatataatataaatattacacattagtagttttgtaaagttattgcaaaatttaaaattatgttgtcattttaatatatttgaataatataatgagaaaacatatatactattatatgagagaaaatataatgatgctagccgcgcaatctgcgcgggccactatgcttgttttgctatataagagtatacaagggtgggatttcacttaaatatataagagtggcagcttagcagattgggatttcacttaaatatataagagtggcagcttagcagattggggattcacttaaatatataagagtggcagcttgagggcaaaatatttacttcatgcaagcgatccaccagttactagcactgcaagttactagcat

SEQ ID NO: 18782 - DNA, 12050 bp, Oryza sativa
  unsure (1)..(12050): unsure at all n locations
nnnnnnnnnnnnnnnnnnnnnnnnnnnnnnnnnnnnnnnnnnnnnnnnnnnnnnnttacttcatgcaagcgatccaccagttactagcactgcaagttactagcatagtggtttgtaaaacgctctcgcatcgccctcccctaggggcagcacgggaggcatcgaaccccggccgccccctccccccatcttcctcctccgcctcgccgccgcctgagcggccgccggcaaagccgcgcggccacaaggacggcggcggcggggctcctcgttcctcgtcgagctcgcctcgtttcgggcggcaaggggagcagcccaggacggcggcgacggtgaccgctaaatccgcgccgcctcggccggatctggcggtgtggcagctggcggctggcggcggagacggagacggagacggcggcggggatggcgacggcgacggtagaggagcggctgggtcgacggcggcggggatggcagaggctgggtcgacgccggcggggatggcgacggtggcgacgtcggcagaggcgccggatccaggcgcactggaggcgggtccggccccccagcggcggatctggccacccggctgccggatcgggcgagctcgtggcgggggcagcagagctcgcgacgacgtggtggcggtagcaaggcgagctcggggcaggagcgcccgtcgcggcggcggcggcggcgtcagccgccggcaggagctcctggaggtggtgctgtcggcggcggtggccgccgacggcggacgcagtatcggcaacgtccacggcagctctcggccggatttgggtgtggccgagtggtggtcggctggcgacgtctgttggcgacagcggcggcggtgtggtcgtggcagttggcggcggcggttgctcgctgcttggtggtggagggcgacggcgcagcggcggtttgcggtggcggtggctcgtgtcggtggcagcggcgacggcggccgtgactgtggaggcggtggtgacgtcggcagcggggaagtagtcgggtgcgaggtgaggatggcgacggcgaggtggctgagcgttcggcagcagcggctgcggtggtggtgaccgtgtctgcggtcatcagaggcatggtggcctcagacggcttgccgagggcgtgggagatggctgcatctggctagcgcgacatcatttggtggagaggtcaaagaccggcttggcgcagagaagcgcagtcgatggcagcggaggtcggctcggcgcgagaggcacgggcagcggagatggaggccggcttggcgcgagaggcgcgtccggtggaggaggccggcttggcgcagagaagcacggccggcggtggaggaggcgacctaggtgtgaggaggagctgctggtgtgtatggagtggtcttcggcgcacgaaggctggccggcggggggtgccggtgcaggggtcctatatgtcggcagagctagtatggtggtggagcatcggtgcgctagccgtgggtccctttgttagtctagtggcggtcgatcccgcttagcggcggccggtccggtgctagccttctgctgggcttgtgtgttggcgatgtcggtgtgtgggtggtggtataattttttctttttcctggctacaaccctccagtgtcataatcttgtaatttttttctgttttatcaatagaactcgttaaaaaaaaagttacaagcatgattcttcagataagcccattcatctctgaaacggaatgccacacatgcagaagaatgcaacacataaattgtgacatactagctagggtattaatccatatccatatctgtaacgaagtgcttcatatctagaagaattcagatacatgcattggaccaaaatatcatatcggtcgccctgcacccctgtgaatgacaacccatgcgtgtatggctggttgacagcagcaaattagaagaggttttttaaagatgagatgacgaattcgaaaagggttgtacagtacagttaataggcaaacaaattaagttttatttcttcgtgcatatatatatatatatatatatatatatatatatatatatatatatacccacatggatggaagagtacatatcaaagcaaccgctaatctggctcatacatgacgccagccagctgatcttgtagcacgtgtacgcatacgcaaaaataaataggaggaatcaaattaaagacgcgagcgctcgagctttatgaaaattaaaaggtatcaccggagcaagagcagctccggcctgtagtagtagagtcccgatcgagacgtcgggggcggcgggcggactcagcaggcggcatggcggaatccgacgagggcggcggggatgttgtagagcacctcgagcgtctgaagctggatgttgccgatgatcccggggacctggtcgttggggccggcggtgaaggcgaggcagccctggaagaggacgcccgacggatcgagctcgacggcggcgttcttgtcgaacacaagcgtgatcctcggcagcgcgaagctgcggacgccggccatgtcgtagcaggtgtcgagcgggcccttgggcggcgccggctggtacatcgccatccggtccctgaacgcctgcctcagcgcctggtacgccgtcggcggcagcctggtgatggcggtgcgggagtcgagcgcggcgccggcggcgaacacggtgggcggcacggcgatccgctgcccggcgacggcgatggcctcgaggcgcaccatgtagaacgtgggcgggatggccgggttcttgagcatcggcgtcagcacgtacctccaggcggccaccctcggcacgccgagggtgaagaatccccggcgcgtcggcggcgggaagcagtgggagaagacgcggccgtaggtcgccgccgtctgcgacaccagtgactccggcccgccgccgagtgccatgatcccggcggcgctgctgccgaagctgaagctgccctgcacgccgtggctgcagccgaactggaagctcctgactgcggtggcgggggtgatggtcagcaggtcggagatgtaggtgcccgccgtcgacgtgccgtcggggtaccggacgcggtactggcactggttattgttggtgcagccattggcgtaggggccgagctgggtgcacgtcggcgagttgcaggagaagacgccggacgacgacgacttggtggggtcgtagaggacgtccttttgcgggtagcacggcggcgtggggcacggcgagcactgcacccatgtcacgtcgctcgccgtgtccagcaccatcgtctgggtcactcccggcccgccgccgccgccgccggtggcggccggattcatcgcctgagatcggacagctagcatgtgagtacgttttaatatatttcgatccctcgaggagatgtccggtcacgttgttaatttgcatatcacttaaatggttatgaaaaagtaatttgacaagatgtattaacatgtaatatatcactgcacaaataatatgtaagatcaaattgaacttctacatcttaaaaaagaagtttttttaagaaccacagcagggaaagccaccaccgttaagattttattaatatataaaagaaaaaataaattataacatcagaatccagttctttactacatcttgatctctcatttaatctaaacaacaacaacaggaaatctcttcctcccttaagaagatacttccaggaagaaaaaggaaaattgtaaaaaaaaaaggttaaatttatttttttcgttactatacgtagaagttgaatttgaatttgataagcagcatgtacgtcaataatgtaataagttctagatctattattcttttcatcagatcaatcaataatgcataagaagttctagccaattttattaatattatatattgtgggtaattattaaccttttttaattatataaacttagctttctaattaattactagtaataggttaattattattattgttatataattattttacttctttttgcatatgtgtgggttaaataattttacctttgatgacattggtgcaggtgcagggtagtacgtgccatagttaagatctccttctatggactgctgttcgtagttagttgacaccggcacgtcgtcggccggctgcagcacgccggcgaccgagccggagagcctccactgtatgtagtcggcgcggtgctggtccgaccagagcatgccgtcgacggtggacggcgccgccctacccttcgccggcgaggagctgcacggcccgtacggtcggctcaacgggacccagttggtcacgttggggtgtgggctcactaacatccacgtacaacaattatatttattaatatgatatattaataataattattattaaatgccaaaataattcgtttcatttgttagagaggttatttaccaaggtaaacaaggaagaatatatagttaaaagttgcccaacgacggcaaagtctagtaaagagtcgagaagataaatgatttatatttataataggaggaaatagtataattgctctgacttaactacttattaaaaacgttcaagttttaatcttaggtactactacctctgtttcatatataaagtcgtttttattttttttctagtcaaagtttttttgtttgattaaatttgtaaaaggacgtagcaacatctacggtcccaaattagttttcaattaaatgtaacattgaatatattttgataatatatttgttttgtgttagaagtattgctaattttctataaatttggataaacttatatatgaaaaaattacggagagagtaggaagaagagagagaaaaattaagacggtactcaggctggagcagacggaatttggcttgagccagctgctggttagcaccacgatgtagttgacctcatctacacctgcactgtggtcagcgagagatgtagagccagagagcacaacaagaagcaacagtagcaacggcactagtgctgcacaagccattgccatagccgggccgctcctgtatttgtgctgtgctactgatgatgatgtgctgtgccaagtctagctagctccctgttcgactatatatagggggggggggggcattaaaggcattatatatatggcgtgcatgtggtacgtagggaataactttacaaaataatggagagttgttgttgatcatatctccaaggcagatgcttattattactctacttactaattactctctccatttcagaatataagtatctaactagatgggatactacaaatctagacaagctacctattcagattcataatattagaaaatattttatccgattttaaattcttatattttgggatgaagatagtaaagagttaacaatttttatctcttttttcatctcgtaagtcattttagctagtcttattctaagtcaaactcatttaacgatgaccgagatggttgatgaatacaacatctaaattaataaattaaataaatacactattaaaacatatatcatgcatggtgtgtttgtggaaatattttggcgttttatattggtgtattttttttataaactcgatcaaacctatattagttttattagaataaaactaatgacttaaattatgaaaatgagagagccatataatatgggtgctaatcttgaagcattaattgatatacgctcgaggaagcacccatatttatgtgtaatataaaaacttgcctttattaattgagccttttgatttaagaacatggagaagataattcttaaatagcactctagatgcttgattgcatggataattggacatattaagaagtaagatggagttataatcgtgatcgagttctcttatgaaggcgtcggcaaacggcaagcaaccaagattcctgaggtgctagctgccttccgaggtcataagagtaagaccctgtttggatctatagactaaattttagtcattgtcgtatcggttgttttgataataattagaagtattaaacgtagactaatgataaaacccattccataaccctaaactaattcgcaagatgaatctattgagtctaattaatctatgattagcctatgtgatgttacagtaaacatgtgctaattatggattaattaggcttaaaaaatttgtctcgcgaattagctctcatttatgcaattaattatattattagtctacatttaatacttctaattagtatccaaacatccgatgtgatagggactaaaatttagtccctggatccaaacaccacctaagttgtttttctaaacacgatacaacactacaagaaatatgaccttctgtgatgaatttctcgtgacatcggagctattagagacgcatgataggtgacggatgaattttcgtcacgcgagcgtcacatattacaaaacgtgacgaaattttatgttttttgatgtaaatgaagcgtcatctatcataagatttcttgtagtgaacacaagcggtcacaaatgtacgcacacccacgcttttgaatagtggcagcagtagaaatttttcaatgggggtacaaagattaaaaatataccgagccataactaaatatgatatactagtgggctacatacccaaatccggggcaggaaggagagcgccatgcacgcagagatgtcaacgccttcacaaacctacttcaaagattcggagatgctactggtctacgcacaaactttcaaaaatccttggtggcaccgattaggtgtgatgatcttgacatcgataacatcctggaggagtcgtaggttacacgtgcaactttcccactaaaatacctgggcctgccgttgatgctagggcggctgcacaaggttcacccacagcccctcttcgataagtcagcagggcgcatggcgggctggagagggaaaaacctgggtctggcaggaagaacaaccttggtcaaatcagtgctcacctcgcaaccggtttacctgctaacggctctcaaggtgaacaaggatccctcaaagtcctggataaacaacgcaagcgtttcctgtgggctggttctggtgatattattggaggcaaatgcaaagtcaactgggagaagatctgctcaccgacggtgaatggaggtttgggaatcctgaatcttgacaagttcacaagggctctaagactccgttggttttggcatgagtgaaagtcaccagaaaaagcgtgggcggggatggagacaccgtgtgaccagaacgataaactcctattcgcgtctgctttgaaaattaagattggtaatggagacacaataaaattctgggacaacgcatggcttgatgggcgctggccgaaggatgtggcaccactcgtgttctcgatatctaggcggaagaaccgctcactcgcgcaggcaatcgaaagcggccagtggctagatgaccaagccttacccatcaatgatggaatgacaattgagctcctgaaccagcttgtcactctctggacgacaatccaacaggtcacactttccccggatgaagacaacaaaatcacttggaagctcacgtgtcatggagaatacacaacgtcctcaacctacaaggcacaattcttcggatcgctcaaaacaaactttgaaaccttaatctggaaagtatgggcaccgtgcaaatgcaaaatctttgcatggctaatcattcaaaatagaatctagacgtccgacagattggcgacccggggatggcagaacaacgatgtttgcccgctatgccgacacactaatgagaccgctattcacctgctggcagactgcagatacaccaagaaaatatgggatgccattgtcaaccggttagcctgtgcgcccatggcgccgacaaattgggcacaggcgagcgtggttcacgaatggtgggaatctctcgccacatgccaagggttaccaaagctggggaccagatccctaattctcctaatctcttgggaaatttggaacgagcaaaatcgccgaatcttccgaaacaaggagctaagcacggcgcccctcaccgcaaagattaaagaagagtaaaaaacctgggctacggcgggaaccaaacgcctagcagagatgttaccttagtgcctattcggtctttgtaaatattacttttactccttacatgtaaatattgctccctgctttattcaataaatggcaagctttgccgttgttaaaaaaatgatatactagtacagaacaaagcatcctgaacaacccatctatgacggcagtcagcagcccgttatagaggcactcatttatgacgggccaaaaaaatccctcttgaatattggtcctcatggccaaacccgtcaccgatgacccctcatctttgacgagttgaatttgcagcccgacacaggacatctgtgacgggcctcaaccaaaccccatcaccgatgaggggtcaacggtgacgggtgcaagctattcgtccgttaccacctaagttgaattagctctaagttgaggggtcatcgatgatgggcttcatttaaggaacgggttttagatatatatcgttagagatgaaaaatcacatctaactggtttgatttttaacctgtcactgatacgacggtcagccgatcaagatcaagatggagacagtgcgccttatctattcgagagtctttttttttacggttaaaacagcaggagaggctcgtactgcacattttattaaaagagccaatatacgaggggaaactgtacaggggtacaacaagagggaaaaaagaaagaagaaaaagactgcctgaaaggcaagctaattaagatatgctattaatccatgattgccacaaaggtttttctgtttcctttacactatgcatatgcagagtaaactcatccttgaaatcagccttccatttgccaaagtttgcttgaataccattgaagatcaagtcatttcgtctactccagagatgccagcaacagattgccaaaacttccataaagaagggatgagggaagttcctattcgctgcaatgatcatgttcatgaaattcaggtttagatcccaatttataccgaggatatgccaacattgctgggcaaaggggcagacgaagaagagatgaagagagtcttctgtgattgagttgttgcatgtaacacatgtagctccaccttgggtattgaaatgttttcattacagcaactctttagtgtttaatctgtccaataagaataaccaaagaaacactttgaacttgagtgtgcatttgcttttctagatgagagttaagggaatttcaggttgaatatgagtaaaaaacatgtcataaactcttttcgattgatattgaggtgagttccagatgtatgtccattgatcttccatatgatttaaatttaaggtttgcacagtgctggaaagaaggtgccattcctgaattgcttggatggggagtggagtataaaatacctcttctaagtgactcagagattgaaaacctttgacacagatgtccttatttttagcaaatgagaatagggtgctcgatcatcatgtaaaaaactccctgaccaattatccttccagaaaagcgttgtcaccaagcccaacatgtaccaaagaaatggctctacaaattggaatcaatctgaaaacatccttccaccaaaaggatcccttttccacatgagcatgcggaggcagagcagagtttcacttaacacgagtgctcatatttacggctagtttcttttagttgtcccaatatacccgtcgacagcgagacacctgtgtgcacgttgtgagcgcgtacgtttgtactctgtttctaaaataaaacctttcgaagatgatgctaaagtaaaacaaatgttccccattcattttatattataagtcactttaggtttgtcctaaatcaaacctctgtttctaaaataaaaccttttgaagacgatgctaaaataaaacaaatattcccctttcattttatattataagtcactttaggtttgtcctaaatcaaacctctttgagtttaaccaaattaaaaaaaatatagcaatattttaacccaaaataaatataccataaaaacatattgaatgatggatttgattaaattaattcgatgttgtagatttatgtgtgtgtatccgtctcacgaaaagctcaaagtaaagtattgcgaaggacaaggacagatcatttgcctctccacgtgcatgctaaagcaaagtatagtgctccctccctttcagattacgacgttttaactttgattaaagttaaactgttttaagtttaactaagtttatagacaaatatagtaatatttataatactaaattagtttcatcaaatcaataattaattgaatatattttcataataaatttggtcaaacttaaaacagtttgactttaaccaaaattaaaacatcttgtaacctgaaactgagagagagagtacatgtaaatactaataccattaatacccgacttagctctttctctaacaaaatttgttcgagctcgtgttgtagctagctggctctatatctatagcacatttaatttctctctcctccaattaaacacaaatataatttggtggcttttgcttaactccagtactcctcctagctaggtgcttggcatcaatcgagatcttgctttattagatatgccgccaatcatgcatgcttaagcttctttttgtacagaaatatatagatgcttgagctttggaagctactacatcgtccttaattattaatttggaccacaaaaagcacgtgtgaatattaacacgttgtctgtcttaatttagggatgcttgatgctttttatacatatatatagtttctcaggagaggccagctattcatgcaacaactcgatctcagtacaactggcttacaccttgtttgctttttcaacactgatcaaaggaaaaggtttaaacttggtgaaagaaaaagagcatcgatcacgtgtgttgtattatactgtagtgatctgtaagtatgtatttatatattgtcaaaagctgaatttctttttcttacgaatacttagttatgaaattcattgatcgtttcaagattagagagatacgtacacagctacgcaatatacaatattaatacgaaagtactgattaattaagtccatgtctgatcttcggctcgattagatcagtggcggagccaggatttcaaagttgggtattcccgtctaagcgttgagccgttgcccgtccctgccccttgcggccgccggccatccaaccgacctgaccgccttagcttggcggagtgtcgggcgccgcccgccgcggcaatggcctccccctccgcggtagcacagtccagctcccgccgccgattgccgtctcgccgcgccgccacctagggtttgcaaatggggagtggcgcgagggagccgagccaaggagggatgggtcacggagggagagcgagagggggctgtctgaaagagtgctagctaagtgggtcaactgatgtttgatgggtcatgacggagtaggtcgggttggttggaggcatcgcaagagaccagttgtgctatgtttggatcaaagagttgaggatttaggtgtacaaatatgtgtacatgtgtatatactagaagtatacttgttttctgataaaaaatgttgggtattcccgggaatacccgggaatcacggtggctccgccactggattagatcagtcccttttgcctcacgtcgcgtaatattgcacatctggtttcacgtacacgatactgtggataacttgtgttgcactcttggcatgccttgagtcaccggccggccttgatccacaccaggggcggatccagcaacaaacagttggggggactcaacataccgagtacattgatataaacacataatctcagtattaaactatgctaaaatgctattataagacctttagcacctcctatcttatcaactatgatgaaaaaattgaagggagggcttaggggggtatccatgggttttgtgggtgta

SEQ ID NO: 18783 - DNA, 1242 bp, Oryza sativa
  unsure (1)..(1242): unsure at all n locations
cccacgttggatccgcccctgatccacactcacgctgcctttcgttgcacatcttgtgttgcaaacctttcgctttacacactgttggtagcaagctttgtgtgtgtgtgtgtgtaagctaggtgttgctcgctccgctccgcatatatccctcccgtgtattgttgcaatggtccatgcaaccatgcatgttgatataactataaagctgtatactttccaaaaagaataaaaatatactccctccgtccctaaatatttgacgccgttgattttttcaaacatgtttgaccgttcgtcttattcaaaaacttttatgaaatatgtaaaattatatgtatacataaaagtgtatttaacaatgaatcaaatggtaggaaaagaattaataattacttaaatttttttaataagatgaacggtcaaacatgtttaaaaaagtcaacggcgtcaaacattttgtgatggagggagtattatacgtacagaaatcctacacatatataccatactttggtatgataagatgtaaatgaaagggacaaagtctcaaaaagaatcctagtatatgatgaccaaattaaaaaaggcaaaacatcaaggacctactagtaccaggacatatggtttagacacactatgtttatctctatattcccagatgtgaggcactgaggctgggaggctcaagttgtccaagttctcataagctaccattataagctccgagttttcaggtagtagtaacagtactaccatgtaccactttaattaaacactgtcctagaatgtatacagtccagcttcaaatgtttaactttttaataattgttcctttttttaagacttctataggtaaaatgttgtatcgtaatttgaaagttgattgagctatagacgatgatgacataatctatgcgacgagagagcgagaggaatctgcatgcatatattgttttaacggaattgctaagctacatttgacagaaaaatgagaaccaaatcttgcaaattttttacattcacatctgcttcacgatttgtgctcaagtgggcttcttctccaactttggcgaccttgatgaactccagcgaccgatggtggcgaccctgaccaagttagggtctagagttgggggtgggggtagaagtagggttgggggatagggaagagggggtttctccagnnnnnnnnnnnnnnnnnnnnnnnnnnnnnnnnnnnnnnnnnnnnnnnnnnnnnnn

SEQ ID NO: 18784 - DNA, 4223 bp, Oryza sativa
cggaaagaaataaggttccctatggcagcacaaatattagagaccaaaatctgattgaaattgagggggattttcttttgaatgtggtataggcattcccttgttttaaatgtcaatatttaaatcaatggatggtgttcttttaaactaaaccgataggaaaactatatattatatttaaattagtagaagtaaaaaccctagatgagttaatactattgacttgtattaacatgtaatatattggtccacaaacatgcaacttcaaattcaacttctacatctcgtaacaaaaaaaaaacaaatttgcaagatgtagaagttgaattttaacctgcatgtttgtggagtgatatatcacatgttaatacatcttcttagatttttttcataaccatttgcgtgatatgcaaacaatgagaggacatatatactccctacgtcccataatataagggattttgggtggatgtaatagatgctagtacaatgaatctagccagatgatatgttcaaattcattgtactaggatgtgtcacacgcatccacccaaaatcctttatattgtgggacggagggagtgtatatatatctcttctctaatattataaaaattaaagatatttttgctagtagtttggtacatcatctatgtttgaatcggctttaattttatgttttgttttcaatctctatctctacgttacttaagaagaacaataaattttcttcgtctgtaaaaaaaggaaaaaaggtccgactaaaaaaagtaacaaaaaaagaaaaagtccgtttggtttttttggcaccagtttttttcccgacttttttttagcacacgaaagagtttatttttttttgcccacgccctaactcttatggttttttttgtctgtttttttattctgatctgttcaacgcgtgcctcttgggcgcttttgattttttcatcaattttttgtcgctattttttctcccgtgcgctttttttactcatccggttttttaatccgatatgttcgccgcacgccttctgccggcgccatatcgatttcgatctcctccaatttgattgcaaaaatcgattcctcaccccctccccctcatcattttctccatgatttttactttcgactcggctttaatttgctggatttaatctccgtttaacagttaccaatgatgacgttgatctttcccagtcgtttttatcacgagttttacgctctgattttggaaaaaaaaaggggaaagagtagatcgagtggttcaaaaatcatcaacaaattttgggtgacagaaccgtatggttctatcttcaggagattttgggtgacagtcaaccgtatgggactatcttcgggaggttgaagatggtagtggacggtgcgagttgggtttacggttccactactccctggttgaagggaagcaggccaaacagagggagatagtagatttgcctagggctaaaaaggaaggaaagctttcggcccaaaacccagaaaagattttcactaattataatctatatatagcgattctaatgttagaattttcattaaccttttcaattataatgtatagtgatcctaatattttaatttattgctaagctcttgtttacccgttgcaacgcatgggtattttttctagtttatataaaaatgagagatagagagggaaaaaaagaaatattactggtagcgtgaataaaatgaagccattttcattaattgaatgggtgggtaaagtgaggaaacggcaagcaaaaggaatgcatatatagagagaggcaggagagatggatacatcggaacatacgtacgtaattaaatatataataaaacgacgaagaaattaattagtatgaaaatatatagataaggatcgaataattaatgatggatcgagctagctgagctcgcagcttagcatgttttttttatttgtcatgtcgatggaatggtcgttctgctccacgcagggtctctcaggcgtgtccggggcgtcgtcgtcgtcgccgacgaagatgggctcgcagcagtagacgacggtgcgggcggtgcttgtgtacccggagtagatctcggtcatgagcgtgccgttaagccggagcacggcgtcgcgcatggtgttgcccttgtacaagtccatgaagtagggcctgagatccttggagctcatcgtcccgtccccgttggcaccgatgccggacatcacgaaggactgcgagacggccgtcagccgcggtatcacggccatgtccaagaggcccgttttgacgaagtatgtcggcgacgccggcgacgacgcgctcctgccggccaataacgccttgatgttggtgtagtatatttggccgaagccgccggtgttggcggccctgacggtgaaggcgaaggtgaggttcccggacatgttcgacggccgctgcaccttcaccgtatgaccggtcacactcaccaccagcggcctctctcgcccgaccatcttgatggcgtacgctatcatcaccacgatcgccacgatcaccgccaccgcaactacgtacctcgccgccttgatccaccggaaaaatgtactactactccagctcgatgaagatttcgctccgccgcctgccgatgccgtgctcatgcctaaatatatatggatatctacggaacccaagctagcttcactatcactagctacgtactacttcttcagttcagctagcttctatctatggaacccaagctagctttctgttaatatatatagcatctgattccagctatggatgcatgggaaagaagctacttgctccgtccctaaatgttgatatatactattctgtccccccaaaaaaaaatattgatagatattattctgtccaaaaaaaagataaactctaactatgaacggagggtaggatgcatgggacacatattaggatggaggtagtattaggtttagtctcacaattgtaattaataataaacaagtacaacttaaaacatagtttggtccttaccattaggctagtttattgggttgtacaaacaggaaagtgattttatctctcaaggggatatcctctcgtttcatacatgccatctaaatagtaataaatttttttaaaaaaattggcaagatagattaattaatatgaaatgtatcatctccacaaacatacaagttaaaattcaacttatacaagttataacaaaaataataaatataaatgggattgtaccataactattttcagtttaatttgttctttttgttgcaacttgtagaagttgaatttggtcttgcatgtttatggagtgatatatttcatattaatctatatatgttgtcaatttttttaaacatttttataactatttagatgacatacaaataacgaggggatattcacttgagggatgaaaatccatatcctgtacaaacccatagacctttatatttttggtttcggttatatctagggatccgaataacattatggttgattggttatgaatcacattatgggtgtgcatgagacacacatcacgccagctcatattgtgtgtgtgtgtgtgtctctctctctctctctatatatatatatatatatatatatatatattgatatattgcggcaaagtttttcaatttctttatgactttttaaggtgtcatgaaaaaacaagggggcgtcatcttaagggataaatagactttttaattagatatacatgccataaaaagataatacatttttaattatagttttataaatatgtgttagaggttgtattcgtttgtgtgagtgtaatggtgtttgcgcatgcatatgtagtgtaattatataaaaaaaggcaatgtaaaacatgcaaggcgcctacaaatcgggtgctcgatctttttttaaaataaattgagcgctgttccaccaagtagatcggaattatttcactaattagatcaaaaatgtttcaaacacaaccgaatcacctcatgaaatattttgatataacgtatgaaacaacggttttgaagctgtttcaccatatatagaaacaatgtttcaaatagcaaaatgatgtttcaattcactggaacatttaatctatacatagtgaaacaacacgagtatacttgctgaaacattgttggtggaacaaaaaatgaaacggattcccttaatagaacgttttcgtaatttgcgggtgatttgttgcaa

SEQ ID NO: 18785 - DNA, 1413 bp, Oryza sativa
ttcgtaaaacatgtgtacgatcgatgttatagatgtgactaagtaaaaaaaaaaagaagataatggattgagtatccctggagcattttttttttcacaaaagcagcatagcaaagcaaaagttccatggtccgtttactctttattctgattgttcaacttttgtaataaaagactttattccgattcgggtactcaatgcaatggccaacacataatttgacagttgaagttgaaggttgtcggtctagagtaaaataggatgctattcccttccttcataaatataggaactaatgctactcgagattcgctttggtttggtcgaccgatctgatcgagcgctccaaccctataaccaacaacctacttgtgtcttgctatctcttcattatacagtcctatacaccgttatattcgatctacgttgtatttaaatctttacaacaagatatcacaccgttatattctacgttgtatttaaatctttacaacaagatatcacatgactatattccgataaaaaaagcatatgtttcaatctattaaccctcgatgtttcatacgtaatagcgatatgattcaacgtttgtctttaccgtgtttcacagaaaaatattttagtggctaatttttttatttcatcatgtataacttatattaatgtttcaccggtggttaactgaaacatttgaccgggtccgatttttttttagagatgattaggcatccaatttggagtttcctcaacatcacctaatattatatggtatgtccagattcgtagtattttgttagtattttctctctctatatatatgcgttgatatagagaagtacatactatatactccccctcattccataataagcacagttgtgggtttcagtgtccaattttaaccatccgtcttatttaaaatatttttatgattagtatttttattattattagatgataaaatatgaataatactttatgcgtgacttaacttttaaattttttttcatattttttttaaataagatgaacggtcaaacgttgggcatgaaaacttatggctgcacatataatgggacggatggagtatatatgtagtcgtctgtaaattaattaattaagctcgatcgatcaatacatgcatacgtttatatatagtagtagtgtagtagctactgatgagtcccgtttcatttgagctagtagctagctagcttatacacacacacacagagtatagtgatcatagctagctagctaggcatgggtgatcatcatgatgaggaggagaagggaaaagacaataaagcagcagcatcatcatcttggcaagcccggcgccatttgatcgtgctggcagctctggggggaaccgtggccgcgaccgccgtggtgataaccgtgtccgtcat

SEQ ID NO: 18786 - DNA, 742 bp, Oryza sativa
  unsure (1)..(742): unsure at all n locations
nnnnnnnnnnnnnnnnnnnnnnnnnnnnnnnnnnnnnnnnnnnnnnnnnnnnnnnttccttaaatgaagcccatcatcgatgacccctcaacttagagctaattcaacttaggtggtaacggacgaatagcttgcacccgtcaccgttgacccctcatcggtgatggggtttggttgaggcccgtcacagatgtcctgtgtcgggctgcaaattcaactcgtcaaagatgaggggtcatcggtgacgggtttggccatgaggaccaatattcaagagggatttttttggcccgtcataaatgagtgcctctataacgggctgctgactgccgtcatagatgggttgttcaggatgctttgttctgtactagtatatcatttttttaacaacggcaaagcttgccatttattgaataaagcagggagcaatatttacatgtaaggagtaaaagtaatatttacaaagaccgaataggcactaaggtaacatctctgctaggcgtttggttcccgccgtagcccaggttttttactcttctttaatctttgcggtgaggggcgccgtgcttagctccttgtttcggaagattcggcgattttgctcgttccaaatttcccaagagattaggagaattagggatctggtccccagctttggtaacccttggcatgtggcgagagattcccaccattcgtgaaccacgctcgcctgtgcccaatttgtcgcgccatgggcgcacag

SEQ ID NO: 18787 - DNA, 495 bp, Oryza sativa
cgttctgtgattgatagcttgctttatcttaccgcatctaggccggatatcatgtttagtatttgcatgtgtgcacggtttcaagccacccccaaggagtgtcacttaatggccgtgaaaaggattctaagatatttaaagaattcctcaactattggcttgtggtacccaaaaggttctaagttcaagctagtcggctattccgattcggattatgtcggttgtaaagtggataacaagagcactttcggtagttgccaattgcttagtagatctcttctcgatcctaatcatcttctgctgcttctccattctttcttctctgtggcgtcaagcactgtcccttctgacgatgtcaaccccttcgcggcaggctctgtggccatctcggcggcgacggcgcaactcatcaacatcaagtcccacgttcccgtgatccttgatctcggcgactccaacgtcggcacctggcgcaccttcttcaccattgctttc

SEQ ID NO: 18788 - DNA, 274 bp, Oryza sativa
tcatcaactaacatgagtgcagaacgaacttacatgaatctaaagggagaaaatattcccagaaaaaaatagttgaactccaacataaattccactcgcattgatcaaatcatgcagttcttcatttcagaaacgtcctcatgcacctgggaagcgcgttatcatacttgtcaagatcttcctcgtagcgggaaggaccggaataatcatcatcatcatcatcaaattcctcagacgtccattcatccgagtacatggaatattccggatcaga

SEQ ID NO: 18789 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnntaccagtttactaattttggttgatttttcattgtaatgttcaaaaacctgtaaagtgatagataattcggaaatttggttatacggttaaacttttgatatggccatgcgcagcacaaatagttttaaatcatactttggttaaacaatgcatatttcttttgttttatttatgtattaattaattgagttagaaaagtgataagcatatgtatatttacttttgccgctaagataatttctattatgtgagcacacccttaatttgtatcctaaattcaccactgtacagtagaacacactagcctatatatctccctctcgagtgcagcgtgagttgacgcgccaaggcctactagcaacagagctgcaagcagagtggcagtgtgagtcgtaccgagagttgaagcacacatagccatctctctcgttgtttctccacgtaagctttttgtagcactagctttctagttgcaacgatggggttcatcagcggcgaggagctcgccgtgacgctggcgccggtggccgtgtactggctctactcggggatctacgaggcgttggggagcgtcagggctctggacaggtacaggctgcactcgaggagggacgaggagagcaataacatggcgtccaagaaggaggtggtgaagggcgtgctgctgcagcaggccatccaggtcgccatctcacttgccgtgctcaaggtttgtcgtctcacaaccctcgacgttcagctagctagcttttgattgttgagtgatcnnnnnnnnnnnnnnnnnnnnnnnnnnnnnnnnnnnnnnnnnnnnnnnnnnnnnnatgc

SEQ ID NO: 18790 - DNA, 585 bp, Oryza sativa
tccagatctcaattccccgatccatcgtcaaatccaaaccctaatctcaaatccctcccaaatcaaatcttctcgaaaaagtctattttgcctccctcgagttcgtgggccgatctcctctcccccggcccattccctctcagcccatctctcccccttcctccatccttgcccgcacgtgcgaggcacgtgcgccactcgagcgctgagcgctctctctctctctccctctccctctctcttctccctccctctctgctctcgctgtcgcttcccgccgacgccgctcaaatcaccacaccgcccgttgcttcccgcgcgcgcgcgccgtggtggccgaccggccggtcgccgccgccgtcagcgcctgccgcgcctgagcccgcgtctgccgcccttgtcgccgctccactccaaaccgccccgctgtcatcgtcgtcgtcacgacccgggccctgccactaccgcgcgcatgcttccaagagatggaggcagagctcctcctccctctgccgcgccgccctctctccctctttcttttcccaaagtggcaagaggcaagcctcctttccctccttctttcct

SEQ ID NO: 18791 - DNA, 680 bp, Oryza sativa
ccacaagacacagccccacgacacgtttccgtgcgccgacatgccaccacgacataccggaaagaggccgtgacaagacctttcgcataaccccatctaaccaagcacaccacacctcaggtttcacctccactcctcgcaaggcagcgagcagtcccctctcgtgcctaggtgaatccggaagctgcatatgccgtcgcaaggcctatccaaactccatcacgcccacccttgcctggatgcgtcagctagaggaaagctacactacaagctcagccgttgcccacgctggcttgtggtaagtacgataagttcttacagggcatcccgcgaaccggtccttaattgccatgggtgcgactagcaaaaccatgcacccacagcccaccattcagtcgcattttagttggataattacggccatgaagcatggccagatgtctcgagcacgcagcccattctgatactaaaaaggtctaatactgcaattatcccatcaactgagctagtggtaattaagcatggctaagcatatagttctagctaggtcacataagtaacatgagctagtcgatttattacccaaggttgacaaagaacagatatcaagtaaacatggcacaagtgagcagataggtaatattcagataccatgtaattagcacaacatgcatatgtat

SEQ ID NO: 18792 - DNA, 370 bp, Oryza sativa
atgacgccgctgtttcagccctccttctcccccccgcgcgcgagtccaccggccgtgggcacgatcccctccacgtcctccaccccttcccccttttctcccctccaaaaccagcgccaaaccgccccacttcacccacgtcgccggagcccaccccatcgtcggttgtcgcctctactgggctcgatcccgccttcccgagcctataaaagggatccccgggctctcctcttccgtttccccctcctccccgagctccccgcgctctctcccgctctccccacgtgagcccaagcgccgccgcttgccggcgaccctccagtcgcctctgtcgctgctgccgccgtccccgcgccgcgccgtttgcgcc

SEQ ID NO: 18793 - DNA, 558 bp, Oryza sativa
  unsure (1)..(558): unsure at all n locations
nnnnnnnnnnnnnnnnnnnnnnnnnnnnnnnnnncgcccagaaatttagcccaaatttccatactattttgtgtattaaatccctatccaggaccagccagggtacacaaaacgacaagtaatatacagttccaaacgtaaataaagcgtaaaatacttacagaagaggctcttagtcctcgcaccgaaaagaaacgacagcagcggaaaaaggtgatcctaacggggcttcagctccactccacaggcaaaactcaactggggtctgagccttggtcttctaacttcatcttcagctcagaagcactacacttctgaaaagggggaaataatagcaaggctgagtacaaccaccgtactcagcaagccacaccaatgatgcagacgtgcaaggggatacaaggacggtttgtggctatttgcataaaggcggttgtaaaacattttattgagcaaaacagtaaaactgttgagtaattaaagtaatattaannnnnnnnnnnnnnnnnnnnnnnnnnnnnnnnnnnnnnnnnnnnnnnnnnnnnnnnnnnnnnnnnn

SEQ ID NO: 18794 - DNA, 340 bp, Oryza sativa
caccatctcaccaccgcctcaagatttactcgatcatcgaggaccacgggggcaaggaggacggcgaggatgtgcatgatgtctccacagaggaggaggcgcgggggttagatccattgattttttttttcttcctttccttccactttcacttgagcaccattgcttttgttcctccatcaatggcgagatggctcgaaagaggatacatcagtgatgtctttgcctcggcagctagatttgattcggccgcaactggattttgccacattacgagctgctgcaagttaaggcaaaaattgttttttctgtgtgtgtgtgggggtgggggcggcgggtt

SEQ ID NO: 18795 - DNA, 19524 bp, Oryza sativa
  unsure (1)..(19524): unsure at all n locations
gaaaaaccgtgcaaaatttatcgaaaatttaaattattttttaaatttatttgaatttaaggaggttaccgcagtttttctatatcgtaccccgcggcaagaccggttaccgtggttactagcggtaatgtaaacccgggtgaaaaccaactaaaacagtggaaaaagaaatagagttgtttcaactttcaagaaaagaaaagaaatggaaaaatacacacaacaagggaaacacgatttaaaaggattggacttttcctcgcaaaaataaaagaagaaatcgattgggacttggggtttagaattatagcggcgatctctacgatcgatctgttgcattgccacctcgctcgcgcttttactttaatctgcggtgatctgtatgattaacacgtacgattctcaaactttcgtttcaagaaagaaaaggactcaaattcacattgggttttatgtatatatatatatatatatatatatatatatatatatatatataggtaaattaactggtgctacatggagtatgggtttcaaaattcaaattgagtatctacccaatttgaatgagtatgaattttttttaaatgtttagatatgatcaattaacttctttcaaactgaattttttttgttagattttgattctagttatataacatccaaacatataattcgttaggtatgtaataatgaattgtgaaataaagttgagtttgagttgttttgttgttaggtatttgtatgaatcaaattcatatacctagatatctacttacaatttgtaaatttttaaaaatttgagagaatttatgtgttttatatcttggagcccgggcactatggagtcccatatggatatatatatagttgtacaatctcggattaattaacttatccctccatcgatcgatcacatcgtgctgttttatctctccatcatccccaccatcgccaattcaattcaattcgacgtggccatgacgcagacgaatcaagccatcgaggtggacggcgatcggctgtcgccaccgccaccggcggcgtcacccgccgtgtccgccgtactcgagaacgatgacctcgtcggcgagatcctgctccggctcgcctttcccaccaccctcgtccgcgccgcgctcgcctgcagacgctggctccgcgtcgcctccgaccccttcttcctccggcgattccgcgagctccacccgccccgccttctgggcttctacgtcacgagcctcaagataccgcgggctcacccgctcttcgtcccgatgccgccggctgcacggccaccggagctcgaccccgtcgtccttcgcggtggcaacttcagcctcgcttacgagggttacacgaccagtatctaccagtgcaggaacggtagcatcctcctcttcaaggagaggcatgatcggcgcgagctcaaatacgcggtgcacagaccgctgcagcatcctgagagaggcctactcgccatcccgttctcttcaacacatgacgatgacgatgacgtcgagcctgatctcggcttcgacgacgagaatgtgtgggggttccacttcggagaggatggcggcagccagctataccggttatcggtgatgttcaccccaaggggagctacttccgcgtggttctacgcattccgggacggcggatggcatgtccataccaaggcgacggcacagctacctggcttgccaccggaatcagctgggttcgtcgtggtccgagacaaggcctacttggcagccacttcgagcagcgttcttgtgttggacttgaagtcctcgagcttgtacaccatccagcttccagatggggtggagttcccacctgtgatgatgtggtataatgatcgaagccacgacgttttgttcggacgagcgagcgatgattctggggtttatatcgccgatctgaaggagcctcagcttcgtatttggctacttaagcatggcagcactggatggactctggttgataccatttgtttgcggtcgatgtgcgctaatttgcacataaattgtgtgggcggggatagtcgtgttgtttacatggattatgtaggggacgatgctgagtttttgttcttgaaaacagatgaatgtgcactctacttggatgttaagagtaggcaacttcacaaggtttacgaggtgacatgaaaaggatgaaatcttgttttcaatcatgccctttatgatgatatggcctcccatattccctgtgaggaaggaaatatcataataatggtgaattctcttgcaatgttctttcatgttattattatttgttccacaatgacacctggtagtgcttttgtacaatgaacccctagataaaaattttttccaaaggtttttttttttttggggcccctttcccttttataatattttaaaaaccccccgggggttaaagaggttgacatatatatatatatatatatatatatatatatatatatatatatatatatatatatatatatatatatatatatatatatatatatatatatatatatatatatatatatatatatatatgcgactttttttatatactttagtggtggttctggagttccatgtataatgtatggttttgctttaggatgcggaaacttggaatacactaaaaacaaattttggtacatcaagatatattttttttgagatacttagtatctggaagtacaaaggcaatagaaaatatgatacccttgtacctttttaaggactagcaaaaatatttgtgcgttcaacagataaagataattttcatgattgataagaactctgccaatttaaacgataaaaccgaaataagacagacaaaacaatggaaataattcaataatcacatatagattgaactaggttgcgttcgcttcatgcgttatcgcacaaaggatcccttatatacaccattccatagcctcatagatccacgagtggatatgccataagttgatacatgggtatttcgctatatcttggaccaaatattgaaattttgattattcaattagtgaaagttttttttactgtagatagcagggggaggcctatccaccagtggagcatgagccaacaccaacgcccagaaaattccctacatgctgccaactgtgagggatgtcgcctcgtcatgtcgcgacagcatctcttgcaccatatgcatcggccacgatccgaacaggggacaccgccacaccggcagtgacaccgtgagttgcccccgccatggccaaccgtcgaagtgccatgaccatggcgacctccatcctaacgccgccgactcctccctccttcctcgtgcacagcagccacggccagatctgcaccgccatcggcaaccttccgaaactccgccatccgcgcacacagcgtgtgctaaatttgagcatttcattgcatgtgttgtagtggttcacttgcttagtgagatgtcacgaagtcccaggttcgaatctccccctcgacgtattttttgcctttatgatcatcgctcacgggaaatagcgcaaaaatttacaaaaaaaacatgggaaccgggtgatcaaaccacgtgtctacttgtggttttaaaaaaacggatgaccaacaccacttcggtacaagatggtttatgtacgataggaacatatactctcacttaacagatatatagggttagcgccatgattgctggcacagagccattggactgaggtgacggcttatttttgaaataagtttttgatatagttctcttttcaaatatgttttctaaaagcgttagattgtcaaaattatagcaaagaccattggtgtcatgtgacaccattgctataacactagctccacccccgagtcacaggtttatctatccagaagcggttgaactaaatagccaatatatagcagaagaatagtaggaagagctcatgtaaattattttcaaaatgaatgaacatttttcatcaatttgtacatgctgaagtttttttacagtatatatcagcgttagtaatgttaaggaacaataatgagatgttagggttagggtttatgcgccacccgggcgaccgggcggcggcagagctctcgcgcgtggcgagatgggtctggatggagatctcctctgatctgctcctgatgtctccgggggttttacccgccgtgggttgttctgggggggatttcctccctgtgttgaaacgtgatctggtagggtggcctgatcatactcgtataggagataagttgaaggctttccctttaggcggattgatctatgggaaaggttcgttctctgctttccgtattgttccaggggatctgtggcccttgcgaaattctagaagggggaggagattgaatctgttttggtatccgaagttcgagttgtattggagacctaattctgtggcattgcagtataaatacaagtcacagtggtggccgaaggtgcggttcaaagtttttccggcgatagggctaggcgttgtcaaccccgtctctttgtttgttggatctagcggaagtctcatggcggccaatgtcggtgggggtgataaagggatcgtcattgggacgatttcccacccgaagctgatgagcggtaatgagacggacgcggtgattctcgacaggattcctctgaagatgatcgagggagcagcgggcacatctgatcagggccaggaacacacaacggctgcgaggaggggatctgcagagaacaaccaagttgatgcaacacagtgtcctgcagtgttcactgaaggagatctggtggaggatgaggaggatgtggttgcggtgaatattgaggatgatgaactgcagactgctggcctgtggacgatcttggcgaggttctattctctgagaactccgaaccaagtggccctgtttgacgacatgcgcagagcttggaggttgagagcagatatgagctacaaatcactacgtgacaacatgttcatcataaccttctcggtagagggagactgattttgtcattaaagggggtccttggattcacagaggagatgcactcctggtagcgagttttgatggcattacgtgcccatcgaatgttcctttggatgttgttccgatctgggtgcgcatatatgacctccctctggtgttgatgacaaaggtaagaggtgggatgtttgggagcaaactcggcaaagttcgtgaggtagacgtgagggatgatggacgcaacaaacatgacttcttccgcattattcgtgttgatctccctgtcaagcgtcctctgaaatcacagatagctataaggatgactgtccaaggcaaggaggtccttcgcaggttcgatttacgttatgagcgggtaccgcacttttgctttatctgtggttttattggtcattccgacagagattgcaatagaagatctgccaatgaggatcaacctttccaattctcagctgagctacgatgctcccccccttaaaccttttgagaagaagatcagtaaagtgaaagctgcccaaacatcaagtgttgcacgtaacttgttcttcagaggggcaggaagtgctagttcatcgtcctccagacacaaacaagatggtcagatgcaggaagcaataccgcccagagttgatgcccatgatgggtttgagtttaaggaaagggaaggggacactgcaattgatgagatgttagctcaacaggctgggaagatggatgttacgggggacaaaactcaggaaacatcgatggttgtccctgctgggaagctagcccagcaacaataggagaaggaagcacccaagaagactgatggtgatgaaatttctgcttctgagatgataccagccatgaggaaccttcaacagcaagcctcgtttggggaagtgtcatccgaggagatcagcgatgccaataggaagaggatgccagaccagtcaggactccagataaaagggagggttcagcaagcattgttggaataccaacaatacacaggtggcagcaattccatgcatggggatatcggcaaggcagctagagcagtgaagagactcaagaaggctgcagagggtgaggacacagacgatatggaggcaaccagccatggggccgctggtaaactgacgggacctgtgattgggtcccgtcaggagcaatgagttgcttggcttggaactgtcgcggtatagggaacgcggcgacagttcgtgacctttgtgccttagtgaaggaggcaggttcccatattgtgtttttaagtgagactaggcaaaagattgagaaggttcgtaggctgcggaatagattgggtttgaagggttttgctggggttaacagtgatgggatgagtgggggtctggctttattctggcatgagtctgttcatgtggaaattataagtatgaatgagagatatattgacgcgtatgttcgtttatctgtgaatgctcctgtctggcatgctacttttgtgtacggggaacctagagtggaaaatagacatcgtatgtgggcgttgttaaattcagttaagcaagtttcggatcccccgtggttagtggtgggtgattttaatgagactctttggcagtttgagcacttctctctgaaacaacgaagtgagctgcaaatgcaagcctttagggatgtggtccagagatgtgatctccatgatctggggttctcgggggtgccatacacttatgataataggagagaaggccgcagcaatgttaaagtgcgcctagactacgcccttgcagatgatgggtggaggggactgttctctacagcacaggtgtttcatctgtcctctcctagatcagaccattgccccatccttgtcaaattttcttctgaagaccttcacaggaatcctgtgaagtgtgtccattatgaaatttactgggaaagagaccctgcaatctctgaagttatagcagaatcttggggcgtttccggagttaagcaggatctgcgcgacattaatcaagctctgtttaggatgatgtctgatcttcgcacatggagtaagaaaaagttcaggaatgtcagccgggagattgagaaaaatagaaagaaactatctgaacttcttctaagtaatgccgacaatagggaaataagacgggtgtccgatcaaatgaatgaacttctgtaccgtgaggagatgatatggctgcaacgatctcgaattgcttggctgaaagaaggtgatagaaatacacgtttctttcacagcaaagcagtgtggagagctaagaagaataagattacaaagctacgggatagtgacggtactgttcacagtacgacaaaagagttggaacgtatggcaactgagtatttccaaaggctgttcactgccgaccccagtattgatcattcgtgagtcactagcctgatgaagccgaaagtcacagatgcgatgaatgagaaactatgcaaacctttagtgaagagaaattgcaaatgccctgttccaaattggtccgttaaaagctcccgggccagatggattcnccggtcggttctatcagaggaattgggctatactaaaggacgacattgtgcgagctgtacaagaatttttctcttcgggtaccatgccttcgggggtcaatgagactgccattgttctgatactgaaaactgagcaaccataggaactaaaggatttcagacctatcagtttgtgcaatgtggtctataaaatagtgtctaagtgtttggtgaacagactaagaccaatcctggatgatctggtgtcacagaaccagagtgcctttgtccctggtagattgatacaagataatgccctgatagcattcgaatgcttccaccatatacagaggaataaaaatcctgagaatgcttactgcgcatacaagttggacttgtccaaagcgtatgaccgtgtagactggaaatttttggagtaagcaatggttaaactgggtttcgctcactgttgggttaaatggattatggcatgtataacctcggtgagatatgcagttaaacttaatggaaccctgttgaacacctttgctccatcacgaggtctgcgtcagggtgatcctctttcgcccttcctattcctttttgtggctgatggactgtccttgttactagaagagaaagtggatcagggagctatgaacccaattcagatatgccggcgtgctcctgctgtgtcgcatttactgtttgcggatgacacgctgttgttctttaaagcggcaaatgatcaggcggtagtgatgaaagaagttctcgaaacttatgcttcctgcactgggcaattgataaatccttgcaaatgctccatcatgttcgggcaaagctctcctactgctgtccaaaatcagataaagcagaccctgcagataagtaactcctttgaagataaatatttgggctttccgatgcctgagggtagaatgaccaaaggaaaattccaaagcctccaggagagattatggaagagaattatgctgtggggggagaaacttctgtcaactggggggaaggagattttgattaaagcggtcctacaggccatgcctgtttatgttatgggactcttcaagctcccggagtcggtctacgaggaattgacaaaactggttcgtaatttctggtggggagcagagaaagggaagaggagaacgcactggaaatcctgggactgtttgattgctcggaagttgaagggaggtatggggtttagggatttcaggctgtttaatcaggcacttctagctagacaagcctggagattgttggacagaccagacagtctctgtgctagaattttgaaggccaaatactacccgaacggttctctcattgatacaagttttggaggtaatgcctctccaggctggagagcgatcgaatatggtttagaattactgaagaagggcatcatatggcgcattggcaacggtaaatcagtcagattgtggagggatccctggattccgcggagcttttcaagaagacccatctcagctaaaagaaattgcagactgagatgggtttcagacctgattgatcagtccgagtcctgggatactgacaaaatctcgcagcatttcctgcccatggacgcagaggccatcctaaacattcgtttatcttcaaggctggaggatgacttcattgcttggcatccggatagactggggagattttctgtcagaagtgcttatcatctggcaatagctctggcacaggttgatgaaggctcgagttcgtccgggaatggaaatagcagagcctggaatgccctttggaaatgcaatgcgccccaaaaggtgaagatttttgcctggcgagctattactaacagccttccaacattggaaaataagaagaagaggaagcttgaagtttcagacatctgcaccatttgtggggtggagtcagaatatgttgttcacgctttgtttcgctgcccacatgcccggcaattctgggaagcgatgactgttgatatgaagcttaaccctctcagcaacattcgcaatggagatccgaaagtgatcttggacctattggagcagtcgcagccggaggaacaggttatgcttttaatggtactgtggcgaatctggcacacacggaatgaaatagtgcatggcaaaccagccccaggaatactagtgtccaaacgtttcattgaaagctatgtcctctcccttgctgagatcaagcaacacccccaagcaagtcctgagaaggggaaacatgttgtggatgtggttctaaagaagtcgcacaacatcaaacggagtcaagaacctgttcctgacaaatggtcgaagccgctcctaggaagcatgaagctgaatgttgatggctcattccaggagagtgacggcaagggtggtataggcgctgtgttgcgcaactgcacaggagaggttatttttgctgcttgtggacatgttgatcgctgtagcagtgctttggaaacggaactccttgcctgcagggatagtcttgccctcgccctacaatggaccctgctgccaatagtgattgagacagactgcttggcgatgatccatcttttccgcgatgcaacaggtgctaaatcggagctggcgtttttaatcagggagatagattctctcttggtgggaaatagggatattagcttcagtaagtgtcttagaagtcaaaataatattagtcactatttagcaaataagggccgttgtgacaagatcacacagttttggccggacaataagtgtacttttatctcgcagtttatctgtgaggaggctaatgagtaattatccctttcccctgaaaaaaaaaggaacaataatgagatgtataggttatcagggcaaaaacaaagggattagtgcatatgcatatgcagagagagtaggaaactcacaaactttgcacctctctttgccgagatgacacatgcttttcatggctcctatgctataaaagggcagcatatacagtcatacagactagtattaattagttactaagcagattagaattagttttggatcatcactgcaaattgaaggatcacacaaatcaatggctgagttgcattgtcgtttttgtgttttttggcattctgtaacttgaccgccccttgcatatatatgcagccagctgaaattagccttggctggcatcctcaagttagagaatgccaaaaacacaaaggcggccgggatgctgtgtcttgccggaaggcacgaagctgacgctggcgcacgacgaccacggcgtggctgcagcggcgccaaggttcatcatctacaaggacaaggccgacgccgtgccgtccaacctccgcgccatggacgccatcctcgccatgttcggcatcctccctggatccgacaaggcggcgcaggtcgccgacaccctccgcacctgcggcgaactgacggccgccggcggcgaggagccacgccacctcccgcgaggcggtgctcgacttcgccgcctcggcgctgggcaccagcgcgccgcgcgcggtcaccacgctcgtgcacgggagggagccccgcaggtacgtggtagcggccgacggcgtcgcccggatcggcggcgacgccgtggtggcgtgccaccctatgccatatccatacgaggtgtactactgccaccggccagccgacgcggtggcgctgagggtcgacctccacgccgtcgccggcgtgggcctgggcggcgccactgccgtcgacgtgtgccacgtcaacaccaccacctgggacagtgcctacttcgagctcctcaaggcaagccgtggcgacgccatctgccactacatgccgcagggctatgttctgtggctagccaattgagacgatattagtatttcctacaaacacctgatcgtagctactcaaccttccatgattgatgcttgatgcatctctcgctactacttcatccgtttcacaatgtaaatcattctagtatttcccacattcatattgatgtagaatgacatacattgtgaaacagagggagtatcttaataaacgcaaaatctatttcgagaggcatctcgatttagacttaacgagcgacgtggacaattacgtgagaagtattagtagcattacagacatgcatgtaagcagtttttctattaggttgtgcatattttttcttcttataaaattttcacttaaattacttatccgatctataatccgattacaccattgtgttcgttgcaattaaatctttataacaagatcttacatgataatattatgataaaaaaaacatttatgttataaattacttttataatatatgtaagttacttttatcttatatacaaattacttttagatttgattaaattacttctcataatttcataatgctttgagttgattacttttattattattgtttttactcagtttcataatttgtgttgattaaatttaatttctaaatagacttatatttttattcctacgacgaatttacttctaatatcataacaacttactttcattttatactaagttacttttatgatttttgtaaattactttcaggctttattaaatttactttcataaatgtatttacatgaaaatcttctctacacttttgaatttactccacatagtttcttattggaactcactcataatgtaattacttctatatagagttacttctattacatagctaagttacttttacaatttaaataaattacttttaaattaataaaatattttaatatattcaatctggatctcgttttatcacatattttaagtggagtacaatgatacaaatagatcttaaaaataatatatgatttaaaagatacaagtgattaaagaggtaaaaaaacatgcactatagtactttttaagctaaaataagatttaaatctaggatggagtgatcgctgctttaggcaaaccagagaccggtcgttgtgtagtcatgaaataaaactgatgctgtgctctctgctcgtcctcgactcctttttccttttttctttttttttatcgaagaacagtgaaggaagctatactaattactgttgcaatcccatgcctgttgctaacttctgaggaaggatgaagatgtcagagtccaaaaagaatcggtagactgaaattccaagttttcaggaaatttgaacccaaaaaagttgaaaatcgaatacatttttactaattgtcaacaaattagtaaaactgttacactgttcattcatcacctgtgttcgaccgtccgatctgcctatccaccaagctgttcatgtgcagatggactactcgagtagtgtggagatgacgaggacggcgccagagcctctcgctgcagctgatttggggatttccatttcctttattactgtgggggatttacagattttcattggctctgctcgctgctaatttgggcagtacaaattttgtgcagccttccaccgatttcgagcatccagtatgcatgccaaaaagggtttcccaaaccgtcagggccagggttaccgcgccgtgaaaaaccgtgtaaaatttatcaaaatttaaattattttttaaatttatttgaatttaaaaagattactgcagtttttctattaccgtaccccgcggtaaggccggtaaccgcgcggttaccgaaagaagataaacatgctattttatctctaacacgcccccgcagactgaacgtcgttcgaacaaacgtttaggctggaccgaaactctgtgaagactggagttggaagacccttggtgaagatgtcagcataatgtgtgagcacattaagagcgcgaacggaaccaatggcgaccttctcacgaacaaagtgtagatcaatctcaacatgtttcgtgcgctggcgttgcaccgggttagtcaagagataaactatgctgacattgtcacagtagaccagagtagccttgactggaggagcatgaagctcatggagaagctggcgcaaccaacatgtctcggcaacagcgttggcaacaactctatactcagcctctgcactcgaacaggaaaccatagtctggtgcttggaggaccaagaaacaagattatctcccaaaaacacagcatatcccgaggtgaacttgcgagtgtcaggacaactggcccagtcggtgtcagagtagacaaccaaatcatgtgaggctgagtgacgaatgtggagaccaagatccagggtgcctcgaacatagcgaagaatccgcttgagagctatgagatgagactctcgaggatcatgcatgtggaggcaaatctgctgaacagcatactgaataccaggccgagttgctacacggtttgcagtcgaacatacctacacgctccaatatctccaagccatactgccgttgagtgagaaacaagccgaaggaatggcgagagactgaaacaccgagaaagtgatggagctcaccaaggtccttcatactgaactcagactgaagagaagagattgtccagtgaagcagcgatgtcgacgaagcagtgagaacaatgtcatcaacatataataagaggtaggccacatcacctccacgtcgacaaataaatagagaagtatatgccttggcttcaacaaacccaacggagcggagaaaagtggcgaaccgactgtaccaggcgcaaggagcttgcttaagcccatacaaagacttgttcaggcgacaaacagagttgggctgagcaggatcaacaaacccagatggctgcatgcataacactgtctctgcgagggtgccatggagaaaagcattcttcacatcgagctgatggataggccagttacgagagactgccaagctaagcactgtgcagactgtagctggcttgatgatggggctaaaggtctcgtcgaagacgatgccggggcactgagagaagcagcagaggacccaccgcgccttgtagcggtccaaactcccatcggcgaggaacttgtgacgaaagatccacttgccggtggcgatgtttgtgcccggtggaagaggcacaaggtcccaagtgcaatttgacatcggtgccgagtactcctcttgcatggcatcacgccagttggtgtcggcgagcgcagcatggtaggtgcgaggtatcagggagagagtggcggcatggaggttcaggcgtgaagtggcaacccggacgccagccttgccccttgtcaccatggcgtggttgttgtcgatgggagagatgccgaagcctgtaaccggtggccatgtaactagggcgcgggcgcttctggcgcacgtcggtaccgcgagtggcgacggctagagaagcggggcacgcagcaagcgcgtactggacgcgccgtcatgagctggggaaggtgcgccgtcatgagccagggaggaagcgccgtcgtggacatgaggagcgccgtcatgggccaagatggcatcatcgtgggcagaccgagccggagaagctggccctaaagtagagaccccatgggccgtcggagatgaggccgcaggtgccggcccaggagagaggcgcccagcccagcccggcaagcagggaggggtcggccgatcgatgcatgcgccggtgggcccaagagaagtggaggcagccttccccgagcgattggagccaattggagcctgtataggagaagtaaaatcctccaggaaagcaagatcagtagcacaagcagtgtcaccagtcatttcggcaaagggatatgtatcctcatcaaacaccacatgccgagagataataaccatgttggtgatcggatcgaaacaccggtatctcttacgttcgctagggtatccaagaacacacacttggtggaatgtggcgagagtttgtggggtgcggtggcggataggttggggtaacgacaaccaaagacgcaaagatgtgtgtatgaggggtggacaccgtgaagggcgaagtagggagtgtgttgggctaaagttttggttgggtgagactcaacccataatgagccggggaggtgagcctgaaatagaagcgagcgtacaatgttattaagagaacgatgagtacgctcagctttacccttttggggcgaggtgtgtgggcaggaaatgcgcatggcgacgccgttggtgaggaagaaagatcgagcggcggagttatcaaactcgtgaccattgtcgcattggatgttgcgaatgggtgtagcaaactgtgtcctgacataggcaaaaaaaatgcgaaagagtggtgaatgtgtcggatttcaaacgaagaggaaatgtccaaacataatgagagcaatcatcaagaatgacaaggtagtatttaaaaccagacacactgagaactggagaggtccacaaatcacaatgaattaactcaaaattggccttagccctagacaaagaagtagcaaaagataggcgtatgtggcgaccgagctgacacgcatggcatacggtggaggagccgcatttgggaggagagatgaccaaggagtgagcaaaacgggtgagggcgtcgtgaccaatgtgtccaagccggcgatgccagagtgtggtggtagtggcagcgaaggaactggcaatggaggtgaagaagttcgccagaaaggagtacaagtcaccgaagctattgcacctggcgatcacggtcctggtaagtagatccttcatagtgaaaccaaacttgtcaaactcaatggagagattgttgtcagtgacaaaccgacaaacagagattaggtttttgataatgttaggtgaaacaagactgttattgagaacaaacattctattagcgtgaagaaatgaagcattgccagactgctagtagcaatgatgggcaaaagagaactgttgccgacgataatgtgggacagagtggcgtaggtaggttgggtgagaggataggataccggtgtccgatgtcatgtgtgaggtggcaccggtgtccatgtaccagccgttggaggcaggcgtcgtgagggtgtcggtttgaaacagacttgccaaagtctgttggtcccaagcaagtgttgggctggaggctccgtaccaggacgttggttgggccgatggctgcagttgttgttgctgctgagtgaggccggctggaaggtaagggccggcctgggagaccggctgcgggagggcagcttgcccaccggacattgccacgcccgcaaaaggagaagtgggccgagggcccaaaatccctggagcacgcagcatcgggccgcccagccacatttgaatcgtgccgacccaggggtgctgaggagtgggccaggcctgtccagcgcgaggctgaggggcagcctgccctacgctttggccacatgtgccctgagcggcgccgccattgccgccggcggtgccgcccccgttcccgttgcgtcgacagcgatttttgttgttgccgccgccaccttgtgtgttgccgccgccttgatttaggttcccgaaccccgtggcgtgcaattcatgagggcggtggaggagttggtggagcggttggaggggcccttgttgatctcggtgagaattagcttactcgatccgggcttcgacgaacatcgggaagggacactgcagaggaataatagtttggagaatttcatatttagggtttaaaccaccgatcattgcaaggacaagttgctggtcggtgacggggtcgccgagctcaccgcgagtgtcagccatagccttgagacgtcaacagtagtcgttcacgccgaggtcaccttggacgaacgtgtgaaattcagccgtgaggttgatggcgcgctgttcctagtggccgaggaacatctgctcgagggagagacagacgaggcgtgcgttaccatcaggctgaatgatggtctccaggaggtcggtggcgatggtcccatagagccacgagagcacgacacaatccgtccgagcccaggacgcatgatgaggaaaagcgtcgtcagagaggacgtggtcggtgagggcatatttggtaatttgcggcgccaaggtcgaggacgacggggacaagcaccttgacattgagaacagacaccgcctgggcatgaagggcatcgacagtgtcagaggttggcagagcgcccccggacatggagccggcgggctgttcgtgctagggtgtggctgatcggcgaccaaccgcgcgggcctgcacccgtgcggtcagtcctgcctgccttagtccattagtacaacaactactgctacaatactactactactactaatactactaccactagtacattattactactacttgtaatactagcactattataattgtttatatatatatatatatatatatatatatatatatatatatacacgtatacaaagtttatatatgatgtatacaaaatttatatacacgtatacaaactttgtatacgtgtatttttggtttttatatacatgtatgtataaaaataaaaaaatacacacatatatataaactttgtatacgcgtatacaaacgttgtatatgcatatacaaaagttttgggtttttatttacatgtatgtataaaaataaaaaatacacatatataaactttgtatacgcgtatacaaagtttgtatatacccgtatacaaactttgtatagaagtatacaaagtttgtatagacgtatacaaagtttgtatagacgtatacaaagtctgtatacgtataaaacgaaaataactgaaaaagatacgaaaagaaaaaaacagaaaaaaccaaaaaaaggaaagaaaaaaacagaaaaaagaaaaaaagaaaccgtccaccagaaaaaaaaaatttccacgcgccgtcctccaccctcctccccgcgcgcgacacgcgtccagtcgcgcgggggagggggcgcgcgactgaacgctaattagcgttctcgttcgtgctgtggtggttgaaggctgagtgcagcgaacaggctagcgtggtcggccggtgaagaagagccgaggccgatgggcggttgcgtggtcgcgctggctggaggaagtccgagggtggcgcgaagagccgcggcgtcaacggtgaccgttgtcgggaaggtagaacttgacgctgtggccaccgtgtcgttgataggcgtgatgacgagagcagaaatcaccgcttggacggccttggcagtcgcggccgaagtcgcgtcgatgagagccgtggcggcggcacggtcgtcaggtgaggccgagtcgtcgggccgaaggacctgccggatggcagaggtggcggcgtcggtgatggaggcgaccgccgcggtaagagccgtgtcgtcgacggactacatgggcgccggcaggagagagagccgtcggcgatgaggttttagggtttagcggaagcgattggatcgggagtatctgataccatgaaagcagggatagctcaacgcgatatcgattaatcacggaacatgtgtacatatatagctacatccataccagaatctctcaaccgatgtataacagaatcgggaagattggataggagatcggcaaaagcagaaagaagataaacatgctattttatctttaacatatttgatttacaagacttgtcaggggcctaggaatgccttcagttttcgactttttacaagataatagtgggtaaaatgagaatatgcttgcaattagtacttgcctcataatgtaattagtaaaacaaaatggcaaaatttgctacaagacacacaaaaaatatgtaattagctcaccccaccgccccgctcgcgccgacctcgccgacctcaccctcaccgcgcgcgttcccggcgaaggagaaaacgaagaaagagaagtggcaatccgggtatttaggaaaatatctcatctcttttgacccagaaataataaaataatacgaccagtgtcctaaaaccaattacacaatttttgtagtgtccatcagccatatcacgttttcgcggtgtctcccagctaatcccagctaattacatgttttttacgtgtcctgtagcaaattttgccaaa

SEQ ID NO: 18796 - DNA, 22026 bp, Oryza sativa
acattatgaaacggagggagtacattccatgttcaaccttaaatgataataggagtatattgtttacacatattgcaatggctaaggtcagacactaaacccacacaaaccttacattgtctggagaatttctaaacttccggtacttgagctatgagaaattcataactttaattagctcacagcaaattaaaacattgaacaatatttagatgcttgtcgaagttcagattctaaattcagatgctcctacatcataaggacaagtcagaaactaatatgccaaatgctcagaaaataatatatgcaatgttcaatcactaatctggcaaatgttagacatctatggttcacacatattgcaaggacaaagactccaaatatagaaaatgaatagcatgtttgaggtatatataaagaatttgtcatcagcatgacagaaaattacagcatttttttttgtttttttggaggacacaacatgagatgtgattggaaatttttttgctcctaggaaatttgtaacaaaaaaaaggaaagtgttccacatttctaaaggctgtcaggaattattaactcagtacataaccaatagttcacagaaaagaatagaaacaatacattaattacactacacaggatgccatataatgcaaggacaatttcagaatgttgtcaaccaagttcttgagcaatgcaagcccaagttcagaccatgtaaaactaaattcaaattcacatataaagttgtatggcacacaaagactataaagcctcctaattttggttggagcaacagcaaacatggttgggtagagttcagcgaatataaattcaataggaacttaacagtagattataaggaaaatgacatgtaactctttgaattgagattgagcagagagaaccatcagcatacataagtaaaatgcaaatttcagataattcacaaatagtcaatagtgttgtggtatgcatgtggcaaacaagaacattcaggtagataattttgggatttcatatgtgtacaagcatatgaatgtcaaatattattctgacagggaattatgtgtaagtaatggcgtccttcaaacctgcaatcgtgattaacttgctccacttaagtcatgtgcatcaccttccctgatgccatcctccaaatctacaaccccgattaactcgcttcattgaagtcatgtgcatcacattgcctaattccatcctccaagcatgtggtcagagatgccaccaggcttatatgaaggttgcctcctctcacaaagaaggaaaaaaggaccgcctcttagcagcatgtgacaatggctaggataatcccggatcaatgccaatataaagatgaaattatgcatgttgtagcagtgctagacttctggagcatcatggaatgtgttttggtcgtgtgcccctgggtagaggttggggctatagcacatacttgtgcctcaaaataaaatatcttatttttctttaataaaagttcatctgtttggagaatatatttgtccttggatctacccaaaacaaaatttgaagcgttaggacaaaatcaccaaaattttatcaattcaccggcagctgctagctaggagcacataaggcttgttaatgaaaaagtaaacactcaaattcctagcccagaaaaaggaagaagttattcctattcagaatcagagttgttccatgcccccttgcatacactaagctgagtttctttaatatgtttatactacgcaaatatatgtatgtaccttatctgaccagtgaccaataaccatagtaaaaattagtaaaaacttaaagcaaagaaataatcctgcatatatgaatattacctttttgttgtgcctatggagtatattaattcatatatatcaaccaaatgccaatcaatgataaataacagaacaaaatctccttgacccttctcatagagcatcttaaagccaaaagccatcatctgacaagggcctataaaaaatgccttccatcctgttcacccatccccagcatatccgtataagcttgtattacgacaattttatagtatccctagctaaagaaatcaaatggtggaatgcagtatcacttgaacaattctcaaacctgtacaatataatttctctataaagtaatctggaagagacgcagcatggcaactacaagtctacaatgttagtctgaatggagcaacaccagtcaccttgataggatatagcctgcaatgatgcacatatggattgataagaaccgaatcacaccattaagaggagagatttaatatatgtgcatacccttcagctgaataagaatccacacagaagactaatggggattcagaagagtcaatttgagtcaatggggtctcactcgatctcaccagcagaagaaattttgacgcacggctggaagtacctacggcagactatgcccctcgtaacggcggcaagaccggaggcgcgacggaaagctggaccaccggagaacgacggagcagtggcgctggcggaaggctggaccaccggtcggcgacggggctgtggcgccaacggaaccctggaccagcaggtccaattgtggtggcgagcggcacggaggcggggcggtggagggagtcaccggcgtcgtcggcgaagacgggagcggcatcggtgacgacaggagcagcggaagcggcgacaggaggcaggagccgatgcggcagcggtggatggaggcaccgcgcggaaggggaagaggcggcgacgagagtattttacctccatgccattaagaaagttgaaggttacctatatgccaaaaaaaaattttgagtcacctatataccatgacacaaactttcgtttacctatctgccattccatccatcttttgttagataataagctctgacatgtgggacccacgtatgaaaatgactaaattgcccctgaagcattttcatctctgctcctctcccgagcaatttcaccctagcctagccgccgcctttatagccgccgccggtcgtcgccggcgccggcacgccgccgccgatgcctcgcctcgtctcgcgtcacctcgccagatccggcggcgcgcctaggccggctcccccaggccggctcggtgccgcaggagtacctcggcaactgcctccgcccttgcttgacatggccggcctgctcggcgccggcggcgtggtgacggcggcggcgggcatcggcgccgccatcagggggctcgacaacggcgttctggacggtgccgatgggtggttccagaagatcgtgtcgctgatgccgcaccggccgatgtccatcgccggctcgcgcggtacgccgtgtacgacaccgacttcgggctgggccggccgatgaaggtggagctcctgtccatcgacaagacgcccggcacggtgtccatggcggaggcgcgcgacggcagggtcggcatctagatcggcgtggcgctgccggagtccgacatggcgcggttcagctcatgcttcgccgacggactgaagcagctgtgaggacgaacagcttgttgcatttattgctttcttgctgctacatattgttgcagagttcagagtttgttcagtttgggtgtgattctgtaatgctagctgttgcttgaatgttgatcctataaccaagtattatttctgctttttctttttttttttgcattttcttacttatgcacgcattttttttccttatctttttacgaattttccttattttttcatatgttcatatttatttatgattttttaaaatttatttacgaatttttttcttatttattcccagttttctatttatttccataattttaaaattatttactaatttttccatatttatttcttgttttaactttattttcaattttttagaatgtttactttatttcattttccttcaacctacatttcagcctttatgcggtgtgtgagccgatttctctttcaaatgttcaatgtttcattcaaagtggctgaaatagagcaagggcaaaataaacctttaaacctccattagtctccgttagtgctgattccatccaaagtggcgcataggtaaacgaaagtttgtgtcatagtatacaggtgactcaaaacttttttgtggcacacacgtaacctctaactttcttaatggcacaggggtaaaagactccggcgatgaaggcggagaaaattgtgtggtggaggttggagaaaaaggacagcatgccactccatatggtgggtttcgacaaaatgccacccaatatattgcaaaggataaaatgccactcaataggttatctttaggatattttaccactttgaggaggtttaagacaaatatgcccctactttggagagagagagaggaagggagagagagccggagagaggagtcgaacggcagcggccgtggtcgtcggcggcgggcagcgacgagggaagaacgagcaccgtccgtgctcccgctagcagcgacgaggagagaaagaagacgccgataagcgcacaggggtggcaccggagggggtgagcgcatgcgcgggcagcgctgcagagccctccacgtcatcgtcgtcgcctcctcctccctcccgtcggcgttgcccttctccccgatcgccgccgccgtcttcctcccaatgaccacggccacaggcagcgacgagggaagaacaagcaccatctgtgctcccgctagcggcgacgaggagaggaagaagacgccggtaagcgcgcgggggtggcaccggagggggtgagcgtacgcgcgggcagcgctggagaaccctccgcgtcatcgtcgtcgcctcctcctccctcccatcggcgttgccctcctcccccatcatcgccgccatcttcctcccccatcacagtcgtcgtcttcctccctctccgccgccgtcttcctccccctgtccacctgtcgcagcccacccccgtgcgctcgccacccgccgccggcgagcattagcgtcgtccgggtcaaccttccgctcctccctcttcctctctatccacggccaggggtattttggtcttaaaatctctcaaagtggcaaaatatcctaaaagtaacctattgagtggtattttatcctttacaatgtattggatagcattttatctaaacccaccgaatggagtggcatattgtactttttctcgtggaggttgggaggaaatcatgcgattttgtttatgtattcgagtcatggtatccacagtgtgggcaaggcgatggtgggaggtgggacagattttgtttctgtatccgagtcatggtatccccagtgtgggcaaggcgatggtgggaggtgggaccgtgggagggccgtgggacgctggggatggagtatagttgatttggcctataggatcggagtggtgaactcctggattggagtggtgaactccttctttttatattagtatagataaaaattcaaggtgtttttgccgaaaaatttcataagtcacccccaaatggaaatagcgctagggttttttttcgcatggtctttttttcaacttcccaatggcgcacggttttttttactccgcctccagatcgctcccaatattttttctcagatcgatcgcatccgtagcacccaaattttatgtccgattcccaccccgatagctccctcccaaatatatacctaacctaattaaaaaaatttcgtccgcaacatcataagtccaacaaacaacaaatcatccagagtgcgcatcaaataacacacaaagttttaatccagtttatgttagatcccaaatataagaatagaagaacagcaaacggagataaaaaaaacaaatcgaacagaaatcgagcagatttttccatagccgcctctgctgccaccgcctcccatggccaaaaccggtgaaggggcgcggagtggccgccggcagtggcttgccgagctgcgctgccgacgcccgccaccaccgtcgtttcagccgagggagggaagcgagagggggcagagggagccgccgccgctgtcgccggatctgtcctccgcagccgccaccaccactggatccacccatggccgccgcgaggccgccaccgccgctagatctgccgcaggagggaggcgagagggggcggagggagccaccgccgccactgccggatccacctcctcccgccgacgccgccaccgccaccgccaccgccgccggatataccgcgggagggaggtgacaaggggttgagggagccgccgccgccgccggattcgtgccggaaggagagcgccgccggtggaggaaggggggagtggccgaggggaagcggcgctgctggtgggtcccctcccagtcgccgcgccgtgccggtgagacaggaggaagagggggagatggagcggtggcgccggtcaccggtggagggagggggagggggagcggcggcgctggtgggaggaaggttggggagaggcgctgccgccgacgttgttttgagtgagagagagatggggaagaggaaatggttttagggttagggtttgggctgctgagtatttgtatagatcgggatcaatcaggaccgtccatcagatcggatggctacggcttctcccgcgtcgggccgggcgccgttcccaggccgcccacactattgggccacatgtacgctccgcacaaataagtttactttatgtcgctcaagttgtccccgaattgttcccaggccgcccgcactattgggccacctcatggaccgcatgtacactccgcacggaataagttcactttaggtcccttcagttgaactttttttatttcaatatgtaaaactaaaccttaatcatctaatatttttatatttgttataattttagtttttcgttgcaacgcacgggtatttttatagtatatacagaaatcagaaatgcatgtactggtacaaactcttcctaggttgcaaatttgctcgactatatatgaattcttgtagccgcactgttagctagcgctaaggccatgattgagatagctaaacacgttggattgatggataatctattttttttatgatatctatttaagggataaacgaataaattaactacaacaaagttgaaaagatgctttagaaaagtattacaataaaaattatattataaaaattttgcacgaaacaaaccatctaagagcttggaagcatgcaaacaaaaacctagaatccagaatcatgaaagaacagggcctaaaagctaaagctaccaacttggggtctctcagccttgaaacataagaatgtacttgctctgagagtttgattgaagaatcacagatctctgatgccatcaaatagtactgctagacttctcttagaaaacaaaaaagaaacactgtgtgctagattagcctgttgtttggatctaccttaattttaattttaattgtcagggagataaaaaaaagaaagagaaaaggaactgtgcacgctgcacacgggcaatcagggagggagggaggtttgggatgtttttctgaatgattaatctaatgacctaaaataatgggttggatgtttaagttaaaaccaatgataatatgttttgttttcctatcatcatttttaggatttcgtctgatttaagagaacaacgtaacatagcgtttatagaatgtataatgaacttttaaaaccgcatgctgcacggaggaggaagtgagggaaggaggtttaggattttttttttaaaaaaaaatagatctaacgacctaaaataatgtctcaattgatttaaaataatgtgtccatcaatttgagtcaaaactgattgttggatgttttgtttttgtccataattaagaacatcatgtagcggattagaagcgtttatacgatgtttaatggacttttagcatacgatgtttaatggacttttagcactgcatgggggtagagggaggggaggtttgggattttttttttggaaaaaaatagatataccaacctaaaataatgtgtccatcgatttaagtcacaattttgtggatgtttttattaagaacttaccagattcttctctaatttaataatgttatgtagtggcttagaagcatatataagatgttaaatggactttaacatcatacacggccggagggagggagagatgtttgggttgttttcttttattaaaggaaataacttacgaccctaaaataagaaactgatagtcgaatactttgtttttcttagattttctagtattttatctaattcagtatcaccacgtagtgagttagaaaacattcttaaaatgacatagggagagccgctagacatagtagatagaggtctatttatgggttttttgcccataaaaataattttaatttgtcatgaagataataaaacagatgaagtaatgcaaggaaagttcgggatggggtttccggttttttttttacaaaatagatattactgtctaaatggttgaaaatcgatggtcgatttaatttattaaagtgtcatttagcgaattaaaagtgtttgtagaatagcacttaacgagtcaaattttattatatgctagcaaattgcccgtacgatgctatggaaagaattaaatcaatgcaacaataacattcggaaacaataacattcggaggaatcaaagtcctgctttaattagctattacatcagtaacaacccgcggcccccaaatcccgtcgccctcctcacaatcgactccctcaccccgattcaccactggtctcctcctctccgctgcacaatcctccctctgtcaatcgcccctcccaccccttgccctcttccaccgccgactgtcacgtcgctgccgtcgtgttatcccgccgccggtactgtagatccccgatccgttgcccgcctccactcagctgtcgccacctccacatccgggaagacatcgtcaccaccgcctccgtccgcgctgaccccatgctgtccatacccacacaccgccggtccagtgcatgggcaatgcttacagcgtagccctatactcctatattaatcacagtagggtaggtagtacaaacaaggtgcatatcagaaagcgctgaccccacgctgtccacaccgacacaccgctggtccagtgcatgggcagtgcttacaacgtagccctatactcctatattcatcacagtagggtaggtagtacaaacaagtgcatattagaaagtgattttgcacttcaaaaatatctatttgtgatatattatatagtgtaaatcaagtttaacatatatgagtcagtggcggatgtaggattttataaataggggcacgataaactaatctatttataaaacaataaattatctaagtgttataaaatattatctctaaagaaatgtaaaaaatccaatacatcataaaaaaactagactagaaataaactaaatcttattttttatatgtagatttcattgtaactagacggtaccccgcgcgttgccgcgggtgcgaacatagccatatatggacatagatgttatattcaattttatttgcaaccacttatccaatcaaatgtgcaaacatcacatagatgggcaaacatgctaaacttgattaatttattttatatgtataactgacttcacaagtcccagagatgatatgaagggaactcattttacatgacaaaaaggcaagatatatatgaaaggatatattttttttaatgggcatcaaagtgcctaatatcaagcacagaggtaacatggaaaagaatcaaagataaaactcttacattccatgatacttaaggtctccagaatcatgaattaacttggaacagggaattacagcttcaattgttggtgccctaaccattaaaatttcctttctgaaccgctgcagtttaagaaaagaacaaaaataaactcataatggtgggtattggagcaaagaaagtattaatctctcctgtagttcctcaaagcagtgcttgattatgtcaaacattacagtttcacttccagtcaacacagagccaaagaaaatacctaagaatattgcaaggtacagctatgttacatgcaagccatgtcatgccactttgctgggtcctctgaaagcagttcaagtgttaattcatatgtaaagattagtatctattttagtttttctctttatacctatagattagtatatatgttataatatcagtaattcacacctaaattatattagtatctatgatatgttctaatttacacctaaagattatactacctccatcccaaaatgtttgacgccgttgacttttttaaaaatgtttgaccgttcgtcttattaaaaaaatttaagtaattgttaattctttttctatcatttgatttattgttaaatatacttttatgtatacatatagttttacacatattacaaaagtttttgaataaaacgaacggtcaaacatgtttaaaaaagtcaacggtgtcaaacatttagggaaggagggagtagttatgtaaattaccaaaaagggaaaaatattgtgcgcagaaaaacccgggacataaatctgagatgccataaaaaaaatatatgccattacagtcgctgaatgttgcagaactacataatctggtagaaatagaacaataagttagatagtggagtcatgtttcatttgactgataactatgcaatacattttgagctataaggagaataagatagatgctgctagcagttcagtagtacctcattgggcttctatcactctattttagttcaaaagaaatagtacatgcagttggctgctacgaagccttgatgtgacaaacaaaataatttcatatttctagtatgaagatatcagtagtttagcaacagaatgtaaggataattagtacacgtgcttgaagagaccacgaaattgcagcatgtcattcttgccgaattcctgcgtttcacctcccatgcagctgcagagaccaagacagtttgctcatgagtgaaattaaggtgcaaaagataagtagaataaaccttcagtgtttgaactggattgcacaagcagtggaattaatcctaacacatagatatgcatgtttccatatagagaggtggaaagcaagtcgactaaactgcacatatggctgtgttctgaacataacctgggtataagaagcatcacttcagctgcataaaggaggcaggggcggagctaccattattcctgggtattcccaggaatacccaactttttttatcacaaaacaagtatacttctagtatatacacatgtacacatattagtgcacctaaatcctcaattcttcaatccaaacacagcccaaccggcctcttgcgacgcctccaccaacccgacccattccgtcatgacccatcagacatcagttgacccacttatccaccacccttctagacggccccctcttgctctctctccgtgacccatccctccctggctcggctcccctcgcgccgctccccatttccaaaccctaggcggcggcgcggcgaggcggcaaccggcagcgggagctggaccgtgctatcgcggagggggaggccattgccgtggcgagcggtggccgacgcccgccactccgccaatctcgggcggtcaggccggttgggtggccggtggccacgaggggcagggccagcgcctcagcgcttagacgggaatacccaactttgaaatcctggctccgctactgaaaggaggaagatgcacatgtttttttaatttgatgttgttgccccgattaatcaaaaagaaactgaaatagcaatcccacaccatttgctagacccatgcaaacagatggacttgctttctatgcataagaatgttgtggagaacaaaaatgtctgcatactgaatctataactattatttttacttttatatgtagatagtacttaccttggaggtaaaccaaagaagttcaattctataggtagaaagcactggcaacatagctgaataaattttaagaccgcatatatgtgaaccataaaagtaagcacaaaatagaaggacatctgagcaagcattttttcctgtcaatccaatctaagtgctgttttggcacaacatatctaccagaagtgtttcttcagtggaataaacctatttatcaattcataagagcacagctgaatgtagcacctgtactatagcatcagaaagttgaaagcatgaggctacgagactgtatggatagaagtaaaataaagtaaaactaaaagttatagttagatcaaactaccttcgtcaaccaaaacaaagccacgagtcttgcactgcaaactcaccagccaatcaatacttgcagatcacatttagcagagattaagtgatagaaaataaacacaaattaaatcactgtgaaaaataaaggcataaaggatggcacaaactcaacctgaaccctaggagcaactacgacggtgcgaaatcaggcaacggcgtggcagccgaggtagacatctaacgtggggaaagtttataggacaaaacaatagggtttattaagcgaatggcaacacgggtgaataaatttgagcgctgcatagatggaaactatggaagtaagctcaaacataaaaatatatctgaccaagtaacttctttgttgccaagtcagtctaagtgctattttggtaggtttctatgaaaagggccaaaatatggtctaacattgttaatgttatgataggacactctgcatagatatcgattgaagaacacatctcaacaacatatggatttagaatataagaacacgtgaatataactctgatggggtgacatacatataaatggtaggcaattgctattatatggactgatagagaggattttgacattggactcataaatcccttccataggaatgtgccatcgccgcccatatatactctttgcttgtctgatgcacactgcagacatttttataactataaatatacataaaaggctagtgaattaccttcagtcacacttgtccattgtactttgtgatacggaccaatcactgtagtaaacattcactaaatcagttaattaattaacatgtaaagcaagacataatggctatgcacattccaactggagcatgtgtatctgaggaaaaggtaatcaacaaacagaacatacatatgtgatcttagtgtttgtgcttaaaaaaataactgcaggtatcaacaaaatatgtcattctaacattgaaagttcataagcatattgtaggtaaaacatatgtaacctcatatctttagacttgatttacctcatatctttagacttgatttaccaacaccatagaaaaatagaaaaataaagtacaggctgccgctagtcatgcaaagttgatatgaaaaagagaagtgagaaaaaggattgcaaggagaactgaacaattaatttgaggaatccaatcagcaggaacacccacgtgaattttcacgttttggttaccacgtgcttatgggcggtcgatgcaccataaatcttgcaaaaccaagcctgcgaggaatgcagggaggagataaaacaacggctacagttaacactgtgacccgcaagaagacaccggcatccgcacctagcacgatgggaagcaacgatggtgatcactggccctgcacggagacagcgacggctggccctgaaagcctgagaagaaggcagcgactccggatccagccccgcgaggtcgaggggagtggaggtgctgaagagatgccggaggagcgacgcgagatggtcaccgggggcgtagaagaagctcacccggccagccgcggcggtcaagaatggcggtggacggcagtggcgttggccgcgacgaagcaggaaccctagcaggcggcggcgaagaagaataggtagcgcggaaggggatcgacagggaaaccaaaggagaaactaatcgcgacctcatgggagggtagaagcagaagaggagacggatcgttgacgcgtggcagatcagacaagaggggacggatagttgacgcgtggcagatcacacaagaggggacggatcgttgacgcgtggcagatcagacgaagtagacacgctgactagctgttggctgaacagtagtatagtaaaacagtaccatgggcaaaacttgtaggcaaaaactataaggtttatatgatgtataggcatgtactccctccgttcctaattgatcatcatattatatggatacaccaaaatttcaaatatgaataaagaattcatggtttaagttgaaagtttttaaatttaagttgaaaattttcaaatttgagttgaaagttttaaaattttgacttgaaagtttaaaaatccgagttgaaagttttaaattttaagttgattttttttaaataattgaaatttaagttgaaagtttttaaattttagttaaaagttttcaaatcttaacttgaaagtttgcaaatatgagttgaaagtttcaaattagtgttgaaagttttcaatttggaatatgaagtttctaactttgggtaatcgaaagacttaaattatatttgaaaagttacaaaaaaaacaacattgattatgcctaattatccgggaaaagaaaacaaatccagaactaaccaagctagtccaaatgctaatcgcttttttttgtatcggttttttccatagcaccgctcgtgcgttacactaacgacacatgtccgtgcgcgccagtaactcatctcgcgcgtacgcgctaattagtcttctcgcatttactcggataacaaactcgatgcatgtaccatcccattatttcctagccaatagcaaatcaaaacattgcatgatggttataaatactttgtgcaaatcaaaacattgtataatggttataaatacttgtgtgcatggatatcaatgtacatttatcgaatgcacaaataacgaatagacttaatgaatgaatacaaatatgatgatcatttggaaatattctaaaaaaatatatgatgatcaattaggaatggagggagtaactagtaaatagtgaatgtcataactcactcgaacaatatatatagtgcattatgattattggattcataacaagtgttgatcactagttcatccaaaaaaaaatatgactatatcgtttaatattattaacttttatagcattctagataatgtttagcaaaagtatctttctcttaaaaaaactagtcaaataccttttataaatataatatcattaacaaagataatagttattgtttcctcatgtaaaaacatagataatatatattatggagcacacacacatgagctagttgctactccctccgttcctaaatataagggattttagttggatgtaacgtatcctagtacagcaaatctggacaggctttatgtctagattcattgtactagaatgtgtcacatctaaccaaaatctcttatatttagagacggagggagtagtattcatgtgcaagtaatagtgctggttgtagtaatattattatcaaaaataaaaaagaatgagaaaacaagaagaagatgaaacaacagaagaatagaatataaggttaaagtttttagtttcacaccatttactacaaagaacaattttaataatattagtatattatcgattaatgtgagtatataccataccatgaatgtgagcaaccaccctcatgtgtttgcgctagtgactaacctcctctttttcttacttctttcgaagttctttgaacatatttaggtaataatgttttgttttgaataaaaaagaaacaattcaactagattattttttagagagaatccatcgtgtgccgctgactttgtccctgttctataatataccactgagtttgttaagttctacagtatgtcattgtattttgcttaaattctataatataccatcaccgtccatttaaattccattagtacttaattttgtcctaatgatcgaaatatccctaggaaaaaaatttccaaaatttggccgaaaattccgaaatatcatattataaacgagacagagaagttgcccatctcaaactttgtaagttttactatctgtatgataaaattgtataatgctaactgaggccaactagatgacaatggtatattatagaagttaagtaaaatgtgatgccatattagaacttgagaaacccaacgacatattgtagagcaaggacaaaatcagtgacacacaatgaattgtctctgttttttatagttgttcggttaactacctatctactatgatgcggcaattttagaaaaaagttaaatcttatactataagtccatatcttacacattaaattacatacacttataatataattttcaaaatataaaataccctattctcattttataggagaaatatggaaaatgatttattatctatttaattatgagaaaaatattagttcaaattaacatatatgtagaaaataaaaaacaatatgaaagaattatggaaatacctactaatgtagtcatcatatatcatgcaatgagaaaagaagaccatagtcgaatgctttattattgagcaaaaatgatggtattatttttatcatcttttagaggaatctatctaaccataattaattagcccgtgtgagtagaagtctgtatcgtcatgcatcaatatatcatgagattattagttatagctaagtacaccgacccaaccatacttagcatatcacaagactatcgggtaatggacaattatctttaattgtgctagagaaaaaagtactccttccatcccataaaaaaccaacctagaactggatgtgacacatcctagtaaaataaatctagacatgcatatgttcagatttattgtactagaatatgccacaccagttctagattcattttttgtgggacaaagggagtaaattacagtccatactacgtattcttaaaaattcttaaaagcttcatataatgttattctttaaccattctttatatttacacaatagctaactttacatttcaatttggaccaccttattctatccatctccaagtccggtgactcagcaattactccgcacattaactatctctctctctctccattttctttttccctccgatagttggataaccgatagatctagcaaggagcctagatatagttccttcgctctttgttaggtcagctcctacctcccaaagtccatgtaagcccgacatccccgacctcaacagcaaccataacaatagtgtgcatcacgataggagaggagaaaaagatttgtcggttactaaagggtaaggctgcgcatgtaaaggcaaagaggaggaacgatggtggctcatggagaaagagcggtgatggcggtgcagttagtggttgctggtggtatgaagaatttgttgtcgacacaatcacttaattttttcttaagtattgatgatacatgggtcaccagttatataaagaaatagtcctagctagttttaaaataataaaaatattgactgaattgaccattgtttcacaatggaccaggtcatggttagtcttttcaatttaggccatatatctttgcaattatttgcaacatggaccaggctgagagagttgggctggctgctaagatgacttttctactccagccatgtaattaacatcacgataagctcgagcgagcctcgatcatcacgcaaaccagaaaggggatcggcggcgctggtgaagttaggagaggaggcggtggccaggagcacaggacagtacagcttagagaaagattagagccacatacatttgggaggagttaatggattgattcatgcttgctttctcggttattttcccagcctccacctccagtggctgttggcgccgctgccggaccgggacaggtaacgggattacgattttcatttgggcagaagcaacggatgatatgattaacaggatgttatgcaggctgtagatcgatggtggaagcgcacgaagtagaagacattgccacttaattcgcagcgtggccttattcagttcatgatgcagctcacactagcattacaagaagatcaacgccattgccagtatgcctggcattacctgccggctgccgccatgcttcggagtggatggttcaccgcgcccgacagcgcgtcggcgagggtgtgaggctggataatggattggctaatagggattggtacttgccgtccaccactcacgctgttggcacaatctcctccggcgttgtcgacgtcggccttgagcccgccctacgagagccacttcatctctctactaagtaaacgcgatgttggagccgcgctggcagtgaaaaacctagattgctatacctggtccaagcaatgttaagtgaaaagtttggtatagacatggttcattatgcaacttgggtaatagttccttctttttcataatgtaacttactataccatagtgcaatttactctaaaaatattgagaaaagggcgggtatcgcgtaaaagaaaaagaaaaatctaagtctcctccgctccttgtgccgccgccaagacgaacaggggagggccgggcggcgagacgagcagagcagcggaggggaggggatcctggtgagcatccgcgtgccctttctgattcatctctctctctctcccaccccaccgggactggaatttgcttgcgttcgtgaaccctactagcttctcttctagatctggaagaagctcttttcctcctccttaatttgatagccttaaacctctcttaattcaagtaataacagtttgtttcttcacccaaacccccatgtcccaagttggatccgccgctgatatgagtttgtggctttcttcagtatagatgaaagttctcaaatatttacctgcaggggatcttaagtttgttgttcagttgagtctaggcagagtagctccgaccatggtttttctgccatcatgatcaactaagattcggttcttaaatagtatattttagaatcaaccaaaatacagtttttgcttatccttcttatatacttgatctcgtacgtttccaacgtgcacttagatatttgatctctcaagttctgaacaattaatctgcaagggggaaatgacttaactttttatcacttttctctacatgtttataattaaagctgccacaatatgaatgctccatatgtaaatgaatctgctgagtccttcttaattggtcataaggatatatttacaaaatatgtccactcatagttttttcagtgtacatgtatgagggaataacatattgagatgcttatgctgagggaagaagtgctatttttttttaaaaaaaatcgtacatgagtcatggctgtacctgacttgatgtgtgtatgatcggttttagcattaatattcaagcaaattagtgcataggtcaagttgattttttcctctataatgatagtttgtggcatttctggtgttcttgtgtgagttgtgttgttgagatgattgacaatatggtacttcctccgtttcatattataagactttctagcattgcccacattcatatatatgttaatgaatctagacatatattaatgaatctagacatatatgtgtgcctagattcattgacatctatatgaatgtgggcaatgctaaaaagtcttataacctgaaacggaggtagtactacattgaagtttatggtgatcttgtggcctgctgttcgagaagctgaaaaataaagtttgcatcacgtaccatgagattatttaacgagatggtcacattttcattgcatcaatgatttgtttatgtgttgcagtcatggaaattaatactggtgatataaggggctatgcttatgttccctctcgcaaggccgccgggtcgccattatgccgacgccacgctccgcagggggcagtggcggctctcccaccacctccgcgccgcagccgcagccacaagcggtggtggtgcgcccgacgtgttcgatgcagtgcctgccctggacgaccgcatgcggtgcagcgcgctgctcagggagcgcgcagtgggaggggaccactacgggtgcacctccctcctccggtggatgctggcccggggacttcgccccaacaggctggcgctcgctgcggcggtcaaatcgtcgtccgcgctccccgactgccgcggcggcgcggcgctcgggaggtgcctccacgggctcgctgtcaaggtcgggtacgcggatggcgcggtggtggcaaaggcggtcatggacatgtacgggaggatcgggtctctcgcggacgcccacacggtgtttgatgagatgagctgctccgacgcggtatgtaggaacatcctgatcactgcctcctcccgtgctggactttacaacgatgtgttccatttgttccgtgcaatgcttgctagtggtgtagatgagagcatgccaactgcagtcacggtcgctgtcgtccttccggtgtgcgcaaagttgagggtgctgagggctggaaggagtatccacggctatgtcatcaagactggtttggagtttgacactctgtctggaaatgctttggtatcaatgtacgcaaaatgtggtgggagcatagctatggatgatgcgcatctagcattttctacaatttgttgcaaggatgtggtttcatggaactcaatcattgcgggatattctgagaatgggttgtttgaagaagcacttgcactgtttggtcagatgatctcagaggaatgccttccaaactattcaacattggctaatgttcttcccttctgttcacttgtggagtatgggaggcactatgggaaagaaattcatggttttgtggtccgacatggtttagaaatggatatatctgttagcaatgcgctgatggcacattattccaaggtttgtgaaatgagggctgtagaatcaatatttagaagttcaaaaatgggagatatcgttacatggaacactgtcattgcgggatatgtgatgaatcggtatccctcaagggcattgaaactgtttcaggggcttttgtttgccggaatggctcctgattctgtttctcttatcagcctacttactgcttgtgcccaagtaggcaatctcagagtgggcatcagggttcatggttatatttttcgacatcctgaacttcttcaagaaacatcattaatgaatgctcttgtcagcttttacagccagtgtgacaggtttgatgctgcttttcgatcttttatcactattcagaacaaagactcagtatcctggaacgcaattctctctgcttgtgcaaacagtgaacaccatattgaacagttctttagactccttggtgaaatgtggcatgacgtaactcagtgggactctgtcacgatcttgaatattatccgcatgagtacgttctgtgggattaagatggttcaagaatctcatggatattccttgcgagtcggttatactggtgattcttcagttgcgaatgctattctagacgcatatgcaaagtgtggctacctgcatgatgcagaaacactcttcagaagccttgcaggacggaacattgttactggcaatacaatgatttcttgctacctaaaaaataattgtgtggaggatgctgagatgaccttcaaccatatggctgagaaagatttaactacatggaatctgatgagccggttgtatgcacagaacgatttgtgtgatcaagctttttgcttgttccatcagttgcaatctgaaggactaaaccctgatactataagcattacaaatattctttcggcttgcatccatctgagctcagtgcaacttgtgaaacaatgccatggttacatgcttagagcatccctagaagatattcatctagaaggagcacttcttgatgcatactctaagtgtgggaacatagccaatgcatacaacctctttcaagttagcatgcatcagcaccttgtcatattcacagccatgata

SEQ ID NO: 18797 - DNA, 10242 bp, Oryza sativa
ttctttcggcttgcatccatctgagctcagtgcaacttgtgaaacaatgccatggttacatgcttagagcatccctagaagatattcatctagaaggagcacttcttgatgcatactctaagtgtgggaacatagccaatgcatacaacctctttcaagttagcctgcataaggaccttgtcatattcacagccatgataggagcttatgcaatgcatggaatggcagaaaaggcggtagaactattctccaaaatgcttacacttgacattaagccagaccatgtagttctgactgctcttctgtcagcctgcagtcatgcagggcttgtcgatgctggaattaagattttcaagtccatcagagagatctatggagttgaaccaacagaagagcactgtgcatgcatggttgaccttcttgcccgttctgggcgtctccaagatgcatacagttttgcgttggatatgcctcctcatgtggtcaatgccaatgcatggggctccttgctaggggcatgcaaggtccatggagaggtcaaaattggtcagcttgcagctgatcgcttgttctccatggaggctgaggacatcgggaactatgtgatcatgtcaaacatctttgcggctgatgataaatgggaaagtgttgagcatgtcaggaaactgatgaaatccaaggatatgaaaaaacctgcaggatgcagctggattgaggttgagaagacacggcatttgtttgtagccagtgatgttcagcaccaagataggttttctatctacgatgtgttgggaagtttgtatcagcaaatcagaggtacacagggagggacagaacatttagttgtgacttatgagctgtgacataaaacactcagtaaattacttggtgttctggccccgtcattgttttgggttgccaaagatctccatggaactgagtgacctttccatcacatcttccgtggtgagcttggaatctcattatttggtttgattctgttttaaccttcttgtcactgttgttcttgatgttttggtgtaacactttttctcacttatgcttgccattgtgcagagtaataagtaacagctactgatgtttttcttggaatacttacactacatatcacttgcagggattgcaatctcatatctttccaatttttttcaggacaacaaatggagacatctgcttacaaccgtgaaccggttggagtgtctttgtcagctcaaaaaaagattggttcctggcgatgcattgttcttcctgaggtaagcaatgctaagcgtgtcatttggaggcgaagcaaaatcccctccacccacaaaccgtgcgaagaaagtatttttcgctccccggaatccgctgtgacccatgagcggttgatggatttcaggggaacagctgacgcagcacagacgtccgaagctagcaaggcatcctcgtcctcacgtacgtccgatctgcccccttccacgccgtggttccgggagctgtgggtcaacgccgacaaatagttgcagccgtcgcctaaggtatgtcaaatcgagagaggagattggacgctgtggcgctgtgttctgtgtggttggtggtgcttcttgggtcatttgcaaacacctcctctaagatagcctgtctgcaaacaccactttcttaatcgagaaggtggtacttcttgattctaattgatgaatcaagaaagatggagtctagtatatacaaaatgtggtcatttgcaaagcagacagagaaaagggttgaagatctatattcagatgtgaaaaaggtaagattatacttcctctgattccatgcataagtcatctttgaattcctaactcatttccaaatataagtcataacttgaggcaccttttactctcattttttttccttctttgtcctttatgaatacatgttaccactcgtgaacatgtccccactgtgtataaatgaagggcaacgagctgatttcatcactttcttaatccttgtgcacaagtataaaaaaccatttgtatttggaatcagagtctcagaggaagtatatattatcatttgttttgacattcatgtgaacatagatctaaggcagaaatgttgtatttcttctgggtacggctgctgctcagtctgaactacttattagctttatagttggtggttaatttacatgtgcctgacaggaggttgctgttggtagccatccttactttttttaaataaaacaaatgttccagatgagatataatttttggagacaccagggtaaagagaactgtgggaaattctagaataatatacccaaaaataaaatcccttttgtttcttgaaaacacaggactacgcttcattttattaagaagaagaaatatgtacaaacgagggatccaaaaggacccctcaatacccccaaaaaaaacgtcacaaaaggtgttgcttgactaaaatcccttatgagaaagctaataagtgaaatataaaatagtattggccaagtggagtactttcacgttcgtctttcctatatccaattcagcactccactggaaattctgtgtgcccctacttcacttcagcttggtagtttcccccacctttccaggaaatctgggatagaatactttatgcccaatcattccaactaactatttcatcctgtcttagcgtagcttttggcacaaaattagctgatgcttattcctcagataatattcctctgaaaacatgaaaacattccatctaactatttcagatggtcataatccttttgtatttctttggcaagccgttttgtactaaaacctgccctaatgtgcttgtgtgagtccttttggactcttttccttcttattaatataatgatgtgcagctctcctgtgtgttcgagaaaaaaaaacttgaaaacattgttgggtttgaccaatgattaaggactgccacgatcatcaactgctacagtttaactagttaagaggttccgagatactccctccatacccataaaggaagtcgtttaggacgcgacacggtctccaaaacacaactttgacttcttgtttctataaaaatatttattaaaaagtgatatatgtatacttttatgaaagtatttttcaagacaaatatattcatataatttttacattttcaaactcaacaacttgagagttatttatgatttatattcccaaggtttgacttaaatattgtcctaaacgacttcctttatgagtacggagggagtatgtaattgccaatttgccaagtgctattgctctgtgaagtgttctgaaatgttcaacacctcaacattcaaagtctctacatatttctatatgtactggcatggtagttttcattcatactatggaagctaaatagaactgtgtggcatctgcagataacagtgtcctattgcttgcatatgagagtagtaaataatttgattttgttgcgaaatacatgtgcttgacatgtatgcttgctgttaggttgatatcacccttatacaatgttccagataagataattgttcgatgcaccacattagaatttttttcctggcaacttcttttatgatatagcaaaataaaagtattaaaagtaaataaaatgctttattcatcaaagaacttgaaaatattcatatggatttgagtagggaagtgttatgatgatctccaacattcctgcagatattaaaatttctaaatttatattgtttctttttctttgtgcaattttctccaactacttagcagctaatcatgccttatctatgttttcgttaaagcagtgaacagaacatatgagcataatctgaacagttacttcagtgttaagggatgcttttgggcatgtgtttaacagtactgatttcattccatttcatttttataggcgaagatgaacttgatgaaggaatctaaacattcagtagatccagaagctcccttgctcatagcatagacccttgaattttattgaatagttagtttatgaaactttcgttactgaatatatgccagggtgtgcccccaagaatcacgtatttttggaatttgaaatgaaatagtaccaaacaaatttggagagtgatgaacttttttctttagtgactaatgttttatatttttgtcaagtgccatgtttcgtgctaactttcctaaactttacatatctctagacgtgagagaatgttcaaataactgatcatcaccgtaaggcggcaaagccgcggcaagttttctacttcttccgacccaaaatattgctagtagtatatatgtggttgttttttaagaaagaccctacgtttccctgttttagagcgctatccttataagcggaattttcgcttcttgggattgtatttctgtcaaagacgagtagttttccggataaaacacaccggtgccttagtcggttcgagggtatatgcatattcagtgtaaatgtgaggagttttttttttgcaaaaatactaccacgcgtcttttccttcgcggatgtacacggccgtgcttaggctaacccacgaaacccacttataagctaaaataagccgcaagtccgtttattttgatctataagtgggttcgcggctgacccacttacaccccttgcgtgctaaaacagcgcaatgaccagttgaatggcgtgttgccgattcctctcacccgatcgagtcatgctccagagcaatacaaacgtggcagcatctcaagacgccaaaaaattttaaaaaaaaagaaaggagaaaaaaaaaacgtggcagcatcccgaggcgcccaaaaaaataaaataaagagaaaaatggtagctttagtggtttattaattcatgattacatgtgaaactttgataatatatcgtatattaatatatttatattgttttattgaactgtataatagtacaccagtatcgactgtactagaacactatattccaagtaggtgtgggtattcggtctgaccgaaaatttcagtctcggtatttggtctttatgttagttcgtctttaaaaagtgaagaccgaatttcaacacaaaaatatcagtcctgaccgaaattcagtaacattttcatatatgcaaagaaataattgaaattttcaacacaaaaatcacaaaaaaaatcgcaaacacgtatgagaagactcttattaggttacatgcctgaataagtagagatgtgaaaattagagtttaatcctattgaacttagtggattataggttgtattttgacaatttttttaaatttggccttttcagttaaccaatgagactaaccggatttaccatacaaaattcagtcttttattacttaggactaaattggtctcggtctttcagttcagtctttttctactaacccctaattccaagagccaaacctcagtctttttggtttgttttttttttctcacccctaattccaagagccaaaccgggatggcctcccgaatggaattgacaaacttggatcagacggcggaagcttagcaaaaatttacaaatgcttgaaataagcataacaaataggcaaattttgctacaggacatcgcaactttgtggttttgactgtaggacaccgcacgaagtcacttttgggaaagaatactctcaaaagttgaatatttgctggtggacatcgcacccattaaaataatattttttggttgaggagacagaaatcacgtgaaagtaatgaatgcccttgggccacatgtcggatccctcctcctcgattctgagctcacgcgacaagtccaaccaccgtggcgatggatttctccggcggcgccggcgcgacgttgctggagatgtaccagaacgcgtggctgctgctgctgctggtctgccggtgccacccggacgcgtgccccaccctcgtcgctacccccagtatggcagaggccttccgagcccacctcattgcggatggctgttgacacgggttttggctcgtgtcctaaatataaatataatttgttaaattataaactaatatattatcttaaatatagtgcgtacaaaatatatataataataaataagaattttattgggagacagatggtgaagtaatttaaataaatagcggccacgaaataaatggccatgaaataaaatataattcacttatattggacaaaaataatttttggcttaaaataggaatgcatatacgcgttccacataaatatagcgtgaacaaatatttttcatgcgcttttcgtcggaccggcgaacgctaatacttagctttctcgtcgtatccgcatacgaaatttggcctaaaacatatggccatgaagtgggattttctcactacctcgaaatagtcacaccccgaatattttcagaaaaggcgtactcaccatataaaatagcatacaaaaattaaaatgtaagccaaaatagatgtttagctggctagtgaaaaaattatactctaaatagtcgtgacttaaaataaaaatgcatgttacatgcgcgccaaattaaagggggtcgcgtttgacattatccaatatttttatctcgatgtctagatgttggcttgagaaagccaccgtgataatatgcatgtcaagacgcgatgcgtgtcgtataaaataaatttacggcagtgacagtccgctcgatagaaaatgatgcactagaatatatacgtgtgcctctttaaaaaaaagagaaaagactcatatccaaagtgtttataaaagtaaataaataaataaattgaggcgcccaattaaatgggagtatatgcagtcaaaatataggacatacagaatagtcatgcatgcaaaaaaaataaaatttgaaatcaagaaagagacacgcatgtatttacaaacaactgaaatttaaagaaaaaaaatcagtcaagtccaaagggcccacacgtcagtgaaagcaaagagacaagtggtcaagcccataacctacccacgatcaccactaatcatgcatgcatgcagcaaataccagcacattcgtcccgtcaaactgaacgggcccacatatcagccaaagggatgtgcatgcagtcaagccattgcccacaaccaccccacgatctctgcgcgcgcgcgggatcctgttcaaaatcacataaagcaaattaaccccctttaatcctcctcgataaatagaggatcagggctagaggcaaaggggagttcgctggggagaggttccaagaaggttggtgtgagggctggctaaggcgaaaggctgctgtgctgaatcgctgctattacctccgtcccatattacttatctttttgagtttttgtttgtcaatgtttgatcattcgtcttattcaaaaaattttggaattattatttattttgtttgtcaatggctttattatcaaaaatactttacatatgacttatctttttttatatttgcactaatttttcaaataaaacgaatggtcaaacgttgcaaataaaaagtcaaaaacgtcacctattatgggacagagggagtagttcgctactgcaaagcaattgccgccgtgctagtttctcgctctgctgtgccggaagaataagaggtgttccaaggtgggaatcatgatcctccttcgttcttaggctcggccattgtgtacgagtcgaggaatctctcaattctccttcctctgctcgtgttaatgtatttttttgctgtctttcggttcggccaatgagtacgaactagggaattatgttcttgacatgttcctaggcttggccatcatgagtacaagccaaaggaatttttcctctttgttgtgtccttcgtctcagccaacgcgtatgagacaaggaagttcgtttcatttgatggcttttaacatgatttcacactttctcctatggtccggccagatgaatacggacctaggagtggtttccatgcatattcttttcatgtcatcctaccataccctctgatttggtcccgttagcagatacaagcctaggcgagattctcgctctcaggttcggtcctctacgagccgatacaaatcacagatacaaacataaattttgcataattcaccataagttaaataagcacttgcttcggtcacgcttcatagcttcaagccgtgctagtagtgatacaggcatagtgataaacaaaattaattgagcatattaattagcacacatatttgctagttttgaacatatgttcagccatatttctctaacaagaattaaaataaaatggcgtttattttctttcccgtcatcaatggcatcggcgatggggctagccggcgtccacgcgctcccgttccacccacggagtacagcttcccagccggcgtcgagctccatcgtgctcccctgcgctcggaggcggaggggcgcggtctggtggtgtggtgttgggcacgccaccagcggaggagcgccgctgtggatgtggccaaggtaggccgcgcgcgctcagcggcggggcgccgccgctgagcgggtcgctcgtgctccaggcgccgccatcgagcaggctgatgtcgcccaagggagaagcgagaaaagaggaagagagaggaagagataaggggtaatttagtcaacatgaaaacattaatttaatggatggagtgtgagtgtctcctgagaaataaccacatttacaaagcgtgttcctccaaaagtgacttcgcgtggtgccctacagctaaaaccacaaagtcgcaaatgtctggtagcaaaatttgcccaacaaataaaattcttttgctcgagactatacaacgatttgtcaggtctatcggtttctggaattgtagggacaaaccaaaatgatatcaggatgcttcgccaagttcagagtacatctttgaaccaaagatgaattgatgattagttactttaatcattggcatttggtaccccgtcaaggaataaaagactacacaacgaaaaatacaaggggaacaataaatacctctgccattgaaaagaaaagggttagcattgtgtgctttctaaaatacaagttaagttgattaaagattacatgtacaattctgtaattacagcatcgtgatgacttgacagcagcaacatggttgtgttgatttacatcttccaactccctctgcacagacctgaattaagttgcaaatggcaatccattaaaactagtcactttggcgggaaagaatataatagcacaggtgtaacacaggtcagctatatggtcagtttgcaacaaaaaaaaaagtacccaatgcagaaacgttagcaacaacgtatataagtttgtgtccttgggtatataattactatatataagctcataattattattccttatataattactatatacaaggaataaagggcaatttgttcctgaacataccaagccgtgctggcaaactggtcgcgacaaaattcccagaacaaaacagctagcctgtttcactgactcctttactccctcgagcaaaaattaaaaatattgatttgaagcaggttttatatttctgggccatctattattctgtgcagggtaatttctacttttagcgtggcagaaattttattgataaatctcatgcacatacaaagataatgaattcatattaatcatacccagcagcagagaagcaaatacatacacctatatagcatgagtattatggtatattataaggaaattttggtttggtgacaccaaaagattaccgtctttgttttataccactgattcacatgagcactttaataccatccaaagatcactcatgttcctcttaacatcattccatccaaataccattccatccaaggctaagctcgcaacagccataaaacgatttcggcactacaatttggcctggctaatccagacagatcaatttaagtgtgaaagctggtatcggacctctcaagacaaacctttaccaaaaaaagatctggtaaccggagaactttgtaatgaagactaagtttgaagagaaagatattagattggggggtctatggtaatcggagaactttgtaacgaagacagagtttgaagagaaagatatcagcttggggggtctaaagtgtgtgcccaactctgaccaccctcatgttttgtctgtctccactctacattgttgcagccaaccctagggagaggatgaggtggtgcagagacatggcaggatgcttaacatgatggcaaaggtgaatgggtggtgctggcaattaagagg

SEQ ID NO: 18798 - DNA, 8332 bp, Oryza sativa
  unsure (1)..(8332): unsure at all n locations
tggtaaaaagaaggcttggatggaatggtattaaggagcaatagggatcttttgatgatatcaatgtcggtgggtttagtggaacaaaacaagatgggtaatcttagactgtcaccaaaccaaattacgcaacagttccatacctatccccaaggcactctagcaaactcatttgagaatctgccatgactttgctgaaatctgatgatttccttgaggctcacttgtacaatgataaactttgcagaggaaaattcctgtagtgacaaccaatcatgatttcagtcaccagcaagccaaccagaaaaggcatatttggtcatagtatcacctatagacagaaagtttgattatacttcatgaccaaaaggaacagaaacagcaaagtgtccctccaaccagtgaactggataacgtttgaggccaggaatgcaacagacacagaaaaaaaattgagatgttgataaatggtaattacctggagaagtacacataacacatggcaaccaatcgttcagccttccagcgcatatctctgaatctacaacaaagaaaggaacataccgttatatcgattttattagaccgaatatgagcacataatagcagcactatcattatcaaacctgttgacacaatagcattaaattaaatgaggtacaagcaaaaggaaagattttcacggaaataaataaactcctaacaaggcttgtatctggacaggtcacaggtgtctggttgctgcccctaagtttgccctattaatagataccatattaataaaatatgagataggacactaatttatgagaatcttgctagtttcagcagaagtgagccaaatgcatacaatctgattaaaattgcaaaagatctagcaaccataactgggccaccattggcttcaaatgtattaagtagcaaatcatacaggttatcaagtaaaactaagtttgtggtggctaaatgtccacgacaaaagtcttaactattaacatgaatagaagactccaaaaagtgatgattgcccaactgaaaatccatggtcaataatttatttacagttccctggaaataatgaggtaagacaattttgacctatttgtgatggataatgccaatttctgtactccattatcgtgtgcttaaagatatattagagttatcatgaaaatcggagtgaactgttgcatcatttatgacttgttcagaaaacatccccgttgttaaatttcggcccattgttaaatttcggccaattgtcatgctgttagttccaactttatttcgtaccagattactgtaaagtggaaactcgctgatagcatggacttggtaacacatgccccttagtgggttggagctcggacacagacccagtaaaactctaaagggctgtttggtttgaggaatggccgaatgagattgtcaattgaccacttgatcctaaataagtttggtttgcggaatgaaatgtggtcatcatatatactaagtgggaaaaatgaggaatactagtcattgaaccaaatttgaggaacgatcttacgatggaccgaattctgatcaaaccaaacaacccataataacatggactatcttgtcttagctttgcatatttgaacctatagttacttataaaaaaaaagtgattgaccttgataaatcaaaaaccacataactagtttaaaaaaatctgcatccatatggcaaagtgccactcaaactgattatcttaggctcaacaaccaagataaagcaactagtttatttgtgaagacaacatgattcgtgctttgtaaatttcttaaagcccagagccagcattgaacgagtccatgcataatagcaactagttcatactttcatccagacataacccatgatagttaaatccagaattcctacatttagaaatgtaaatgctggttaaacatccactaaacttccagtgtagagaatgaaaccaccaccagacacatgggccacgagaaatgcataaaatatggctgtggtggtacaatataagactaagtaaaccagataattaacaaggtatgaccagggatcggaatcccggcgataaccagcacagttaccgctccagagccaccagctagtatccaacgtacaggccagaataattcaattttaaattataaatcatacgaactgtatatattcttgcaacatcatttgtaacagagaagtgtaacaaccgaaaaggagagacgcattcaataggggaaatctaaaaagagccttgttgcttgtttctgcagctcgaggcagtctagtcaatgtcacctgccatcatagatcggaatcccaacagtaaccagctggtaaccgttcaggatctgctggctagcaggtatctggcataccagccagaataaaacaaaattttaatacaaactgtatattttcttgcagtgacatgtgtaagtacatttgaattatatgatagagtaggaaaaaaataggcacattcaacgaggaaaataggaaataaaatatgaaactcccatcactcgtcactgcagctcaagcccttttcaatcaacgcctcttgccgtcatacggttagatacaaccgatgtcttggttatacatatatttcacaaaaagaatatagactgttggatttgatacaaaccatttcactacaaaagattgcattttgaccattttggtcaaattgtgatgcattgatgtattttatgtgccaaccggttttggaattcaaatatttggactcaaacatgtcccataactggagggaccagtattttcttttcgaaaccggtattcaaaatgttatgttagatgaaacaggtatcttggttatatatattgggcaaaaggaatatggaatattgtagtattaaatatgcatgtcactacagttttaattttgacagtttcaatctaattgtgatgtattaacgtatcttatatgacaaatctatgaaaattacacattacacatgccaattaaattgaattcaaaatacgactgccagtctttaggattcaaaaccttggatatgacaactggggaaaaaaggactacctcaagcatattttcctcgataaagcaattcaaccctgtgcttgtgatatctgcaccattgtgctgcaagatcctgagctttcctttctgatgcaaatgtgtgagtgcatgaattagcaaagcaaatatatgtngtgtactggtgattgatctaatttgctatttaccttggtcccataaacaagaccacctccaggggaaggatgaaagcatgcaacgtttacttcatcttcagcactaggaagaactttaccagctccatgtccgatactctatagacctaacgtgatgaataggaataatgagattaaggcttcattcataagtaagaactgagcttggtagtggcacagaaaccggagcaagcaattaacacatgattaattaataactaaatattataaatttgaaaaaagggttcatttgaatttttaaagaaacttttatataaaaacattttgcaaaaaatacaccgtatagcagtttgggaagcgtgctaacggaaaatgaggaagttgaagtttagaacagggcctaaatcatattgttagtcatacagaaacaaaaggacactaggagttacaaactataataagaaaattgttcagactgaaatatttaaaataagcagcaaaaacagaatttccagtattttcactgatatgcttatgcataatctaactatatgtacctccaagatagtatatacaggaattccagtttccccatccatcacaatgctcctaagcatagagttatgacgacgaccatatgccaatagtatgtgctctgaagtgggtgagaactgcagaaaaacaagtgctcaccaaattaactgatgaagaaagttgttgaatttcatatcaatatttctcaagtttaggtcaaaaatgcaaaagccagtcaactttataatgctgctactggacaatgcttgagacacaagccacaagttcgacagcaattatctgaggtatataatatgtttctgctcccagtagaagggtggcagcagagatgcctgcttatcttttgcagcactaaaaaaccaacaaacacacaaacaaatgagatgttaacctggatggaagttaagcaatgagctgcccttatcgctcttgatgtaagaactttgccaaacctgtaaggaaaatacattcacaatttcaaaataactagaacgtttacaaatgagaaacctagcaaaagagcatactatgtaacaagactgttgagaaaattacgttgcctcctcaagagagtaaactcggagctcataaataactcggtgagaagggagagggtgacgagttggtgatgttccggcccctgcagaatcatactgcacaggcaattggctaccacggtcgccttcagtttgaggcagcaaacaggcaacacatgctaccagaaatcgtccacaaggggaaaaatgggcacccatttcactgcaataattattaactttagagtaagcaaagaagggtcaacaatccactgcacagtttgtcaaaaataaaatacgcacttcatgtcaaacatctaaaagatactccctccgtctaacaatgtttttccacagcaccccatgcgctcaaaccaaggaagtacaaaatctaagaaaaatttaacgagaaaaaaacatgcatagcaaaatgcaaccattttacccatttcaaagcatttaatgagtgaaaacattgtaataaccacattcttggttttcttaatggacaaacattgtgaaacagaacagtaagtttttgttgttgctgcacaccataacttatccacttatgtacatattcaggcaaagcaatacaggaaacaacagaaaggaaataaaagtttgtgttgtgcaggaaaaatgtgaatacaagaaaaccaaaagtacaatgaagcacctgcagagaacggcatgagaaattgtcaaccggcatgcctcgggttccaatgtaacacatggatccttgatatcatgccgccatattctaagcttcactgtgcaaggtaattcagcagctccagcagcaagcagtgaggtagtaagttcagatccaacacctaatgatgcagcatgaacctcagcttcatcaatttgggggcctagaagtgaactcccaaccccacgtaatgagcccacaacatgacgacgagaagcatgatgtcgatttgatcctctagaactgccgacatcaatcggaatagatggagaagcacctgcaagttcaattacacagtttaatcagtctcagcagtgccagtaccacaagaaggtaggcctccagtacaaaggcatcatcatttggaaggtgcagggtgcaaacctgtatgattttgggccatgaaccagccctgcaaaaagggaagctcccagctacgcgagtcactgaagagatcatgatgatgatttccaccctctgaatttcttaggatcatgtgaacatctaatccactagaagtggtaaacgaattcattggcataccatgacggccatcatgttctgaaggctgagatgttgctggaatcggcacgctgttgctcagggagggcatttgcacatcatctctagcagtagaactctcatgattactagtggagctactgcccagtaatctggagctaggttgccccctgtcaatctgcatttcaactccacttaaaccagatgcagaagcatgagaagtagatggttctccagggcacacatccataggcgtgacaagttggtcaggctgttgattttcaacatctgatgccaatggattttgagctaaagatgatggtctctgatgcacattggttgaactactaaccaagtcattgcgaatcagacataaacttccatcatccctgaggtatgcaggccaaagcaagcaaggtgatgatgaattagcctcatgatgtggacagtttctggaattaatatttgcaaaaaacacagccgagggatagtttgaatagcccgaagaggttgcaagggtcaatggtgagtccgcagaatcaagattattaacctgaaattgaatatctgcataagatcaatcggtacatgaaattatgcaaagaaagcaaaaaatgcagaaaacagtactacctccgtcccagaatgagttttagggttggacatgggtattaagaaagcaggtggaattaaatgtgggaaggttgtgattggttgagaagagaatgtaggtagagaagttgttatattttgggactgagggagtatattatttctacctctgcagtaagaagatatggagcaccatgggggtgaaaatggacagctcttagtgagcggcgggttcttaatataatggttggagcagcagcctcatctcttttattgtagttccatatgtacagctggcacaatacattgcattgagcactatatgttatttgatcattgttcataaaacaagcacagaaagacttcctttttttttcaaatttaacactataatctcactttgtgacctgatgcaactgccagaatctccccccttgcatgaaatgctattgatgcaattggccgatctatcaaataagagaacatcactgaaaaggttagtattcagatttcacccatggaaggagacatactcattaggatctgcttagatatattacggaagtcctgagatccaatacagtctgaggttttagcgtcccaaagacggacttcctgatccaaactaccgctagcaaggatatcaggaagtaatggatggtatctaacctgaaatagaacagaagaaactcaaaataataagtggcaaataagactgcaaaaacagcatttatgcatttttatgtaaaacatatataaaatgctccctatggactaagctgccaagtggtggataaggatatgggtacaaacatgacatgctgatataaggcctgatggttagtaaaaatatcagtacttgagttgtttatttaaaggtcattgtgacttaaccccaagtcattttggtttatcagcaccccctgtaaatcattgtaccatccaaaagtgcaactatatcccctacaacagtgccccccaaccccccaatctatcttccccttattgcgctacgggtggtaatggtaaattagtaggacccatgtggcgtgcaacacatgatgatagcagaacagctgattgtgacgatttgatgaaatatcccccaacaaattggtcaagtgaatcgtgaaattacaggcaacagtgagggacagggttattacagactgaaacgactttgagggtgccaataaaccaaaattacttgtaggaaggtaggtaacaaaagcagtgacttgtagcagggacagggtaagatttatcctttatctataagagcttgtagcacacattctggaacatgatgacagtgttcataatcataccacccaaggcgtgcgccgatgtccactcagcactttcaaacatttcccagtttgatagtcaattattttaacagtatgatcaccactgctcaaaagagatggagttagtccacatgccttcactttaatccttatattccgcaaataataaacttactgtgtagatgcaagtgttttcccatctgggctgaatgcagctgcgatagtagacctggggggtggcaaaagaggacaatatttggcagaccagtgatgcagggactgtgattctgccctgtatacagaaaaggtttcattccagggaaaagttaggtataagagtgagagtacaaaactatgtaactcaacagttaaaatagacaatgaagaatagttcatagggtttataaatatttaccaaagaaatattaggtgtaaaatcgaaagtacaatatatgtaactcaatcattactacagacatgacaaattgtgcttaaaccatcctggtaaagtaagaccccgtaccatgaatatatatcatgtttagcatctgtagctgcatatcttagttcattggaatcagcatcatttcctggagatttgctccaaagttttttagcttggtgttttgttcgaggggaaatctctcgctgagctaatagatcgaagatgttcctgacaataatgggcaaaccaaaggttatatatttaacaagtgatctcatattataatgccattagaaaacaggttactgaaaatgtttttatattatccagaagatgacccctcatgcagtttatttttggagggggccatggggataccacaatggctcaatggtggcattaacactgatggtgctactctatc

SEQ ID NO: 18799 - DNA, 3780 bp, Oryza sativa
cattaccaaaatactaatgctaattcatgtggtattgaccttttgacatttctaccagtggagacgacacttaatccaacacagctgacctctaggtgaagtggtgtaacagtatgcagaatatattcccatagctttggtccattttctggaacaaatatgtgaggttcttttcacaaatgttgttttaaaagggctttgtatgctaacaaatactgtaccaagagtagaagaagataaataaggccagggtgctaatcaaacttaataagtcacaagagggtttgcagatataattccacctttactgtgtcaaatattgcacatggatgcaatattggttccaaacacagaatcaaaagaaagaatacattttatcaattgaattgtaacagttagtttctcataggattgtaccaacttctctagcagaaaactaaatgatgatgttaagtagacaattacctttgcctagatcttgcagatgttgcttgatatctagaatacgatgcttgtgcagaagcatgctttgaaccttctgcccaatgttcagccatttcaggccttcaatatatatatgcacctaaaaattaattgaaccaaccagatacaacaagatgtaaaatgttaatgaaattgtatgatatataacagaagttaagtaagaagtttttagaacaattcttcagaaaaacactgacacaaacatcccaaaatccaacatatgaaaatcagaaaatgcagtatactccaattaaaaattagaaaacagcacatcaagagtgactggacacgaacaacctaccatttgatagattccctatggtaaccagtgtgtggtagatataacttgccacagatgcttagattatcatttgaccttaggtcacctcgcacaatgttcttctgtttgagatattcacaaaattgtactacagaacatccagctccagcagcagtgctgccaaaggcaaacaaggtgcacacatgcacaatagcgagatgcagcaaagaaaatgcatctcaaattatccaaagcacggtgcactatgcaagtcatgctctactagcagccaggcgctaaggcaccaaagaacatttctcatcaaaagactgcttagaatataaaaccaagcccaactagaaacggttgcttcaaactaccaagttttagtgagtctgctagatagtaagaaaatcatatttatgacataatattgccaattttgataaaaataaaagtgacatggcatgctatatatattcaacggtttagttatttctagtaggttaaaagagctaaggtttcatctcattagattttattttggtgaactgtgcactcgttggaaatactctctgcacatgatatttcagggatggatcacatctttttgtgctttgagctgtaggcaattatggacctagcatattaagtgtaaattttgcaaacaggcttgtacagcagtgtgcatattcattaagatgggtttttcattgaaaaatttgaaaacttgtcatcaaacacttgctctttaagtttattctgcatatgttgtgtgtttcagggatgcttgccattgccaacagatttcataacacatttgatgtcctgctcttgtgagttaagaatgcatgggaacaatgcaaacaaaaagaatttcaattcttacttttggacaagtacaatttattcattggtaaaaacatggagagcaagtcagtccaaggaaggcctacattctgagctcacatcctatgccaaaaatgcataaagcaaggatagatcaacagctcagcaatgaatcattaagggtgtgtttggttgcttgcattttcctagcctggctcatctctctcatcctggttgagtctagcctggatgaagagatacacatgcaactgtttggttgtttgcatcagtttagcccggttgggatgagattttgtttggttgagtgcatgagagatgcggtttggaaaagattttgtttggttggttggatagatttgagtctagttacctcttcatttagttgggtgaggttacctacaaaaatttcaaatctagacaataggtataaacaatttttcacatacaaagaataatattggcatcaaaaatcacccggcattctctgcaccaaaagtgaaatttcttgagttctcaaaaaataaaaagtcaacaaaacttcctccaccatttgatagcaaagcgctggaaaaaaaaaagaaaaaaaaagagagagaagcgtttgtcctcctccttgttgtcgaggagatgagttcttgcctcatcgccgccagccgttcccagctcctctgtcgccggccagtaccatgctcctcgctggcctctcatcctgatctgacatgcgcgctcctctgctcttctctcagtagaaaatagaacagagaaaacaaaaaaaaaaaccctcaatctcatcgttgacttgcttcatcggcgctcccagctgctcaacgccaccatggtcaccggatctggtggcctggcggtcggagaaggcagttgtggcgacagaaaagagaggcagcgcatcgacgcgatggagatggcaagggatgtaatagcggcagtagcttctccactggggtcggccgagggagctcgaggtcagctgccagtccaccaccggagaagacgccaaacgagcggtgaccgcaggggatttggtggcggcagcggcaagggagagaggggaagaggagagcaattgagaatgggaagatgaaaatgagagggaggaggtgagcggatgctagacccctgccacgcacgtgcacgcactgatgcaacgcttgcacccgcgctgcatccaccttgcatcgagtgagccaggctgaggagcgaagaagaaatcggccgtttctctcgggcctggctaacctacttttgcatgaactcagccaggctccaaagggcatgcagttaaccaaacaagcggacgcgtctgcatctcccatgcgagccagggtagatccaggcaaccaaagagcccctaagactaccaatatggttcatatctgatatgcacatgaaaggaaaattgatacagtaatacaatatgctaaaacaaccagaccgatgaaaacaaaaaagttagatgcattgccacacaccaaaaaactaccgtatagattcctataggggtgaaagagtctagcggcgaaccaccaagatcaaacccctacagttagttaacatcatatgccaactgccaacatgccaaaaatacccagcttacaagtcaaaacagctccacaagaacccaatcaccatgtaacccgatctcgcctcgccttctacctcgagcttgtccgcttggggctggcggatgcatctaggaggctaggatcataggaaattcaggaaccctccgcacgcccaaaacagaacatatctgccacgaaccctacggacggattgcatcctagcatcgaacaaatccgggggaccaatccaatctaatccaatccaacagcgcactccgacaacgaatcgcacgggatcccaaaacaagtattccatttctcagcggggcacacgcggcggaaccaaacaatcagaagctagggcttaccacgacgaggggatgcctggaaaccgggcggatctggttgcccggcggtgcggagaggcaggggggacgaggggcgggagaccgaggccgcggcaagggaggggggcgcgggggaacggaaggggtcggttctgcggtcgccggcgaaagacgccggggagcgggcggcggcggcggc

SEQ ID NO: 18800 - DNA, 2462 bp, Oryza sativa
gggtgggggcaatcgggtgcttttgccctcgtctctttttctcgttgcgcttaggacgctttggtgggagggcgtcaagagcgagtcgagccgagaaaggggagacgacgcggctccaccgtggaaggggcgatacgatagcgcgtcctttcccaccgttggatggtgggcatcaacggctctcttttttttctttttcgatctcatatggggagtatattttagagaacgctaaccatattgtgataataaaatatctatatcgggcttttttccattaactcgcttacacttgtgactccctctctcttggacccccttacctttctcccacactcacacaggagggcggcggcgtcccaaccttcgtctccatcgacattgtttctctggtctgccgtcgttgccgccaagaaaccccgagcgccattgctcccgcttcgtcggcattgacatcgtttctcccacctgccaccgctgggcgggaatcctcgagccttgtcgcccctgcttcgtcgccagcgatgtcgtttcttcagccttgtcctccgctagtggcaaagttgtttcagagctctttagtttggcctacccctcctctgccatcactacaggataggaagaagacaatgtattttttatgggtggtatattttgcgaattttttaatgtttcagccaatgtatcttgatgtttttttttgtgttggattaaatgttgcagtgggattttttatagtgtttcaatttgtctctgattcttgtggatttgttgatgtttcagtaattgaagcttgatgtttcatattcaatccatggttcaaccgtatttcatataaaatatgtgttaagatagtggtggaatattcttccacaagtactggaaatagagggctgaaatagcgccctctgtatgtttttctatatttctacaacaaaaatgattttacatgagtgtaagaccagtgaaactgatattttcctcctcatagataaaaattcaattagtaatcaataatatttgctttctatactatgagcacacttataaagacagatatagtagatacgaattctctaaagctttggcttttttctcgtgacatcctatgtatgcatgtgatagatatcctctaacatcaaatattatcaaatattatgtctcatcctcgtcatcctctagtttttaaaggctatagctatgatggtagcatcggcaagttaaaacgaactacaaggaggtaaatcgtggatttgtatccttgtagacttgaggatttgttttcatgattatcggcctgtagcctgatcatcagttactatattattaacgtggttgttcatcaattactatattactaatgtggttgttttagcatactatatacttactttatgttaatatagtaccatgcaccgcgtggtatttttgaacaagtagctagtagctcgtaaaagggacgaggtacatgctctaagatcaaaagggatggagagtataatggcaagtcattagaccacatttgcgcaaaagaagtatggcaaaatgtgctgggtcctttaaccctatattagacatgctcaaatgtggagttaagctcaacttagggatcaggtggaaataaaaactcccaaacccgatgttgggacaatagaagaagctttttctcatgtgcaccatatatctcgctctcggtcacaaacactaccttgaacatccacaacaacataggaatcatgaacttttgtgtcatcaggccaaggaattcttcacagcacgaacatcacaggaatcatacatgttcacctcagcgccatggcactccctttccctagaatgtctacctgcccacttcccttcacttccatcatgtcttctacatgaaaacgaccgtccatctcatgcaggtggttgcagttaatacacaaatcatggagaagaaaagcgttgctacaacataataggaatttagaagttgtttgtcaaattctattggtccaacctttagagggtagcggagtaatcccatatggaaccgaaagggtcaccatgttggatcaaagacgcaataagaaaccaattcaaatgtgacaattgaacattgtgaagatccagcttttttaatatataatgattaaatttggatgaagggagtttgaatatagtcacctccttctaaggctacgttcggaacaattgcctaacttgactctaatgttttccatacacacgctatccaaacggttaaacaatgcattttttaaaagtaatatttatagaaaagtgcttaaaaaaccatattaattgattttttaagtttattaagctaatacttaattaattatgcgttaatggatcgtttcgatttatgtgctagtacgaaaggttgccagccttagcttagggtgtgtttggatggagggatttgggtggataggacatggcggcccattatttgtggg

SEQ ID NO: 18801 - DNA, 1002 bp, Oryza sativa
gtgacgaccggtggggacggagacgacggcgacgactagatttgaaggatacgggcaacggccggtgggaagaagacggggtgccggccggtgtagaagaaaacgacggcgacaaccggatctggaggagaggtgagacgagcgtggcggagaccggtgggaaaggaggtgggccggaggccagcggtcgagaaggcgggccggcggccgtcgagaggagcagggcggcggccgttgagaggagcgggcgaggcggcggccggcgtgcaagaaggtgagccggcggccggcgtgaagagcaagaaggaccaactttttttctttttttctcctttttccccttttatttctctttagattttttattttgcagtacattgataatttttagtttggtgaatttgaaggggtatactcaccacctctaatgatgaggtgattgtaaccactcatccatcctactccttctaaccaaacaaaaaaatggatcaccaaatccatcttcatccctggaaccaaacaaaagactggattgccatattcactctaccaaacaaaaaactggctcgtcatatcccatccaaccttgactgtgaaccaaacacaccctaagcctaaatacttatacaaatttagttctagttttctccttctaaatattatacaaatttattttgccaaaaagtctcagctgtccattaattggatgagtggctcacatcactcgcagtatttacctccggacgaagaagaaatcgccgccaccctctccaaaaaccctagctttcctccccctcgaaaccccaccacaccactgcaacgcgtgcgagcggcggcgagaggaaggaggagaccgatggggcggccgtacgcggtgaaggggcggaagaagaagcggaagctcgacgacggcggggcctcccgcgagcccccggtcgacgaagaggcggcggaggagctgccgccgccggagggggtggaggaggaggaggggaaggagga

SEQ ID NO: 18802 - DNA, 13827 bp, Oryza sativa
attgtatctgaacatatcattctgtatacctgatgattgaggagcttaatgctacacgaatgatacttttgacaattctttgttagctatattgtatctgaacatatcagtctgtagctcgatgattaaagagcttaagctgcacgaatgatatttttgcgattcttttgactctttgtgtagactatgcaaatcctgaactcggatgaccatgctaattatttgaggaagcaaaacaggaatccagctgattacaggcctgatatcattcaccaggtatttcgaatttcttgtatttccgaagctcccagggattaatggcacatgattaaagcctgtcctctctcacatctgtacaacccctgtttgaaactgaacgaaagcagacatccaattttctgtttgaaatcattccgtaccacatcattatctgtgttctattttggcttcccctattgaggatatatacattccatggcatttacctcctcacttttgggggctaaccacagaatggcccctctggtaaaggatactacctccgtcccaaaaagaatgttattctggctatgcatctagacatactcttatcaggtgcatagttagaaatgcattctttttgggacagaagtagtagctgatttctgtagttggtgctgtgcacataacaccagaatgaagtcattcttgaaagagcctcgtggtgattttacaaagaacatctaagtgattaatgaaaaagaaattgttcaagccagtcattcatttctctcatttgttttatacctgctttctcaaagccaacataatttgtattcttaatattttgcaggctcttcttgcaatatttgatagcccactaactaaagctgggaggttacaagctgtttatgttaggactgaaaagggagtattgtttgaaatcaagccttacgtccgcatgccacgtacattcaaacgtttttgcggtttaatgtgtaagttaataatggctgtaattgcacatatattgtgtttttagtgttttctgtgaactgtgctgatgaagtatttctacaatattgcagcacaattattgcagaagttgagcattacagcagttggaaagcgggagaagcttcttaatgtcattaaaaatccagtcacccgctatctaccagttggagcaaagaagattggtaagaatccatattcttttagtggtagtgttaatcttaggtataagtaaatccagagttccttaaactagctagagtaacatcctaaaatcatctttggttagactaggattaaatttggatgacagaaaccaaaattttgagaactgaatgtcatgacatacaattttccagaacctcgtttactagttttgtgtagagaatttctactcatttttttcctatgagaatcacaacataaagtagtatttgtaaaatatacctgcaaagatgcacttttagctaggtcaaatagtataattcgtgacccaatgaacatttagtagcacatttttcttgatcagggcatcaggtaatggtccactgttggttgttgctaattcatgagtttttttatacttaggtctttcatatagtgctgagaagtcagtcaatttgtttgactatgttgccaaatccagtgacgatgtaccccttgtgtttgtggtgagttaagctatgccgtcgagttgatttattttttgttccattctttcttcctggtccatctcttatagtctgcacatgatttcaggtaggtgctatggctcatggaaagattgacaacgaatactcagatgattacatacaaagtaagttaccttcaattaaaattagagttagagcaaacagtttgcaggatcatggtgatatcatctatttgctgcattcttttgttattgtctactccctccgtttcatattgtaagactttctagcattgcccatattcatatagatgttaatgaatctagacacatatatatgcctggattcattaacatctatatgaatgcgaacaacgctagaaagtcttacattgtgaaacggaggaagtagctgttaaaaatattattacataaaggtttcaagcaagttgcatttatcatatgctcgctcatttgtaagacaggtttacaatctagctctgtaacacaaatgccctgttgcctttcctgagatgcctggaatgttgcgtgcatttactgtctcaaagatgttttctttagttcgtaaaaaaatgtttttcctttgtgacttatgtaaatatagacagtctcagatttttttttccttttacttgtgttgatatccattgtcttcagatggtttcgtttgactcgtgttgatattctgcacattgttcttgcagtttgcaattaccctctcagtgctgcctgctgtttgaatcgaatatgcagtgctctcgagcagaagtggaacatccagtgaaaggaaattttgaaaacgaacactgaaaaacattatgtgaaattgttgtgtactcgctagctaatgcaattttgcggtctcctcccatgctgagtgtgtactgtattctgattgtggagacttgaaaactccggtggtaatagtgttaaagttcaatgtttgtcgcaacaatatgttacatcttgaggcatactgttgcttatgattaccaccagccttgagctaggttggttgaaaaccgaactgcaacgtttgtcctttgcccaaaattttacgctgagctgagatttacccgcattaacaggaccatttcactcccgagatctcatgacaagcggttttttcgtttgattccttggttttatttatacttctactcaacgcttggtccatatatatatagtatcacagaaaattttaagatagtgggacagttcaatcatgaatcagatcttctaaaataacacaggaaccataccagtcaatgcctgcgagaatagaaaaatggttacggttgcataaaagcaaatgctttagctcttcatgttcagtccagcatgatagaagaagacattgcaatctctagagctgtttggttcttacccaatcttaataataccaaaaaaaaaagttggcaatccaattaatttgttgccaaataattggcattccctttcaaaaaaaaaaaaggtggcattgccaaaatattggtaagcaaattgaaatgtagtgtgaacacatttccaagtggaattttggcagcaaaccaaacaaccctcaccaaacattttcatcaggtttacattgacaatgatccaaacattgttctcaggatttggcaatgccaacactttaaacaggtttacattgacaatgatccaaacaagcttctcaggtgctaggttttgctgaaattaccaagcagaaagaacactcgatgcaactacagtctacattacaagtacaggtaaaaaagtggatgatccttgttatattcacaaaatgttccacggtaatgagttcaacggccaaactcgttatttcatttagtgactacgatacatacttacaaccgggcacaattcgagtaactcgatcagttattcagaacttctttaacttcacagcaagcttatcaaggtgaaagtccatgatctccgagatggtctccaagaatgtctcctcactagttcctggaaggatggcatcctctgcttcctctatgatggcctcgatttcagattcttttttgactgtttgcctgcataagatgctgccgatgtcataaggcgttaggcctctctctgcccccttcttcaaaagcattgtgctgatgcgcagaactcgggcacactggggagatagcgcccacccgtggaacttgagaagcgcaatgtctttgtcagcatctagtgatccaatgtatgctgcggtttctggaccgaagggttcgcgggcttggggccagtagagccactcaaaggtacaatcttcaaactgcaaaggggaaaaggtaaagactcgtaaactggtacagaaaaattgattgaactaagcaagatagcatacaaggaattaacttgtacaaaaataatgccagctaacaatgattcaaatcaaatgaatattaaggacacacggccttgtttactggatcagtgccgaaattgtcacattaacatagacaaaaacattgagaaaatacgaggatattactgacattgtttaaacttccaacaacactaaataattactagggatctctaattactatgctaaggacaaaaatagcagtttaagtttaccaattcaagcgagtgaacataaatacaattgtttcacatgatagcaatgatcaaataccttctctggcaggcagtacccatgatcaattggaatcaacttcaagtgatcttctccatcttggcacactaatatgttcccagcatgacgatcagcatttgccaacctaatatccagtatggcaatcttctgaacctctttaactgggaaagctcgagggcccatatcctcacaactgccattgttatctacaaacagctgcaatgatccaaccttattagatcccttccccatatggaaacaacggaccaacgctgtgggtggtacaccagaaaatccaggaacatcacacgatttacatccataaactggatggtcaagaatatatgctgcaacctcccttaatgcaccttcccctactcgcgttccccttttcaacccctcaccatcagttgacaaaggaaggcccctgggattattctttgccattggttcctcatcaataggcttgaatactgcaacattgctttcacctgaagagtccttcatgaaatagactccccctgaaccctctgttgacatcacgggaaggtacccgttttctataccagaaattgttgagtagatcatttccatcacagcaggagacaatttcacctttccattagcaatgattggctcaactggagcaggtttacccttagctggtttcgcaaggttcaaagcatctgtttggaggttatcattgtctttgggagtaacaactgtaacaacagtttccttatcaccctgctgtgtctgaacctttgctggcctgcggatgaacaagtggataactgcagcacccttcttgctaatatctgcaatcaattggttatcctcaagctcttcaccgtcaaacacaagcctttggtccttgagactcccaagttgctgtccactctcagctgagagcttgtccttgagatacccaacattgcagcaactctccacctggaactgaaatttcttcccattggcagtctcaatgcttatcgcacggaggtcagccaaccgcacgacaagatgaagcacatttccatcggtaagtccataatccctgacatgggagttgtttagtgacagctcatgcccactgaacaccagccgctgcttggtagtgacaaagcccttgaactgctggatgcggagcttgaccgaggcaacagagtctgagtgcaggacacgcattggcatgggtgccacccctggcatggcaagaaaaatgacaatagaatccagctgctgcaaccggggctcgccatggggcgcaaaacaaaactggtccagcagggggctcagtgtggctataccggctgacgacatctttgctgatctcaagcaacacagccaaggcagccaaagctactgatgcaacaagcacaagtgcacagccaccagcactagagaagcagctatttgcactatgaattagtggatgtgacccattgatgaaaaaacaaaccctagggtctcctatcaacaaggaaaccctaggggccaccgcttgacaccaatgcgcctataatcccttcttggcccccaatgcgttcaaccctgcacattcaagagaaacaaatcatcaaaccctaggtgagcaatcgtggtactcaaagcagcaatttcagcaaaccacatagcaacaatctgagcatttcgcacccgaaccgaaggaatcgtgcagaggcggcaggatcgtctctgctactactccaatggcgcagcagcacagcatctgtagaagttcaaaaaaaaaaaaagaagaaaaaaatataaatcgagtaggaactcgagttcggccaggggattcgaacagcacaagcaacagagagacccctcaccggaattgatataaacagattggatccgaggaggcgcgaagacgaagcctcccagcctcccttctccgtctccgcctccgcctccgcctcggcctccgacgggccgcgaacccccgcgagattccgcttccgaagtcgcgcagtctacgatcgatcgccattgccaacacgcgttagaaacacaaacccgaatccaaaaaatcgcaccacttcctcatcgatcctacccatcaataacacaggaaccaaatcgctcccgcgggagggagaaatcgcggaaagtgaatcggagaacgaatggatcatcttaccacgacggcggaggcgcggattggcggtggccggagccgatcaactgctccgcccttcggaagagagagagagagagagagagagaattgttgaaaagaaaaagaatgggtgagggtttaattgggcgaggtggtgtgggtttagcttagcgtggtgccgtggtgggagtgggattttaacttaagtaggatttggatttggatttggagttggaaggcggtggctttggcttcgggttgccggcttcgtggggaacacgttggaaaggagtcggttactgtttagaataagtaactccggtaattaattataattattaattaattaattgtctgtttgtttccagtaatgaatgacttacaaaaaaagaaacccggggttgcaacttgcaagtcaggccaacggtgagctggggccattaggtcctactgtatttcgaatttgaaattttatgagcttttataggctgactatttctgctagttaaacttatttaagtttgacaaaatttatagaaaaatttagtaatatttttaatacaaaacaaacatattttatattaaatattagttttaataaagctaatttcatgttttagatgctgttaaatttttctatatttaaataggaaaataatcaaaataacttataatatgaaaaataagagagtagttgacattagacattgctcgtttcaaaatcgctagtagatcttttctgaaaataacaaatactttagaagtttttgtaaaacacgaaccctgctatatgtacaacttctacattcgatcggtgtacaatcgaaacggcaaagcagcacagtacatgatggcgtgaggcttcatgtgacgtatagcatgttgctgatgccgcgtacgtcgttgtccaaaagtcggacgctccggtcgtttgtatattattttcggtaaaacactttaatatgaaaatggaggaagtaaactcgggtatgctccaacgctcttgacggtggtactctataacatgcgcttgtgaaaagtgaaaacccaagttgggttctaattctagataaatagaaaaggaaatataagaattgcgttataagggaacatgaagttttttccgattggtaataattgaatagtttcctatgaaaatggtaaaaaaaatcttgtgaaacttcggagttacaaatgatacatccaaaggtgtcatattataagcctataaattatgtagatcgaaatgtttacaatgcaaccattgcacaatgatccccaaacaaggattatataccaagaaaacaaatattacaacgattgatttctaagcctgtgttcgagaggtgaggcccacacacgcaaaacagagcgacgcattttcttatgattaattaagtatttaatattttttttaaaaaatggattgatatgattttttaaagcaactttcatatacaaatcttttacaaaaacacacagtttaacagtttgaaaaatatgcgtgcggaatacgtgggaggtgagttgggaaatgtgggggaagaacacagcctaattcttctttgctagcgcttgaagaaagtacataaattaaatgggagaaatttgtaattgattaggaagaaaaagtaggtgaagaatttgaatggtgaaagattgtgattagttgataatggaatatatgtggtgaaattattatattttagaataaattttaaatgctaaaagttgatatattttaagacactaaagtaacaagcaagttcgcagaaaggatcttgaaccaacaacgacaagcagtcaagctgctgccaatgccatggatgttcctgggctcctgtgaagaattctagaaaatactctatccatcccaatatataacaattttggactgccaatgccatgaatttgaagaatgatatgtccagattcgtaatagtaggcaaatccgatactaggctacctccttcggtttgtcacaaaataagttatcttttaataatcattacatcgaagtttatgaaggtaagagataaatggattgggagtaaacaaaaggagaaataattttattgagatttgataaagtgaaggtattttagtttttgtattggtacgtgtgagatgaatgaagaataaacttattttagggttggaagtataaacttagggttggaagtatgtttatagtttaagtcttggcgtaaatattgaatacgaccgactagttgaaatcgtggatacgagttacgaccggcacagatcgatcagcatgaatcgacaccgaaggtttggtttggccagtgcaacctgtaacgttatgtactagtgctttcctgccgtaataaaaattttcttgattcctactggaaatataccacaaaattccggcattctagagcagcagtaattacattccacgtcacacacaccaagctgtgggtgaaagagaaaggcaatgtgaaattaacatctatctgccatccttatcacagccaaaagaatcatatccctggagtctgcggataactacagatgatgatgatggaaatgaaatagcttcaacatactgtaacaacatcccaagtcatgcccacagcgagcaaaagatttatacaccacaggtagttctctctctctcttcctctcttcacattcacaggttcctctctacaaaatcccagatcctctcttccatatagatccggtcccctaaccggcgcggcatgtgcctctcgtcggggaagaggaggatatcgtagggcttcccctccgccatcagcgagttgatgagcctcgccgtgtgcctgaaatgcacgttctcgtctatcataccgtggatcagcagcagcctccctcggaggttcttcacatgatgcatgatcgacccgtatctgtaagcgtcgcgctgctccgagggcagacccatgtacttctcggtatagaaagtgtcatacccatcccatgctgtcaccggagcgccagaaactgcacaactgaacgtgtcgggaaatctcgcgaggcacattgccgagagaaagccaccatagctccagccgtagagacctatatgtccgggttttgctaggcctttctttattagccactcggcacctgctaactgatcttcagcatcgacacgaccgatgttgtatttgagctgtccctcaaactgcaaaccgcgtcttgcggttcctcgattgtccatctgccaggagacagtcagtcattcagtgttacaaacaacttgtattgccatggctcatgagcccaatgataaatgtagtgacaaatgcggaaatatataggcatatgattatactccataatgagcaatcaacaaatgcggaaatatataggcatatagcagccagcataaatttatcatatatgaataattctaagcaaaaaaaaaaactcatgtaaatatatgattatagaaacatccgttccaaaacattttgcttccacttcaaaattcccaccttaaaactttagattatttttgctcaagaagcaatatggttagtcatgatggattgtatcatcaatcttaccacttgccatagtcgctagggatagggggtagtataattgtttgcttgcaactgacagacattactacaataaaaaatattggctgctggattgtattgggcttttcaacccacacgtcacttaggataattacatggggcttttttggacacttgtaatgttttgctaattcctaatgacaggaaggttacaggcgccaatattttccagacatagttgtggacgcaggaacccttattagcttagtggagtggtgctaatatttctgactcaacgcaaattttatgcttgaatgcactattgcattatctgaggttgagtccatgttaactctcaaaatgacatactgatgtgctttggaaaaattaatggatgagatgccatgcattgcacagcataccttgttaaacaaaaagaaattaaatggtgctatcttggccataagtttatttaaaatcatttttagtttagaattttacccatgcaatgcattgcacagcataccttaagattggtgacattatggaccaaagtgaaaacagaaaaaaaaaatcctcaatcggaatctatcttgttaaacaaagagcaaagaaaaaaaaatagaggaaagaatagttaccttccaaactaatatacccttactacgcaggaactgagctctcatgtcaactgtacttatccatgagtcacttacaagctggacactgggaccgccataaacgttaacgagtgttttgtatgggggtggtccatattttttctcatcagggagataaagagttccatataaagcagtcccatcctttccttcaatctgtactatctctggagacagctgctgaaactttttaagcggctgaacagtcagaggctgctcatatagaggcattatcacacttccatcaagcaaagagcatagcaggatcacaggtggagattttattgagtcatacacatcaataaacctcagcaactgatggtcaagaattactgaatgacgtcctgtgccatgagtcaacctcttggggacttgcaagggaaggctccaatccggaaataggttggtggagtaaagatttgtctccaatggcccatccaatgtgcctgtaaaatatataactccagaactctcattgacaccagcaatttggtcgatcatccaatcaccttgtgtgaggggccccaagcacacaccattcttgtcatgaagatacaggtgtctaaatcctgtcttctcactggcccaaataaatccacctggatgtttactattcactcctttatccagaggagtaaaacaatcgtgcaatgttatccacgtatcatgctcttcctctagtatgacctcccttttacctgaagcgatgtcaaacttaagtagcttaagttttgagtgagttctattgagaacttgaacagcaatagcactattatgcatccagtttactctagcaagatattcttcatcaccatggatactatttggttctccacataggagatccatccaagttatttctcctccatgggaagaaacaactccaaggcgcactttgacattagcagcccctgcaaaggggtaagcatgatcttcttgagcatctggaccaaccgaacttttaccctggtgcataattctatacagtgggatttcagatgagtcaacttcagtaaatgcaaggtgtttgctatcaggagaccaccagaatcccatcttcctttccatctcttcctacaatgggagatacaaaatattaggcagcagccatcaaaacaaattccataccaatcctaatggatcaacatgtgcacctgtgcaatatactcagcaagtccgtggatctgggaaaaaaagaaacaagtacaaatgttagattctgaagttgcagtaacaacacatgatgtatgatcttgcatactttatttaatccccggtatatatttctgttgatcatgcaactactaatgcacaactcagcatgttttgaatgttagaagaatactgatagcataatatacatgctacatgggtaagctaataaaaactatgagatattattggtaaaggggaacataaagttcttttagcaggcaagtttatcctagaagcttatttgagccatagcactaatggcggcagttaactagaacaccctctaaagtttggttaaaagactaacttataaaacttgtagtctttataaacaccgccagcctcctgcaatagtttcggctgctgtgtgtctttggaaggtaaatatcccactgtttggactttggctatggattaagcttactttggttcaaccaaaaaacaatccctaccaagaggtagaaagaaatatttgaactataacacattgaatatattgttgacaaaaaaaatcaatatattgcttagttccaatgatagtcatgttgggttacatgctagttccaatgatagtcatgttgggttacatgccaagaataaagctaataaacttctagaaagtcaacatgaaacttttctttgcaacctgctcaacaagacttggtatgataacaaacaacacaatgcacacatattcctattaaaatgtgagtatcattaacagaactccaaagaagtaccttcccactttcgcttgcaccataggtcaactgggtagtttgcccatcagagaaccccactgtatgcaactcatcatcccgcacatacgcaatcatgctcccatctggagacagatgtgggtcaatgatgggggatgtggctgaactttgcagcttgagtacaggttcagcaccagacaaatcctggaagtaaacctatggaaatagaaaagatatatttccatgaaactcatgatatttagcatccttgaaaatttacaaaggttatctgaaacatcaaaaactaccagaaaaagaatatccatgatacgctgacaacacaaaactaaccatagatgacaataatcaacacaacagaggagttttatttctttgaatcagtagcgagatcactatttaggaacatgtcagctacctaatccaccaatacaagatgcagcactataccaagaatgcaggaagtgcgatctcaagcacagacctgcaggcactgataaactcaacttcatagccatcactaacgactacagagcaaatatggctcatcccgcgacatccaaaccagaaccataataatggtcacccaacactgccccacaaaaccaataccagccttccattaattcaacactcgaaacggaaattaatgagcctaagcctatccatgtgcagttgctgatagcaaaatcagaatgtcaacctcataccaaatccttaatccgagaaagtggtccaatacacaaggataaaagtataaaactaccgaatttgattagggcaatgcgtatcatctaatactaagttactaactcaactgaattggtaataatataaatcaaggaagaactaaatgggggaaagggtttgcggtttgagagatacgaaccccagaggggagcggcacgacaatgccggcgcgggaggcgggggtgccggggaggcgggcgcgccactcgtagcgcgtgacgccgaggccgcgctcccgtgcgcgctcgcggcggaggcgctcctcggcggagaggttcccctcctcgaggccgccgccgtcggggggcccgaagaggagctcctggcgccgctgcgcggggtcgaaggcgtacacattccggtgaagcgtgccgtcggggctgtacaggaaggccacccggcggtcgtcggggctgaagctaagcgccacgggcgccccgtagcccgggagcgggtgctgcacgatgtccaggagctccacgc

SEQ ID NO: 18803 - DNA, 6880 bp, Oryza sativa
  unsure (1)..(6880): unsure at all n locations
caagatcgccgccccaagaaaacctcccccctccctccccaacccgcgatcctccacacccaacaacaaaggcggaggagaaggtatggtgccctttgaaggcagacgaggatctcaaatccgaggcggagatcggagtggaggaggagagagagagagagagagagagaggatcggaggagaggtggagggcgacttggagttggtcgttcgttccaagaaggggaggagagagagagagaggcggcgctaattgtaagtaagtttgttgagaggagggaggcctttgggatgtctcggtttttcgttggattggatcatggatggaaggagggcggtgtgaggagggtggtgagtgagtgtggttgctttgcttgactgggtctggtctttcttgccctttgcctctctccaattctatcctaggcttccatcggttgccattttgcttaaaatggcttatttggtttattagaaaattaaagttaatttataagtaaaacttttgtagatttgttcgtagcgacttaaaagccaacattaacaaaaattacgttaaaagcatttcaaaatcaacttcaaaatcaagttcaaaaattcaaattttagcttattctttggctgtttaggccaaacgatggggctgctatactctcttttttttgttgttgttgttggataagaggaatttgtaatggttagttgtcttgaaattaactgttctgtagatataaaatatcatactttccaatgattggatctttcttgtctcgagatgaatttgaccaaattatcttccatgtgcttctttttcgtctttaacatcctaaatagtctacctgtcttgtgttaattttggtaccatccttattccaagcacagttatttgttatgtgttttttaataacgttgatataaaccttagcttgtgtccatagttctacatattgagttttttttaaaaaaaattggttaaaagttctctaaaaattaagttatatattattaattatggactaaaattctgcaaagacacttggcacgtgtatgccaccttagtaaacatggataaggaggaatgattgcacatgcaaggacatatgtatgagagatggaactaccggtgtgtagtaatgcactaatgcgccagtatcaatagaaattaaataattccggcaatcctagaataccaaggtctggctgatgattttctcgattgacttgagccaagagcatccagacttcttcacctggcatcgggagagccctggatgctactcgatgtgatctgcttacaatgcgatgttctttgagagtgtcaacttcccaacattcctaatttgggagagaaaagcccctagcgttgctagtactttgcatggttagttgctaactgacgatgttggatgaccgattggctgagtaagcgaggtttgcctcacccagccttaagtgtgctttatgatcaacaggaagaaacaattgatcacatcgaaacatgtatctcatcaattttggcagctgatcctgatcgccatcgggcatccatgcttctttgcaaaaaaaaaaactttcttcctctcatggtggtgtgagtgcaagaagaaagtaagcgggtagcttcaccgaggattcgacaccatcgtcactttagccacctggttgatttagaaggaaaggaacaatcgagtgtttaaccaatggcaacagacctagaccgaagtgacacgtgatgcggaaaaagatgtgctttggtgtgaagttgggctgctaaagtagcatcacaatatagtatcttggtcgcacaatggatgtcatgatagataatcttgtttacactttgtgtttatgtttgtttttctttttcacttgttggctgggttagcaagatgcacattaccctcttcttaatacaaaataaacacacatcttatgcatattctgcccccaaaaacaaataatttttgtctagaagcactgtagtttgttataaatttacaacaactttcaagcggactaatacttgtctcatgggcgggggtgctagcccttgctagatagatccggtagccttttcaaaattaaacctataaatgggagacctatcatgcacatgtgaggactaaaatagtaaagaaaaaaaaccctatgtcgattttgtttctaatttcgaataattctaatacgaatagtatacggaacgaaaatggtggtatgcacattgaggaaattcctatatttcttcctcacgcaacactccatcagcaacttaggtcttgtttgaggagcttctagtaacttctcttagaatctaaagttttccaaatactgcagattcttacctagcaatggtggattaggctcatcataaaagcccataaagcaattgaaccagcccaacaattgcatgttactgtgctacatgcacccagccatcccacacgtgcaatccccacctccgctccacccgagcctcgtattggtagttcagtggcattgtcttagcatctctcacccaagcgtgccgtgcgccaagccaaatctcgcctcccccctcctcctcctcgcccttgccctgttcgtcatcccactctccgctcccctctactgctgctccatggcccattcctcttcgcaaccattgtccctgtccccgtccacggtggtcgcacgcacgccactcgtcccggttctcttcgtgatcggcgactccacggctgatgtcggcaccaaaaactacctcggataactcacccgcgccgaccgcgagttgtacggccttgagttcgacactcgccacaacacggggcgcttctccaacagtcacatccccatcgactacatcggtatgtatctatgtatgtgtcgtccccttctcggcactatggctagctcgaggacatcctagctggtctaccgagcataaggcaaactggcgcgtgctaaccatgacagggtcccgatcatgaatttgttggcgacttcgatagggaatgatcactcttgcaatagctgaaaccccacttctccaacatgggctctcgcaccaatcttgatcaagacaacatcatgaccgcatattatggagagttgttgaaaactgatcgccaggtgtttgagactcaacttgaagaattgcttcaaaagatggcttcgtactaccgtaagacgaggcaaggcatcatcaagcaacaaaaattcatgttacccatccatgcaaaatcaaaggtacaacgattctagcagtgcctattctaacatatgaagttgtgatggtgatgttatttctagtttaaataatcggtttacttctttgaatactacctttgagaaaacctttagtactaccttggaaagccctagatgatcacatgagtgagttagagaatcgactaaatagccggttccttggtggtgcatgtatttcatgcaacaacgagcatatgcatggtattccttcatattttcatataccaaaattttctgtacaacaagattggccgatgaaaaatacccacaattccctcgatacaatagatcctagattcactcctacgatactgtatgctggtccgaccgatgtgttattgctggtcagaccggacgcatcgatcggaccgacgggtgtaataccaccagtccgactagaggcagcagccgatccgattggagggacatcaccggtcagactacgctcggcatgtttcgtagaatcagctcatgtctggtgctcctctaaaagacattgacatgtggggtccacgggctgactcaacaagattggataaactgcctcctaaaccgttcaaggagtcaatttgtaatggttttgtgagttggaggataggttatagggatgcgattcaaccatgggcatgagttgagggaagcaaagtagacttagggcctgttcactttgatgaaaaaaaaaaccttaccaaattttggtaggcaacttgccaaaattttggcaggatttcttatatagttatcaaaatttggcagcaaattaaatatagtcacttttttggcaaatttactaaaatttggtaaggttgaaaatgacatcaaagtaaacaggcccttattacccacgggaatggtgtggggtgggctggtaatataagcccagaaaccaatccatccagcccagcaactgcgaggtcggctgctagtctaacgtgcacccaagccatcaccccacacgtgaaaaatccccgctccacccgcgccgcgccgcgcccaggtagttcagccgcgcgccaacccaagctcgctcgccggccggaaatggcgctccccttcctcctcctcctcgccttcgccctgctcttcccgctctccgctcccccgcgctgctgctccgcggcccccgcctcctcgccgcccccgtcaccgcccccttcccctgcggcggcggcggcggccccgcgccgcacgccgctcgtcccggcgctcttcgtgatcggcgactccacggcggacgtcggcaccaacaactacctcggcacgctcgcccgcgccgaccgcgagccgtacggccgcgacttcgacacccgccgccccacggggcgcttctccaacggccgcatccccgtcgactacatcggtacgcgccccccaccttctcgatcggcggcgccatggctgtggcccctttgctctctcgtgaatcctccccccccccgcttcaaaggttgcaggtggttctggaatcgtcgatccgatgctgctttgcctctcgtacgcctatggatgcagcatgttgtgggtttagtgtaatctgggttttgggtttctggtatacgaaggttttgcttagttgttggttcctatgaatttggggcatctgatctcatacatcgggggtatgtggatttttgcccaacaattgctgaagctgaagagtaatcagttcatagcactctcctacacagctgaccacctggatctcacatacatagactcctgcggcttcctctccttgatctcacatagcaatgttgtgggtttagtgtaatctgggtatttgggtttctcgcatgcgaggggcttgctcagttgttggttcgtctgtgggtttctgccgaacaattgctgaagctgaagagtaaccagttttgcagcacaaccaccacagtctgggcatcatttgatcctgctgttcttagcactcctgcagagctgaccacctggatctcacgtatctatatagaatcctgcggcttcctctccaaatcagtatccagtatccaccaccgttatcagccgttgaggcaatgcattggcagaatgccagaacattaagaagtgccatcataatgtacaccattagtccatgcatccagaaaacattgccagaatcctgcaatgtatccatttgatagtcctgagtcccgaccagttgtctacatgctccagtctctttgccaccacacactgttaaatctctcttgtccaatgtccaccacattctggacagtttcaaggtcctcacaggaagcacagctgcacaacctttgttaatgttgctttaagaaagtcatatctactcattagtttctttgggagagtaaggagggaaaaggcataggaaagaaacatttaactagggctactggctcactatgtgaaagatgtttcccttcaatttcatttagctggtgttctttatctcttttgcccgtctctgtcagtacttatgtttttcatgaatcaatagtatcttgttctttcttctgtttttaaattattttttccgtgatttcttaatcttagacttttttgtgcatttgcagcagagaagctggggcttccttttgtgcctccataccttgaacagaacatgcgcatgggtgtcggcagtgtcgacctcagcaacattgatgggatgatacaaggtgtcaactatgcatccgcggcagctggcattctctccagcagtggttctgagctggtttgtcctcctaacttcccaacaactctatttcacgcttataatctagcaggaatgtctttgtgagacccttctctagaggacgaatcagaaggagggtgtttcaacaacagactagaagcaatgactcttctcatagtgtctacatcctctctagttaggaagaatacttgctcaaccatttgaactaatgctgaaagattctcctgttcggctgctcccttccttccatgtgttccaactagtgtggattatcagggcatcaaattcccttcttagttcctaggaattcatgacttatatatgcttcctaccagatgtgagattgtctacacgagacgattgatatgctggtgctgatggggggtttatttatgctgctggccttgtccaagtttgcttgtgaagctacagtgctataagttgtatggttgttttattttcctgcacgcataaagcaaaaggagatatatgtagccatctactcaaagctaatttatcataatttttttattgtctgaaactaaaaaactgcatttgttctatactatggcttttgggatgatcaaggagttagtaagaatcactgatccggcaccaatgtgatgaaattgatgtatatcatcctgaacattccattttcatatcaatctttattcctgcttatgttgttgaatctccaatctttgtgcccaaaacaacaaaaacttgtggagctgcaaatgctaattttgtcatttcaataaaacatcatggtggtgtctaaagaggagaaatgtttacgtatgaacattgctgcaaagttttcctttatgtggctatatgttttaactttctataaaggattggagcctcttggttagagtnnnnnnnnnnnnnnnnnnnnnnnnnnnnnnnnnnnnnnnnnnnnnnnnnnnnnnnnnn

SEQ ID NO: 18804 - DNA, 10616 bp, Oryza sativa
atatatctatataacggttaaaaaaaatctaaaaattcgtaatttccattcgtcacctctctttttcgtccgtaagtccaagagtccctacctagtcctcccccattcaagcaaaactgaacaaaaattgggagggcggataaaagttcaatacgaaagacagatgcatattcgatctggactaaaaaacagatgaaattaaccccataattacaaaaagatttcatggatctaacctggtggcggccctcactggtgaggctcttgggtgtcggggtgttgagggagctaggtaatcgataaagacaccgggaggtgattcccagcaacggcggctctcactggcggcgatgtcgaggaagcaggcggcggtggcaactttgtgaggcggccgccaaaactcagtcgcctccgcgacctcaagcctccccggctggcagatccgccacccacaaatttggtcgctgcccacgcgccttggccattgcagctgccatggggccatcgccgagagacaacgggatccaggcgccggtggcggatccacgcgagtatgaatgacgccttggagccggtggtcgatatggtctgcgacaactcgggtggaggagggagagacgcacagaaagactggatcgccgccgtccactttctcgtgtcgccggagattggatcggggagagtaggggagaaaggcgattagggttagggttttcggacccttcccttcaaccggcgatttcattggcacgggaccaatccgagccgtccatcagatcggacgggtcagatcggccccgcgtcggccgccaccgctatcgggccatgcggtccttgggccatggaagagaactgggtcgtgcgcccttcgcgcgctcagttcgccctgcgtcagccatcgccagtaggatggcccgcttgctgtgcaattgggtcgtgtgcttgcgctgaacgggccggtccaattttttgggctggttatgaaagtaatagaccaaaataagattttatttaattctggcgatttaatttatttagtcttttatagaaattttctttggtattatttggagccattttaaaattgctgaaaaattatgaacgattacttgatcactcttattgtcatactagaccgcttaaaagatggctcagttaaactttatccaacacgacattacccggtgcaacgcatgggcattttggtagtatatactgaactagcaatgcaaatggcccatagtaacaacagggttaagaaattagatgcagctgtacctaagcagaaattgatgttgcaaactacttcctccgtttcacgttataaaactttctagtattgcccatattcatatagatgttaatgaatctagacatatatattcattcttgcatccaaagggactaactaaacttttattgagaaactaggaagatactccctccgaccggatgggatttcatagtacagcgaatctggacaggaagcatgttcggattcgttatactataaagtgtcccattcgatactaggttgttatatcatatgacggagggaatagtaatttccatcactttgcacccatttaccaaacatgctacactaggacttaaaagtcaaattctagtcttactattaattaatttcccatcaaaactttctatcctcttcatcacaaaacatgctagacttaaaaatcaaattctaatcttaccattaattaatttcccatcaaaactatcagcagccgcactactatttcccttatataaactcgcagtattctctaaacttgccaaacaggcccacggctgtaaatttggatttcaatatatggcaggtgcgattatatttcattaattaaggaatcatactcttgtgttgctgtaggtggcaaataaaaggggcattaattctccacataagaagggcacgaattagatggtttccttctatatatatgattattacctctattggattagcctaaacaaatctgtactagtactgtaataaaaaaaatccccacataaatacaggagtgcagtacatatgaaccccttctgctatgaaaccctgtggaagacggctggccttggcacagcgcatagcagccggcgttgagaaggggagcgaccgatcgtactgatcgatttgttaggcttttaggcataacgaagaagctagcaggtaagtatatgcctgcagacttgtcatctctattttgattcttcacattggtcctcttgttcttttccttgtattcatccatgtacacccgattcgagaatctgttttcatttttcaaaacaaatagtccatattactttactcaacttttaattaaattttactagcgctatacccttactttgccaagggattagaaggaaaaattacgagggttgagttttaaccatctggttttactggtgggatgagttttgggtggaaaacatgtgttttttttttgtcgaggtgcgtttctttacaacgaattacgatgtagtaggaggagggcgacttacactttttagagcaggtataataaggttgagtcagcaggctatacgttgttacacatcagcgaaatcctatgtggttgagggagaaaagaagaaagagaaaaaacggacgctagatctgttgccgggcgatagtgtgagaaacgaggctcttaccgctcgcttgtagctgatacgggtgatacctgacatatttggtgggcctgacatatctccactatccaatgtgcatgtatttatgtttttctccctatctaacacgctagagcacaggcaacacaaatagctacagggatggtggttagttttgatcatgccaattaatttggttgtgcatgcatgaattaaatgttttgtttatctccatttagctagcgaagcagctagctcatcgcgtgagctttctctcttgacggctatatcagacatggcgactgcctgcgcgactcacgcagccgctgccccccacccctagcacgagagcaagtgaacattagttgaagagatttagctgttgccactgagatggaggaaaatagatgataaggggaagaaagaaaccgttactaacatgcggggattatgataatgctataagcgttacatacgtgaaatccacactaatttgaacttaactaatatttttattgttttctttaaaataagaggattgctacagtccagcaggttgtaccgggcggtaaaacaaatctaaccgttgaatcgggatgggtaggatcgggagagaagatgagcgtcgggagagaaatttaaccggcgttcgagtcgtcgttcccggcggcggcggcggcgtcgaagtcgtcgttcccgacgggatagtccaggagacggcggtggttgatcctggcgatggcggagttgatgtccaggtggcggcggcgttgatggcatcgatccaggcggtggcgacccagatcgaagtcgcggtgtcagaggatgaagacggcggtggcagggcagaagcacggcagcggcgggggtgaggaagcacggcggcagcggggtggaagcacaacggtggcggggggtgtgaggcacggaagagggagacggcggcggggcggggcggcacggcccgatccatttgatctaggcttcccattgcgaagttacatttttgcccttccatctgagttttcaggtcggtattgtacaaggatagaattggtaccgagccgttggatctggccaggaatttggtaccacccggtaccggtaccgagcgctggacggtaaaaagactcttaaaataaactccaaatttactcaattttaaaataacctttaggcatgacattgataatgctacggttgtagagcatgtgaagaaaaccgatcttcagactgcaaataagtttctataagagctttttattgttcataattattataggatatttttttaaaaaaaatgttgataaactcgccacccaacatacggagtacaaacaagatgtgtttcataagattttgagaaaaccacataccgcacgtgtagcataggtaatttccgtctccctttatcacgtgagtgagtcgcgtcttctttccaactatcgatacgtcttctcaaaaaaaaaagaaaaaaaaagagggacatcactgagaaaaactacgccgacaccagaaaggctgtggcggcggcggctcatggctcctcttcggtcggtttggcaccgtcgcgctagcccctactggtaggctcgatacccttaccgcggcatttatgtgataggttctccgtgatcgccgccgacgccgacgccgacgctcgccggtgggctcgagatcgccaacttctcttctccctctctgccacggaatagccaagaatgaacagaatctgtccaactatagccagtctctgattaatttacagaaatttcgcatcgtttttgatttgtggctgacaccatcctattccccatgcgtgcagtattttgtttcatatatatatttttttctttttgaggataggcaaggagtaatgcctaacatatattctcattttcagtctgtttgcactaattttgctatttttatatttagtccatgcttcaatgctgagaatggtgagatcggatacttttttaaaaaaatctccattgctaaattaaaaagttcggtacatcttttttttttacttcgaggaagtttagcacatattaaattacatacgtattacatatgcaatttatgtaatctaggtctcgattttgttttcttggagatctgtgatgtcatctttaccatgggtgacaatggaactccgtggtatcgtgcggattcatccggatgtttttcatgcatgttacatatggctttagcactcacagttatgtttgtttcctttaaattagttattctttctgtaatcctattaacgtccatggacagactgaaattatctttttgactttaacacttttatatttttcttcgtcataaataatcagttgtaactttctaaagtttgttgttctatgatcaggagttcatggatcagccacttttggaccgtgcagcttcttcctcgtctaaggccacaagcagtagatcagctttcacagatgctggattctttagtattatcactttttcttggatggggccgttacttgatcttggaaggaggaaagcactagatcttgatgatgtgccaactttggatgataatgacagtgttcaaggcatcctccctaactttgaggcgaagctcgtctcagtttctggttcagggaagtacaccgatgttacaacaattaacttggtcaaagctcttgttcttacaacctgggaattaatcctcttcactgcagtttgtgccttactccgtactgtctcttcatatgttgggccatacctgattgagtactttgttgactacctgaatcgaagtccacagtccgctaaagaaggctacattttggtgttgagttttgttgttgcgcagttcatcgaaggcctctcatcaaggcatttgctcttcagatcgcaccaacttggtgtgcgggtacgctcagctcttgtcgccgtcatttaccaaaagggcctctccctctcaaatcagtccagagaaagcagttcaagtggagagatcatcaatgccgtgagccttgacgccgagcgtgtcgcggatttcaattggtccatacatgagctttggctgtttcctgtgcagattattctagcaatgctgatcctatactccactcttggtttggcagcatttgcagcccttgctgccactgttttgacaatgttagcaaatctacctatagggaggatccagcaaaattaccaagagaaaatgatggatgccaaggatgctagaatgagggctatgtctgagatgctgcggaacatgcgcattctcaagcttcaaggatgggaaatggtcttgtcgaagatcatggagttgaggaaggaggagatgcattggctaaagaaagatgtatacacctcagttatgcttatatctgtcttctttggagctcctgcttttgttgctatggtcacctttggaagttgtttgcttctaggcattccattagaaacagggaaagtattgtctgctctggcaacgtttaggcagctacaaggaccaatcaatagtatcccagacacagtctctgtgatcatccagacaaaagtatcacttgacaggatatgctcttttatgcacctcgaggaactatcgagcgatgttgtaactaaacttctaagaggtacaactgatgtatcgattgaggtgaggaacggtcagttctcttggaacacaccttctgaggttcctactctccgaaacttgaacttccgtattcgacaaggaatgagggttgctatctgtggaactgttggatctggaaaatcaagtttgttgtcatgcatactcggtgagataccaaggttatcaggagatgttcaaacatgtggtaggattgcctatgttagccaatcgccatggatacagagtgggacaattgaacataacatactttttgacacaaaactgcatagggaaaggtatgaaaaggtccttgaagcatgctgtcttaaaaaggacatggaaatattaccattaggtgatcagacaattataggagagagaggcattaacctaagtggcggacaaaagcaaaggatgcaaattgcacgtgctttgtatcaagatgcagatatctttctgtttgatgatcccttcagtgcggttgatgctcatactgggttgcacttgttcaaggtatttttcagaacaaatctttaaatcctttttctatatgtgtgtaatcatcattgaatgcttaaactaataacttattgttggtacttgagacttctaatactacaaaatatatttttacatcatatgatttcaacgacattttctcccagtcaatttagggttttttttaaccttcagttgtcagtgctagtgctgtttgaatagaacatgttggttttgttggatttttcatttcccaacttccaaaatcagtaatagcagtttatctcactgcatagtttattgtgtggacataaacctaatgtcttaatcagatcttttgtatgtttcagctaaacagtttttaggtagcttgttcttgaacaatatttagggttcaagagtatatctactgtatgaaagttattcatcacgaccttgtatttttcaggagtgcttgcttggactcttagcttcaaaaactgtagtgtatgttacccaccatgtcgaatttttgccatcagccaatgctatcatggtgagcttccaacaactatcaaatctacttatttattctactcgcaacaatcgttttaccatgtcaattcatttccctgttctaggtcatgaaagatggacaaattatacaagttgggaattacgctaaaatacttaattctggagaagagttcacaaaattagtattttcccataaggatgccatttctactctagaaagtttagaacactcaagtggcaatcccaaaagtagtcttattcctggtgacagtggaagtacgcttttcagataagcaaaaggatgataatcaaggagcagaagaagggattgttcaaaatggtcagttggtacaagaagaagagagggagaaagggcgggttgggatttccgtctattggaaatatattacaatggtatatggtggagcacttgtgccgcttattttgctcgctcagataatttttcaagttcttcaaattggaagcaatttttggatggcttgtgctgctccaatatccaaagatgtgaatcctccggtcaatagcttgaaaatggacttgtatatgttgtgttagcttttgtgagctcggtattcatcttcataagatcccatcttcttgtcatggctggatgcaagactgcaatgatgctatttgataagatgcatcgatgcatattcccgagcttcaatgtatttctttgactccactcctagcggtcgaatcttgaacagagtaagtaatttaccttcaccatctttattttaatgagaaaattgaagttatctccttggaatgccattagaatttttattcatattcaattaatcatgaaagttgaaacaaaattgcaggcttctagtgatcaaagcacagtggacaccagaatttttgacctgatgggatatgttctatttcctgctatcgaacttcttggaacaattattttaatgtcacgggtagcatggccagtcttcgtaatttttgtcccaattattgcagcatctctgtggtatcagatattctttttattatatatcttatgttcgataccaattgtggttccagtttataatttttaagtatgtagaaggaaaaatacattgattcatgactatattgacaatttttcacagattcaactgaaaattgaacatcagtgtttttcttttcacagatttaatttaaaatttaaagggatggcaaagcaattacagataatacaaaataaaatcattaagtaaatatatgatgtgatacattacttggcaaaaatattcccaatcaaattttcaggttgatcctagtgtatataggagtgtccttgtacatttccgatgttcttctgaacaatcaaattttgtcttaaaatatgctattgaacaataataattgttaccatatttcaaaactataattatgcattttctatgacattattggtttcaagacgactcatattttgtgtttgtttttaattaccacaattccttcccttcagcaatattacatagatggtgctagagagttgcagaggttgactggagtttgcagagctcctgtgatgcagcattttgctgaatcagtagctggatcaaatatcattagatgctttggcaaggaaatacagtttatcaatgccgtcagtcatttcatggataatttatctagaccaagtttatataatgctgcttcaatggaatggttgtgctttcgcttggacattctttcatcctttatcttcgcatttgccttgatacttctggtcaccttgccagctgctctaattgacccaagtaagtacggtgggctttaatttgattagtcagatcaaattagttcattattgtattaacatccgtgctaactctcatatttactacttcacagagacagctggtcttgcagtcacttatggattgagtctgaatatgttacaagggtgggctattgcagtgctctgtagtttggaaaatagaatgatatccgttgaaagaatttttcaatacatggctattccttctgaaccaccccttacaatatcaaaaagtagaccaaactgccggtggccgacaaatggtgaaattgagcttcgcaacctccatgtttgtctcttgaactctatgttgttatataagttcacttctaacaatgtcggagttatatcaattattgattagaactcccaaattttctattcgaaatattctctgagaaaaacaatatgttattaaattactcccttagggttgataatacttgtcattttagacaagagcacggtttccaaaaaaacaactttgaccattatttttcattataatatgtataaaagtgttaataaatatatgattttattaaagtactttgtaagactaatctatacatgtaatcaccatatttgaaagacaaatattttaaaaatgattcataatcaaagattctatacctcacccttgtctaaaacgacaagtattatcagcccggagggagtaatttatttcttcatgaagttattccataaaaattggcatgcaggtcttttttctagtagtgtagagttgcaatcctctttcataatatactattttgtatgacttcaacataccgctgtagaaataccctcccaaaactatattttctttcttaacatggaaaacatacaacacctaatgcataattttctggtgaactgtttttttcctctaaagtgctttgtatgtgatgtaggtaaggtatgcgacacagttgccttttgttttgaaaggcctaacttgcactttacccagaggattgaggaccggtatcgtcggaagaactggcaatggcaagtcaaccttgattcaagcactattccgcatcgtcgacccatgtattgggcaagtgttgatagatggccttgacatttgcaccattggactacatgatctacggacaagattgagcatcattcctcaagatcctgtgatgtttgaggggaccctacgaaataacattgaccctttggaggagtacagcgatgagcaaatctgggaggtaattcttattttaaatttactagtacctccatccctaaataacatatggaagacaaattactatagaaaatacatgacattcataccccaaattaaatgagggatggattgaagagagagggtagttagctttagaagcatacttattttggggacaaaacttgagtgttagaaatatacttatttagtaatggaggtagtataatttgtaatgcttcgtatgtgcacctatgttttttttaaaaaaaaatatgcataactcatatctgctattcgatgggcaaaag

SEQ ID NO: 18805 - DNA, 17245 bp, Oryza sativa
  unsure (1)..(17245): unsure at all n locations
cagaggctgactcgccagcaaaacttctggaagacaatttatcgttattttcgaaacttgtatcagaatacaccaagggatcagagtattaaaccatgattagtagatgaaagaggggccaagtctatcaccgagactaaattttcggcttgaatttaaatatactttcttggtaacctgttgcaacatgatcagttgtgtattcggaatgtgcaatggaactaagaaattgcaatgttgttcggaaatccctggatgcatagccgatgatgtgtttgcagagatgtttatgtttgagaaagcattactccagaagtacggatgcaagtgggtagttccgctacccatataaaaacccacttgctagtctatttttcgcataattgtacacaattcagaaaaacaaaaaaactaaaagtgggataagcgggacaaaaaaggccgcttgcccgccccgcttgcatctatatccagaagttcaccatagacaagaatgctactaatataggttatataagattcatagacgcatcaattttttttataagactagtcaagtacccgtgctttgctatggaaatctaaaattgtgaggtcacatgtttttgaacgatcctaacaagctaccaacatacaaaagtctgctgttgaaaataaattaactgggctaatgaactattgtctcctttgttaagtcacttttttttactatggcttccaaagttcattcagtaatctaacaatttctgctatgctagatctttgaaaacaatcagtgcagcgaattgcataaatcatctactcctacctgtttctcaaataatgataaagtttatgagttctcaatatatagaaaagatgcccgtgcgttgcaacgggtaacgacttttttcagtgttatattaagagctgagtaataaattaaaatattgggatcactatacactatgattgaaaaagttaataaaaatcataacattgggatcgctataattataattaaaaaaattaatgaaaatatttcctgggttttcggtcgaaagccttccttccttttcagccctatgctagtgcgctacctccctccatttgatctgcttctcttcgaccctaccatcttcaacttcccgaatatgactaccatcttcaacctcccgaagataatcctgtgtccgtgcccgtacatttgccgaatcaaatcgccccatcaaatctagccgaatctttctagatcagccaaaattggtcgagggtttttatccactcgatctactctttccgttttccccaaaatcagagcgtaaaactcaggataaaaatgactggggaagatcgccgtcatcatcggcaactgtaaaacagagattaaatccaacaattaaagccgaatcgaagggaaaattatggagaaaatgatgagagaggcaagtgtaaaatagagattaaatccggcaattaaagctgaatcgaagggaaaatcatggagacaatgatgagagaggattggggaatcgatttttgcaatcaaattggaggagaaaacacacgatcgatatggcaactgcacagcgctagggttcaccctgggaggcgtgcagcgaacagatgggattataaaatcagatgagaaaaacaaaaagctcacgggagaaaaaaccggtgacaaaaaagagggacgaaaaaaactaaaagcgtctgggagacgcgcggtgaacagatcgggtaaaaaaaggggacaaacaaccaaaaggcttagcgtgtgcgctgcataaaaaaactcttttgcgtgcaaagaaaaaacagaaaaaaataccggtgccaaagaaaaccaaacgaacttttttgtttttttactaggagatttttttcctttttctacgggagtcggacaagagatgttttttttctttttttttactgacgatggaagctttttttcgctcgttaagtcggacttttttttctttctctttttttaccttttttgagtcggacatttttttcttttttttacggaggacgggaatttcctgtttttaagtagagatctctatgtctgtctctactacttaaaaaataaaaggtgcttccatcgtccgaaaaaaactaaaaaaaaaagaaaaaaaaacaaatcggtccgataaaaaaaccgggtgaaaaaccggaaaagaaaagaaaaaccaaacgtaaaaaaaccgggcgaaaaaagaaaaaaaaaatctgtccgatctaaaaaccgggcgaaaaaaccggaaaaagaaaagaaaaactaaatatgtccgatccagaaaaagggcgaaaataaacgaaaagaaaaatgaatccaactctggtaaaaaagggcgaaaaaaaatcaaaaaaaaatcagcccgattctctactacttaatctctactatgtaaaaaagaggtgtttccttcattcctcaaaacaaaataaatagcgaaaaaataaaaaaaaaagttcgactctctctcagaaacgaaaaaaaaagtccgactctatatccgatcactagtacagatccttctatctgtgacgggctctaatatgcttagaaatagcgggccgtcacaaggaagtcatctcaaccgggccgaaaagtacccaattgagatatggttgcacagacatgttagatgagtataaaactaaagcccgtcacggatgacacctatcagtgacgggccgtagtttaggcccgattgagataacattccatatctcaaacgggcctaaagttgcggcccgtcacagatgaccatcatctgtaacgggcaccaactttagacccgtttgagataacattccatatctcaaacgggcctcaagttgtggcccgtcacagatgaccatcatccgtgacgtgcaccaacttgaggcccgtttgagataacaattaggcccgtcacagatgactcatcagtgacggccaatatacttaatctctatcgggcattaactaaatcccctcaccgatgactatttttccatttttcatatgaaatgtttatatttgtaagttgactatagcaaaataatttagtgcagtataataattcattttataagtcagaataactttacgggtagtaaatgatttcaaatgaaaaaaatgtcaacaacaaagttgtataacttatcaagatttacaacttttagtttggtcatttttcaatataacatttttttttgaatagtttgaatttgaatttaaaaatatgacaacttcaaacaacatttttcaaatactaaatgatttcaattgaaaatgtcatcaacaacaaagttgaataactcatcaagatctaaaacttttatttttgttatttcttcatccgataaaatgttagtaatattattcacaaattttacatatatgtgttatagtttataaaaccagataagagatatgtcaattttgtgaacaatgttattatcactttgtcatatgaagaaatgaccaaaataaaagttgtagatcttgatgagttatttaactttgtttttgatgactttttcagttgatatcatttagtatttgaaaatgttgtttgaagttgtcatattttcaaattcaaattcaaacggttcaaaaaatgttatatagaaaaatgaccaaaataaaagttatatattttgatgagttatacaactttgttattgatgactttttcagttgaagtcgttcgctgatctaaaattctatttgaacttttcaaactttgaatttcaaatttcaaattgtttaaatagagtcaaatggagaaatgatcaaaataaaaattttgcacctcgatgagttctacaactttggttttggtgacttttccatttgaaatcatttaataaccccaatttgacatcctggcctagggcataataggattaatagaatactcataccaacatgttacaactactttttcggaagccaatctttaaagaactttaacattaagtttgaacttctcgcgtgggtgcacacgagtgagggctagccaaaaaataaaatttatttattttttaattatactcatctgtgacgggcattaacttaggctatagttaacgcccgtcacatatgactcatctgtgacgggttaatgcccgtcacagatgactcatctgtgacgggctataggtaatgcccgtcacagatcagggtcatctgtgacaggcgctagttgtggcccgattgagatagttcatctgtgacaggctatagtttgactggtcgtctgggtcaaagctatcggtgacgggctttacttagggcccgattgagatagaatcatccgtgacggccattttcccgattgagataactcttcacatcagtgacttctagcctgtgacggccgccatgcccgattgagatggggcttaccgcccaattgagatgagggtatccgttctagtggattcctccttaaaaacggaaaataaaacacaccactcctttcggcatcggtttgagtccgagatcccagggacactcctctcggtttcaatctatatcgtgatatctcatatatcttggtgaaaaaaaattgatgtgccggattaaagatctgtgtgcaaaaacggaacctaccggtcgagagcattccatttttatatgattttaatttttgggtttgtacttttctaattgagtccctataatttttatatttacatttgagtagtatcattaatactggctacttctctgctgctgcgcttcactattatagtgtacaagcggtaggagagtactagagtaaagcggtaggagagtattatatacagctttccccaatctgattttcaatttttgaattgaagaaagttactatcttggttaaaaaagattactaacaaaaataagtaaagtatttgagtacgtatatatagcattttgttgctttagaaatgtgtagcggttgggaatttgtcatagatgtatagatatagcatgacataacatgtggtttcttgatggacagttttcaaataccatttgtagctcacttgattagttcacatgcatgtcgagtcatttttgtatggcaacataaagtgaggtcataactacagggcatgtctactgtagcatattacatatatatatcccagtaaaacataaacaggtgagttacaggggaaaatccaatatcatagtaacacataagatatgctacaagtatactttataacatatttatataaggtcttgtctagctttaatgtaactgatgaaaaatccgaaaaatttcagtcacttttttggacgactaggatcgcatcaagatttgtgcatactcattatctctcccttaacgattcttctcttttctagttcgcatgcacgcacatgagactcaggacaaatcgccacgccttgctttcttactgagcactgaggcctccactgccaccgcacttcgccccatggctcactagctagccagaagccatcaacggtgccggcgagccccctctagaccggccacctctctcttcctctctaatcttctggcggcggcgtggtgctatcgggttcactgccgatgaccacatcctccaaaccccatgacatccctcacccctgccaccaaccctacccacctgcgtgcctctaactccgcgtctccagcagcgcctccgccgcctcgccgctcatcgtcgatcaggccaccccagaaggccatctccctaatcctgggagaaaccgctcctttcttcccaaaaccccacggcttcccccaaccctagccccaaaaccctaactctaatccgtaggtcatgtaccgcaatcggatgtctctggcgatgagaaagataaagggatcggcgaggatctcttcatcactgttgccatcgccgagaagtggttgaaagacaattctctaaacgttggatttcaatccaatgggtagggagcaggtgaacaccaaatctcagtcacctaaaaactaccatttcccttcattcatataaagatgtgagatgagaaagtacaataggagcacaaaatgtgttgcatatatatacacatggcagtaataatgactgacttggttaaaaggctagtaataaaattaaataaagtatttgagtacacgtatatatagcatagcggttgggaatttgtcgtttatgtatatatatagcctgacataacatgtggtttctggattttcagtttcaaaaacccatttgtcgtcgctcacttgatatatatcattaattactgacatgcaggtcgcgtcacttttgtatggcaacatagctaggtagagagcatgaaaacgtgtacgcgtgcacgcatgaggatatgtaagtgcgtacggtgcagctctgttgcacggcgagacgtacccagccagaaccagagaccgaccgagtccctcacctgatcagctgcctcacaaggcggaagcagtgcaactgcgcaagcatgcacgtatacgcaacacgcgtgtgtgtaatataatgtgtagctggctcgatcgatcgatctctggctgcctggctcgccgctcacggtcctataaatagccgcgcgctccaaacgcagcagcagcagcagcaagcgtttagctagctagctttctttccttcaatttcgtttccaaagagttgatcacagtacgtgtgtttagctagaggaagctggtggtggcgagaccatggtgggcaagggcaacgagtgcgccgcagctcgccgccgcttcagcctccgggcggcggcggcgtcgtcgtcgtcgtcgtccttcctcccctgtctcttgctggcggcggcgctctccgccggctgctgccgcgcgcacgcggcgacggcccgggccccgcgcagtctcttggcccgcttcccgacgacgaagatgacatcggagttggagaaggaggccggccggtacgtcgacgacagctcgcaggcggcgaggacgaacaacaagatcaccaacctgcaggtgtcgttcgtcggccacggacatgatactccagcaggtgctgcttattattattattattattattactccgctcgtgtaaacactcggcacgtacgcgtaccaaaagcttattacaaacaaacttcttaaccgtttaatctaattattatatcttagagttattataaaaaaatatatatgatttaatcacagtacttattatgtcaatagtgcaagttttgttttcaacaactttttgcacctatatatagctagcgtggcatcctagtcagagtccatgaaatgagcccaatgggcttaccgcctttggtccttggcccatggcagtgcgtgcacaaatacacaagagaatgcgggctgaccggttgagccggctgcatattcgcactcacacgcatgtgcaactgaacgcctgaaccagctgcagtaccagctatccatgagtttaaaaaaaaaactcagccacaaagctattagcatatttagtcatatttatatgttgggaacttgtgatacattggaaaaattaataataatcgacgttcaatattgatgtcatttttatgattcatatttcctcaacaacagatacggttactgtagattaaagtgaaaatcaaggcaagtacataggccatgttatcagcatcctatataatattattttaaaagaaaaaaaaataaataataaaaatatataaaaaggaatgtgcagtataaagaaatcaaaatataaaaatgcaatattttttcttattataccaatttattgctttggaaaagtcattgagaaataatccaaataagtacaatttgcgttaggttagatttggaaacatataacttggctttgtttttatcttatatttctagaaaagataaaacaattagtagcaagtgtaaacatcatgaacatattttccttctaattatatggttttaacagcttataggcaaaacttttgaatttataaaagtgagatgaaatattcataaaacacacttttctattcatctaatatacaaccttcatcaatttgttagcgtatattagtatgatgcagtgttttttcctcagtattccacaaaaaaaaatctaaaaacacactaaaagggtactttaaaggtatgatgctgatagaactttttaagtaccggattatttgctttaaaaattctcacgttctaaataacctctaattaagcagtatacaaatactccacacacacaaaattacgggctaacttaagcaagcatgccaataagcacgccgattttctagtaattaagtaataactgtgttgatcaactgagtaagtatcatcagacaggcgtcgtttaagtgctatatatctgcatttcagtgtagtacatcaattaaattgactccattaatctgttacaaaataacaagatggcttctcctactctgccgacgagtaagaattttctttttcttgagaaaagccgagtgagaatgtttgattgtcatttctacgctgtatttgtcgttttcagtagcaattcatttaagtaacccgtgtttctgtgacataacaagatggagaagggcaattcgctgatgctgcatacccggcgaagtggaaaccagatcaggatccgtccacgccatcgctggtcgttgctcatcatctaccgagtaagagcaactccaatagcctcttcaaaagactctccaagttaaattttgtcaattcttgaaaaaaaaagtactccaatagcctctctattcaacttgccaagccatttggctggccaaatccttcccctcagtagccaaatttggccagccaaactcactagccatctgtgggccccacctattccctattctctttctttgcatccgctcgctctctctccccctttgccgctgaaatccctaccaccgccgcttgccaaaaatcgatggcgagcagcggcggcggtagggagccaccgtcgaggtcatcgcgagccgccgccctcgccgtcgccctcctctagatccgtcgcgagccgttgccgccactgccgctgagctccgccccgagcatcgtcgaggtcgtcgtcgccccgggtcgtcgtcgaggttgtcgtcgccctgggtcgtcgtcgaggtcgtcgtcgccccgggtcgtcgtcgtcgcgagccgtcaccgccgccgccgccgagctccgccccgagcatcgtcgaggtcgtcgtcgccccgggttgtcgtcgccccgggtcgtcgtcgtcgcgagccgtcaccgccgccgccgccgagctccgccccgagcatcgtcgaggtcatcgtcgccccgggttgtcgtcgaggtcgtcgtcgcgagccgtcgccgccactgccgccgagctccgccccgagcatcgtcaaggtcgtcgtctccccaggtcgtcgtcaaggtcattgtcgcgagacgtcgccgccgagctccgccgccgcccccttgtagatctggcagctcgaggggaggtcgacattgtctcgcctcccgcctccccgcatcatcgagccaccacgcgcggccgccgtcggcatcagggaagggaatgggaagaaaagaaaggggaaagaaggaagggggagagaaaagaagaagaggagtagaggctgacgtgtgggtccattgttattttggagaggattaatagagagtctgttggagagagcatctagtttgactagctaaatcagatggagagttggctatatgggtgtttggagagttcgatttggagaagctattggagatgctctaagtattgcagggttgttctacctcgaatattatacatagtgggtttttaatcccatttactagtactagtaatttagtccaattatattcacccctaattctgttacatgatcgacaagatggcaatgctcccttcattgatgctgcttacccagtcaagtggagtccacgtgctgatgggcctcctaaacaaccagccaccttccctgcttctccaagtaagtactgttttatgctacatcaattggattggtattctctagtactagtagttaattaaaccataaacaaaattgaccctgtaattaattctgttattacataattcacaagatggtgagaaggccgaattcactgattctgcttactcggtaaaatggagtccacgtagtgttgcacctcctaaagcaccgggcatctttgctcaacattctagtaagtagtatatattatagtcgttttatgctatatgcatgtgctattttcattgactagcaatgcaatcaaattgatcccatcactctgttgtgttaacaagatggtaacaaggcccaattcactgatgctgcttacccagtcgactggaatccacgtagtgttgcgcctcctactccaccggctgccttgtcttctctggctcatccaggtaagaacatataggtagattttgtactcatttcagcgaacctttcatggaatatatatttgaattcatgcagctgcaggcatacatatccagcgcgggatgctcttcttaatgaagaagttgcatcctggcgccgtcttgccggaaggcacgaagctggcgctgccgcacggcgaccacggcgtggccgcggcggcgccaaggttcatctacaaggacaagggcgacgccgtgccgttcgacctccgcgccatggacgccatcctcgccatgttcggcatcctccctggatccgacaagccggcgcaggtcgccgacaccctccgcgcctgcagcgagctgacggccgccgccggcggcggcgaggagccacgcgcctgctgcgccacctcccgcgagccggtgctcgacttcgccgcctcggcgctgggcaccagcgcgccgcgcgcggtcaccacgctcgtgcacgggagggagccccgcaggtacgtggtagcggccgacggcgtcgcccggatcggcggcgacgccgtggtggcgtgccaccctatgccatatctatacgaggtgtactactgccaccggccagccgacgcggtggcgctgagggtcgacctccacgccgtcgccgacgtgggcctgggcggcgccactgccgtcgccgtgtgccacgtcaacaccaccacctgggacagtgcgtacttcgagctcctcaaggcaagccgtggcgacgccatctgccactacatgccgcagggctatgttctgtggctagccaattgagagtatttcctacaaacacctgatcgtagctactctacctttcatgattgatgcttgatgcatctctcgctgctatcttaataaaataaaactgatggtgtgctctcttctcgtcctcgactcctttttttctttttcttttttttttcgaagaacagtgaaggaagctattctaattactgttgcaatcccatgcctgttgctaacttctgaggaaggatgaagatgtcagagtcctaaaagaatcggcagactgaaattctaagttttcaggaaatttgaacccaaaaaagttgaaaatcgaatagatttttactaattgtcaacaaattagtaaaactgttacactgttcgttcatcacccgtggacgaccgtccgatctgcctatccaccaagctgttcatgtgcagatggactactcgaggagtagtgtggagatgacgaggacggcgccagagcctctcgctgcagctgatttggggatttccatgtcctttattactgtgggggatttacagattttcattggctctgctcgctgctaatttgggcagtacaaacgttgtgcagccttccaccgattttgagcatccagtatgccagatgcgttcttttttttccccttcaatttttcttccatcttgaaagctcattagcacccccaacaaattaaaatgctgcagatgtctgatgagattcttaaatggtgtcgtaccgagctaacaggtagtaactgagattcttgggctttagttccgcaccaaaattagaagtttgattaaaattgaaagtttgaataaaaaagttagaagttgatgtgagtaggaaagttttgatataatggaaaagttaaaagtttgatgaaaaagtttggaactaaataaagccttaagtgaataaagactacaaatagaaacaatttatttggaaaaactcaaatgtgaaatatgtctaacttttgtagatggagggagtaatttatagcacacgattgaaaatgcattttaacatgaatgactcgtaacggtttagaatttttctaatttatatttaataaaccatggcaaaataatatggtattttaaattttcatttatttagttgcattgcttgagaatgagtttgagtggtttggttggatgtctaagtacgaatgctgctgtcatttgtgggaattgggaagattgttctttggtgggggttcaacatcactctttggaacagaactaaaaccatgcataaccaggaggatatatagcagataatcacatatttttctttttattttctttgttgctctttcatgtcagatacaacatgtattcctgatgtttcttacacatttctcatcagggggatatgttctaagctcaaaaccggacatttctgtatagctaatatatagattatgtattttgaacactgctaaagtgttattagtaaacctacaaaattacaagattaattaaaatcgacttcaattattagatataatattaacaaaatagttaagaaaaaaaaataaaaactcaagaacaaagtttttagccatttaatttgttaatttaatgactccgaaactaagtttagtttggtcttacaattttatatggttatcttcttacttatattgtgcgttttaaaagcttttgagtttttttttgattgtctagccggcagttgtctagcaaatccctaaattaattaattaatccgagattgtacaattatgtcacatcctgatttttgttttatgatttataaattatttaataaattattattagaatttatgttaaatgttcattaatttacaagtgaagttaaatgtgagaaataaaatttcctaaatataaatcatggctgcatttaatttttattaaattctccataattaaatatacgctctgcaattttctcgaatttttcagagctcaattactaattttaataatacaaagagcagttcagcaatgattcgcatattaaattaatcattaaatggtcttcttataatttttttaaatacttatagtgttcaagtattttaataatttttcttggaattattagagcaccggaagtatttttaacaatttagagatcatttcagtgattaatttaattgggaaagtaataaaaaaacacccttttcctttccgggccgaaactagaaaagttcacttttagttctcggtccattctctcttcctttcggctggttctatcccttctccgaagtccatttcatgtccctccttcaatcgggctgagtaaaagaagcccagctgaaagtctgttttccttccctctgctacagtagtcgcccctaacctccagccggccggagacagagcccgatgccgccattgccgccgccttcccccgccaactccggcctcctctctcgtgtatttccaaaattagttgaggcaaaatatcccccttatcctcctctatctcttcccccaaaaatccggttttatccctttgaattcgatgcgaatttggattcgttttcgagtttatctctccaaaccaaactctagaaaatcccggcttcgattctctcgttgtaggatcgatatctctctcccatggctataaatagagttccctccctctcctctttcggccgccacctctccctctctccgccgtcgcttgtagcgccgtcgccgcgttcgtcttctccgtccaccgccggcagccgctccagccgcccctagcagccgcctcagccgtcgacgacctacgccgtcgcctctctcggctccgcaaggtcaagctccaccccgtccaccccttccccgtagccgaaacccaccggagctccatcgtcgccgtcaacccgaagttcgccgtcgcgttttgatctccggcgaggccctactgctccttccgtcgtcgccaagctttgccgtcgccacccacagcgtcgcagccggggagaagcccgtccatccatccgttgccgctgctcgtcgccggaaaatcgtcgctgccgtggacccgaacctcgccgccctttggagtccgtcgccggccatctccttcactgttcgtcgtcgcataagtgttggtaagaatcgccgtcgccttctctttctcccggtgccctcgtttgcattattgtgccgtggttcgcctgcaaccaccgctcccatgccgttcaccgatttaggtttttttcctagggtattaatccaatctaatctaatccgctgtatgtctagcgtcatcgtcgtctccgtgtgttgccgccgggtagtcatcgccgtctctccctctccgatcgctttggtttggtgaggtttctatctgtgttccctcagtttaggttttaatctcttgtttgtgtcgttgagtagccgccgccgtgccgcgcttagctgttggcttagcattgccgctgcgctagccgcctagccgccgttgtaccgctccctgccacagctgtgtagctgctgctcgtgcgtgccaaaagtcgatgtcgtcccgctaccgcagcgaccgagccacttgctgctgcgttgtgtcgctgccgcgttgccgtagctcggtagccatcttgctaagtcattgttgagtcgttgctgctgccgcgccttgccaagtcgttgacgcagtcgtgccgctgctaaaccgtgtcactgtcgctgcttagtcgttgctccaaattgtgcaacgccgcctctatcccacgtcatcgtcatcgtggtttgtttgcttcccgtagtccgttagccgagttgcaaagccgtaggtgcatccctaggtttctaccggcctatcgtttgtcgtaccagggttttaccgtgaatcgtgtctagctcatcggtttagccgcaaccattgttgagtcgtttgctcgttcgttcgaacgaggtgttccccgtgcttcgttcgttcgtccatgttgagtcgtcctttagtttagagccgttcagagccgccggtttcggttaatcatttcggtgatcccgtgtcacgtagaattgactcgttgagtcggtatctcgtgaggccagcttgccagatcaatccaaaccatccgatcttggtcgactcggtcaagattaatctcagccatccaaagtcaatataaatcatgttatcccttttcaatggcatattagttctttttactatatatcatccactaaattagttccaataattttcggaggatgttttaatctttaatctcagtataaatcgtttgtaaattgtttaatcaatttggaatagtgttttctttaataggtttaattggaattaattttgtaaaattcataactaattcatatgaagtcggaatgaggccgttcaagtctctaaattcatctaaaatcatgatctacatgtttgtttactttttagtactgtttatttggtttttattagttttttctccgttataaatgttagcttgtcatttccgtcgttgtgaaggttcgtgagtgcgtcagaagtgttcaagaagactaattgaagaccgattattgcaaggcaagtcacacagatcctaaacacaatcatttgagcatgttgctcctatatttaaattctctatttatttcaactatgcatttatttttaaatgtcaccgggtggtgtgaacctattcatttgttatggccaatttgcattgattaccctattctttgataccttgggttataatttgactagttggactttatatattggttcgactatatattagaataattgcttagtcatgcttagaaacactagcatactattgggatgattaatgtttcactattacttaatgatggatactttatggtagctcacgatggttaatcgtgttgtgataaataattgataattaaaacttgataatggtgggttgtgagcacatggttttgaaggtcatgctcatgacaattaaggaccggttcgcaagctactgttgtgagacattaaccgtactaatcacaagccagaatgggcaacggctggacactttgtatagcaaggctcattgtggggcgctagactgtgaagcggcgagaagtccgtgggggtcgctggggagtccacgcctctggttgtagagggggtgattatgatccaggaaaggtgcgctgctttgagttgagctatgcgaggggtcttgtcacaactacacaaatggtggcatgttcagcatgggcacatggtgatatggtgacatattgtggagttatgtcttgtgggtaaatttgtacacctctggccagagtaaaactatttgaatagccatgcccgcggttatgggtgggttgagcaatgtttttcgtgattagtcccacactactcattaatgataataatgtgataattaatttgactcctggtttggaatggtaaattcctggtttagaggtttgatctgtacgaccggggttggttgttcaggtttggttgggcctgcagcatgggtgtgctattcagtgttgattaatattgatgattaattactctacttatttactactcctaaatgtttgctaaatgctgcttttgcaaatgagcctatattatgccatcctttggtatccgtgtgcacttgcatatttgctgtgtggcttgcggagtattccatgtactcaccttgcaataatcaatcaaatctcagttgaagaaaaatgatccagaaggagaagatgcttagcttataccccagttgagctgctgtgggagtggagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18806 - DNA, 769 bp, Oryza sativa
agtgaagaggcaactcaagcctcggagtcctgaaaagaagatacctattgacccgtgctatgaagaacttctttaagggaatgtccacaacaaacaaggaggcctcacagatatcggactatgaccgaacacttcagaaagcctatcacaagaagtccaaaccaatccctcagcttggagaacaacaaacaaggaggcctcacagatatcggactatgaccgaacacttcagaaagcctatcacaagaagtccaaaccaatccctcagcttggagaacaaccaaaccaagaggttgagccgttagtgaccagcaaagattttggcataacggaattcatttcaaacaccggtctaactgtggatcagctaattcgaggcgcaccaatcccgaaggcggaagtggcatacaagtttgaactcggtaaaccgcttgtcacgcctgagcagctgcagtccctaccaacgcagatgtacaaattccatgaagggtacatggaaatgagcgccaagggtagagagatgttcggagcgaggatcagaaaccccgacttcttgcaaggagaagatgttctctggatccatttcaaggatctctttgatctgtaccatctagacgccctcgacgtctctcttctgagcgcatgtattttgtgagtatctctgagttcgatttggttcggtcaataaataacttctggcatatatataaagcataataatttcctctcatcgctggagaatggagattaaaaggcccaacggggaggg

SEQ ID NO: 18807 - DNA, 27118 bp, Oryza sativa
  unsure (1)..(27118): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttcttcagtttattttctttattttattttttttctttttcttttttgctcgggaggaacacaatcaacaaattagcaagaaacagcagaacacaagcaatgcagatgccagcatttttattgcaatgaccaggcttaaatttcaagggtgaaaagggaaatcataatcaatccaaagagcaccaaatccctctctgtatggaatcattaactagcaagcaaaagcccgcaggtgagggacactagaagcccgcagccttcaaacgaggggaccttgagctcgaggagcttgccatggatggtgggagctcactagatgcgggattgaaaatggggagtttggagaactagaacaggggagggacagcatgatagagaagggagagagagaggggggggggggcttggtgcagagcttaatgggcctggctgattcagcatgattccacctcagtaatgcttagtaatatttccacgtggacaaaaccagggttctaaggaggcaagggatggaaataactggttttgagagatgagggacatgagttgtccggtattgtagtcgagggacgaaaattagactaaggcagtaatcgagggacaaaaactagacttttgcatgtagttcgtagtgaaattgagggaacgcatgcttatttagaaccaatttatcctttcttttccatggttgtaatctttaaaaaagatggttttcatgaaacgaactttagaaacatttttgtggaatccatgttttgctttattaattcttcataagtgatactctagtgtcaaattaaaaaaagtgtatatagttgtgaaactaatctgtggttaaactgaccaaatattatttttctgttgttattttgtatgatctacagctggcaatcatgggaggatggtactcaatcaatgattgttcgccacttcctcactctctcattaccatttcagtcgctaaaggtaaattgcttctgaaagtaaagattatatcaagaccttcatacatggtttagttttcttgtatcatattcagactatgctgatgtgcccttggaaaagattgtgcagataattaaaaacaatccaagtataattgtagcatttgctacaataccacttgtctgcttagttcatccagcaattggtcttggtgtattacttctctcacatgccttccatgcacactccaccctttgcaggtacaatttaattttactgatatttcacatgttattgttactaaaatcctctatagatatgttttccctgtgccttttgaaattgcatgtttacaagaacattttctaggaggaatttcttgcatttctcggtagtatctctaatatacaaatggatgctcatgtacatctattttgtacataattgcaatcattcaactactacactaatgttttgatcttgtgtcagtttcttagcagcttcatttcgcagtatcactcagaaaaaggatttgtataaatccatgggtgataatattattctgcccgaaaataaacaagatggcctcgagcaacttctgccgatggatgatagcccaacatctgttaaaagttttactgactgccaattggaagtatttgactgtcggcatgggatcatgatcttgcaccttcttgccactctaatgtttgcaccttctcttgttgcttggctacaggtttgttcttacacacctgaatatcatttggaaaatttctagttactcgtagtttttattaacttttgccctgccaatgtggagtgagatatgtaaaatatgcttcctcatactaattttgtcggtcatctcgatggagctagagctagagctattatccagtctttctcaaatcagtttgcctatatgcatgagtaggctatctagattgaaacggtcttattgtgtccatgtgttttggcaagatagacagtagacagtattggtctaccatttccaggactaacattattgatgagccagtgatattttgactcattactatagaaaagcaactacactgctcccatggcacttcagccatgcaaacaaaatttaataaactacggagggtgaaatttgtctcatctatttaagaatattttagaataatgtgtttttgacttttgtggaatagaaatgcaatgcatttagaatcatttcattttgtcaggaactggaaggccttgatatggcataaatgtcctaaaaataagattgtgtggttagaaatatgatgtcgatttgtattgctcgttaactaagtgcaacttttcacctgtagttaagatcaggctttgattggatttatgggctataaattgagtagtgtatagtttttcagattatagctgctacaggatatcccaatgaaatcaatgtactctaacatcgcggcatcaaaccctgccaactgtttatctctgaactagtatattttttgttgatctgtcctttggttcttcctacattctattaaatcattcataggatgcgcagctcagcaaattatgctgtgcagcttattgaatgtcgatttaaatcgcatcatattatttttctgcagagaatcggaatgggtcaaaattttccatggtttgtggattcagtactttgtgttggcactattctgcatggacttttcggatcaccaccaaatgtgagctgtatatctttcaagctacctggaaggagagggcgagatgttggactaagctttctctaccttgtagctggatattattcatttgttagctcaatggctctggctccttatagggcgctctatgcattggcaatcatcggtttcatctgctttgcttccagaattattgaaacaagaagtacggtaagaggtgatgttatttctagaaaacatcggaagcattcatagggactaacaaatgagaagtgtattttagatatgaagttggatacattagtttataatagcagatcgtgttttggggtttatggttggaaactgcaaagcattgctcttgacactaaggccagttttgcgagggaaatgagggtatatttttcttttcactgttgtgaaggagatttgatgagtcactcagatgatctggatatgttgtatcataggtggggttgatttgggggaattttaagcccattgttatgaaaagacggaaccagtaactgtacattgttgaatgccgacatgatatagtggttttttcatgaatgacaatgggttccttacttccttaggggggaaaagtgtgaaatatatatggcattttcaagtgctacattttgttgtactttctttgactgagctccctgctcacttctcatatacaccttttttttttctgaactctagttcaatatgtggaaactgctctgaagagaacgttccctcgttgtttgcatgttatttaaatagttattaaaaaattaaaaaaatcttatttaaaaaattaaaaaaatcaataagatagattaatatgtgattaatcactcaaaaacataaaaggttatatttaacttctacatgttgcaatgaaatagctatagttatttttttcacttgtagaagttaaattctaacttgcaattgctatacatcggacaatgtttcatcatatataaaaaaatgtttcagatatttcatcactcattaaataatgtttcactagaaaatgttacagatgcttcattactcgatgagaaatgattcaccaattggtaaaaaaatgtttcaatcagatgaaacagtgaaaaaacactacttgcatcatcaagactcaattctgcaacatccaagaaaacacatcgtacatcatgtgcaacatccgataaaacaaggatgaaacacacgaatacaatagagtgcaacaaacatatacaatatattgcaatgtaacatcaaatcaaaacaaaatgaaacaccttaatacaacagagtgcaacaagctaaaacatcgtacatcatgtgcaacatccgataaaacaaggatgaaacacacgaataaaatagagtgcaacaaacacatacaatagattgctacatcaaatcaaaacaaaatgaaacaccttaatgcaacagagtgtaacaagctaaaacagtaggatgcaatatcctaaactccaactaaacaaacccacctccatcttcttcatctccggtcaccggcgagtccacctccatcaccggcggtgccgccacctgctgctgctgctgctgcggctgttcttgctgcagcgccaccgcgcccaccgccgccagggacgggccggctgcagcactgccgctggggacggaccggaggcggggacagtgatggtctgcacaggggaggaggaagcagcggaggaggtgacggcaaagtcagagacggtgccgttgcatgaggcgaaggaggggagctgcacggccatcatggcgatggctggcgcctgcggccggtagagcaggaacaacgccgccgcaccgtccgcgacgagcaggatgaatagcgccgccacgagcaggatgctgaccagcccgtcgccagcctcgtctagcaccttgcctctgccgcaaggggaaaaaaaaagagaagagagataggagtgtgtgtgtgtgtgtggtggggggggggagcaggaggaggtagttacagagtaacttttggataaggacgagtcgtccgatatttggcgtcggaccagacgccagatacgaagcattttcgtgtttgttggttagaatgaacttgcatttttgtgaagtgatatattcataattttttgagtggcatataaataatgagcttacgtcccctcaaaagtttaaaatccactctttgaagtattgaatctgggacgaaccaatgtattgaatctttgatttttcactataaacattatctactatgaatataaatatgataatcttaagttcatttgctgaataattatatcacaatctttaattttttttgaaaacatattaagagatatattatcctctaagtccaaagagcacaagggaatatttggatgaaggtaacagtagatacatatgtggaatgaatgatgaagatggacatttttcttgattggtgagctatgctaggtcgtatgattatagcctcttattatcccccatccatttaattacaaaatctacccctcattctcttccctctttcaacaatatggccctcacatctcccaccaaaaatgggatgcactgaaatcaaaatgaagaagaaaatagaaaaagaataccaaaagaaaaaaaaatcaagaatcacaagtatcaacaaatttcaagcaagggatcagaagaaacaagaatgtcatccattcatgggcgaccaccattgatttacttgttcctcatcctgctccccctactctccgccgtcctcggcgcggcagcgccggccgtcttggtggtggacgccgagagcgacctcgtcatcgccgcgccgtccgcccgggcgcgttcgccgtggtcgccgcgtggccggtgcacgtccgacttgtggtcagcggccggcgccggcggctcgtcctccttctcctttcttgcggcgagcattgcgatggcgtcgggcgcgacggcgctgttgctgccgcttgcgccgccgccgcccatggccctctcctgctcgacgaagagcagctgcacgatggtgcgcagcggcatccggtcgttggagatcgcctgcgcccgcacgtccggcgacagcttccggcagtcgatcatccggcatagccgcttcttgtccgccttgctcagctccgggtgctcctgcatacgccattgttgatcttatcagctcgaatgatcaattaatttagctggtattttgacggtgtgattgattctgtgaccttgagataggtgtcaatggcgtggtagaggccgtcgtggtcgttgcgggcgatgtccggcaagcactcggcgaggtcgacgaacttgccgacggggaagtcggcgtggagcgcgacggcgcggaggtactcgtcgaacgtcctggccaccttctccatggcggcgctcatccgccgccgctcgtcgggcggcgccggccgctggaacagcgccaggaagtgctcgagcacggcctccgcggcgccgacgtcgtacgccggcgggtccgacgacgacggcatcgggacgagcaggtccaccgccctcgcctcgtcgagctgcgccccggcctgccggaccagctgcgcgcgcgtcgacggcgacgcgccgacgtagctcgccacgcggagcagccggagcaggaagcggccggtgaccgcgccggcgtcgccggggatcatggtgacgatggtctccagcacgcgacgctgcttcgccgccgccgtctccagctcagagctctggccgttggcggtggcggcggcggcggcgtggttgagcgggtcaggcaggtgcttgcaggcgtagacgtggagggcctcgccgatgaacggcggcgggaggaggcgggcggcgcagacggtggagaggagggagcggaagacgtcgatgtccagctccgacacgtcctccgtccaccagtccttgggcactgactggtgggccttctttgcgtacccaggcctcgtgtaggtgtacgaccacgtaacctgcacaaatatttacgctcatttatgaatttttcacagaaatttcgtcaaatacgagctaaattcggttcatatctcaaaagaaataaaactgggttcggctgctacgaattaggtcaggctcgatttgtatttaaaaacgatctaataaactgttatttatacttttctctgttattactatataaaagtggaatcatcctcctcctgtcttctatcttagcgcgcagcgtacataactatcgaatctaatgttttatttcctaatcatacttatactatatccttatttacttctaccttagcgcgcagcgtacataactatcgaatctaatgttttatttcctaatcatacttatactatatccttatttacttctaccttagcgcgcagcgtacataactatcgaatctaatgttttatttcctaatcataattatactatatccttatttatatgagcgtgattggtacaatatagaaacatattactagaaagtggttggtgtagtgaatttgtcgccattgccacatcactactttctctacaatgcacaaaaccggcttgatggttacatggttttaggttttaaaatgtatgacaacgttttattttaaaatttcatggtgtttaaaaagccaaatgaattttaatttttggcaaaatttgtgtaaatttcacttgtattcatctataatctgcggtcatcaaccgtttccgcgccaaaatcaagaaagaaacgggaaaaaaaaaacttcaaatggctttcaaaatcaaaatttggcgcgaaggacaaagcatctaccttggaggggggcgtgaggatcttctcgacgatggcgtcgacgcagggctggacgatgcggctctcggaccagccggagatccgccacgcggccgtgagggcggcgatggggtccttccagccctggaggatgcacgagtcgaagaaggagtcgagcttggcgacgaggttccccttggccaccgcctccgtcatccggaggaatctcgccgccagcgccgccgccacgaagtttcccgcgccgatgttgatggagatgccgtagcagaacttggcgcacagctcgaacgcctcctcgccgccggggatgtcgtgcagcgccaccggcaccggcgccgcatcgacgccgtcgacgccgtcgtcatcggagcagaggcgctgcaggaggccgcacttgaggaggagggggaactacagggtaaaaacacctgaaatcaatcaacaggttggacattggaaaacagaaaagataaatactcaccaaattttaattttctggcctatttgtttgtatttctgttcttcatttccttcaaatggaatcctctagttatgtgctaaaacctttgttgtaagtttgtgatattttttgggacatgtgtatattttgaattggcagcaaaacaatattcagtctgaactgtaggcaatacagatgcagttttgctatgataaaggctttgatagtctaattgctaccagatttatgtccttaaactatgattatttgcttttaacttcagtttactctgaagtctgaacttctgttatggtactgaaattgcttacagggaattgttctaggttttaaccagaaattgatgcaaataggaaatgaaattagcaagagcactttaacttttgattgttctcttctctaaaaaattgcttgcatacttgataatacggatggcaaccagtgccttctgtatcagcattttcagagtgggaacagaattttagctgcaagtaattttgagaaaagaaagtacaacaattcagatttactctgcattccgagcaacttaatcacagattgtcttcattttccaacctaaaagcaacatcctttttatgaaagcataaatgctgtaacacttgtgtccatgcaaaatagtttctcccagttttgttttctttaatgtcaaaatgcacataattgaatcagaagcttggtcatggaaaaataaatcaggaagccagttttgtacatttgtcctataatcttttcaaaatcatgaatcatgagaggatctgaaggaggagcatagtccaaactgcaaaaatcttaaataacagcttaatcttcagttttatttaaaagaacttcaattttaccacttgttcactttagatcttttccattaaactatttccatcagtggcattcacgggactgaacttaaagagaactttgcattctattcccgcaactttcctaaccgggattttgtgaagttcagaagaagcttttgaggcgtggatcagaaaagggcatagcaagtaatttttaatgcctcatttgatgcttataccatgacaatcttggcaaagcagatcttcaggcctatgaacctaaaccaatgtcggttcgtcatttcagaaaggatgactaaacaaagatagagttggtttgaggccatcattaggctttgatgtgtgctaatcattgcgagccgcgacttggtaaagttgccttagttcacaacttcacatcatcattaggcctgtgacattgcttaaacaatgtaatgtagcattggggaacatgtgacatgttaaactatcagagaaagatggatctgattcagcgcctcctatcatattctatgtttcatatgtatgcccaatgcttaataaatcagtgattcgcaaaggtggtgtggctatcagatttgaataccttgataagggtgcaaatggagttgatggccaagagtatcttttcaatcaactttggctttcagtatggaacaaaatcttttcaggggagatgctcctcagattggattaggtggccaaggtatttttgattgactattgaattcaaatactgttttctagaagaaaagtctgtgatcaatatgtatatcttatatcattaaaagttaaggataggaaatttcatcagcactgcgaggaatataggaaatggttcaaaagtggtaataaagataattttgcatcaatgaacaaaaccagcaccttatgtagctgatactttgtgttgttgacatgtatgatgagatcagcaggtacgtctgacagtacagacctgtagtgcaacaaagtcaaaatagttacaaatattcattgaaacgacaaacgaaaatacgaatgcacgacatttacctgacagcttcttcggtgtagaatgtgtcaggctttgtcccaagcttcatgtacttcatggtgaagaacttcttgatatcctgcaaaggatgctctggttaattgactgaactcatcactatcttaagaaacaatataactgaatattgctgcaggttcaatgaactacatctgaggtgaacataaacagtgacatttttctttactgaaactgaaactgacaaaaaccttgctggttctgtctaatttccagcaaaacagagcaaaatcaccaagttgggtatttcatcaagaatttcataacatggcataaatttccaataacttggtcgatcaataatcccagaacagaactagataaactgttttgatcttttatctagtatttccagcaataatcccagtcaccaagctagcaagctgttggctggttattcttcagaaccattgctcgaacagaacaagcaagtatttgacaaaaaaaccagaaagtgctgatgaaattgcaggagcttgattctaagaaacatcaaaaccaggggcaaaagcatgccatcgaaacaatgatagattggtaaaacatttaaaactcaagaaaagctccatccaggcaaaacaaatgcaatgtatgatgctcaagtggatccataccttgatgaattaaagagaaattctgaagccttaagatctgccagctaaaaagctgaagcttaagctaatggcaaatgtgagggggactaataagatgtggcccttctcttctctttagagaaaaggcacaatcagccttgctaatatatatatatatataaacctccaagggaagagaggagctttcaggaccacaccttcaattttgtgagtgtgtgtgttcactgttcatagctactaactttctgtgagccccatactagctctctctctctctctctctttctctctatggcctttcaccttcagagagtatccctgataagaaaaaagtgtacatattattggtgtgttttttgtatgcatttccttggtgttatatgcaagcatgacttcacagttagggtcacacatagcacaagcacttgggtggaattttaggggtcctgttgatttgattaggatcactctagcttagcatagctaggtcctttttgttgatggtgtgtgttggtgtgacttgtgcccaaaccacacacacactcatcatccaatacaaagacagggtgctggccacattagtgacaaagaaaatgtagtagagttggatcttgcctcattagaggcatcttttttaaggaagcaatgaagaaatccaggataaggtaatcaaaattttccaaggaagagcggagaataaataagtaaatccaagataactttttaaacttttctagtgtaggaataatccaaaagaagtggatttttctgctagttttgtgcttgtgtgcctagcatttttcttgaatgcccaaagcatcaaggcattaaggaagacatatggggcctccatgcaactcatgtcccttgtatcctcatcatgcaccaaactccagcttgtagcataaacatactcttcagttttcagagagagggagagaatcatagagagagaggtgtgtgtgtgtgcctccaaaaaataaaaggtaaggtaggataacaaacaaacagtggtgattgcactaatgctctgtgctgctttcagatggaacagtgctcacctcaagcagcagcagcagcacaaggccccatcatataggcatgactttgttacttgctcttcctctccttttgctgttctcctttttctgcacaagatgttgccaacttggcctcatccctctgtccatttatgtaggctggcctcagtgttcaaatgcaggcttgccatgatcagcacctatatatattgagtttgatatataattgatgatattgatggacaaaattcttctctggctctgtttcttttaaaacaaaaatccatatgtgaatagtagttgcgagttttcagactgcgacgcgcttattcggtttcccataattctgaatgaaactcactagctaagtgggatgtggactgaagcatcaagtgcagctagcatgaaatgcacagcatgtgccagattcaatgaagagtgggggttggtgccctggaagagaattgcatgatggaaaaggaccatgcaacacagggatttaatgtttgcagctggtgccttgcaaaattagtacaactggtattcaatgtatttatagctaattgttgatgagcaaagaagtacaaagagaaaaacgttttccatgaatgaaaaaggaaatatatgcaaaaaaacacaaacacaagaaaggaggtagttactagatgtgagtgatataagtaaacatgattgcactttttgcagtatgggtgtgaagtacaaatccccttgatcattttttttatatatctcaaaatgaccaaaagaaagcagcatgtgccttggattgtgcccatgcacaataaaggctccaataaaaataaaacaaaccacaacaatttttttttaaaaaaaacatatatgattcactagaaattaggatggaagaactgagaaattcccttgtgacacaaggcatcgaaagaatgaactgcaatataaagcttgatgctcagcatatatgcttatacagtttaatgaatttctgaagaaatcatcatgcatggatccatgcaaatgatgatcagagtcagtaatcagagcctcaagagggagagagagagagagaaatcaccttgataaggaagctctcatacatgcagctatctgagagtttagcaatctttctccagatgatcgattcagggttcttggaaactcttcctttgtcaagatagatagatagagagagagagagagagagagagagagagagagagagagagagagagagtggaaagaaagaggttgttgttgttgaagaagaatgagaggagggttaggcctccatagttgaggaaggttataagaagggaagaaagaggggggaagatgacaatcaagagatatcctcctccctccctcaaatgcctctccagctcccagatgtcctatacaacaaaagattctctacttattgcttattggctcaaatcatgagctctgtagtgttaaggaatggtggcaatgtagctgcacagaccatgaccatgagagagagagaggcagcaggatcttgttgcccccacaactcggcggaggattgtgtattattgccgtcactagctaggaacttaggaaggacctcacctccctatagctgaaaaataaagcagcatgatgagtttgtaagaaaactgcaggaaaaaggtggtgtgttgagggtagtgttggtcagaatggttggctgatttactttaatgtagaaattaattggttaatataggatgtatctcataataaaataacactttatgttgctatatcttgtaaattaaacggttaattttggtggtccatctatatattatgcattaagaaaacatgcatatgtacaactctgtatctatataaattttcaaatggcttgactatgtaacccattggataaaaactaactagccaaaattcaattaaaaattacatgattttttgagagtgtatgttcgaccccaaacacaacttaagctgtgtttttaggtaagggttgggaaccctcaccaccgacacggaaaacggagcaatagattagtatgtgattaattaattattagcttaagaaaactttaagaaatggattaatatgattttttaaagcaaatttctatagaaaatttttacaaaacacacaccgtttagcaaattgagaagcgtgcgaaggttgagaacttggatttaagaacgcagaaccatccatatatgcacatgtgcatgtgtgcccctacaaacaatgggtggaccgccatggacaggtgcccgggcatagagatgggtaaaaatgaccgacacagaaaaactgaaccaaactaatcgagatcgaaaacaaaatgattgaggccgtaaaactaaactaaattgatggacaccaaaaaactgaaccaaactgatcgagatcgaaaacaaaatgattgaagttgtaaaactaaacttaattgaccgacaccgaaatatggacagactcaccggcactagcgagcataccagtggccaatcataataggttttgctcaaactctagaaaaggcccgcccccattgcatacaaatgttgggatttttagaggtaagaggcttttcttttatgaaatagatagaaaatataacaactagcttatttttatggcattagttttcaagtcattgatggcacaatctttagtacttgatggcattgtatcgatgttttaaatcatggtaataaagttgtgcgctgcatacctgcactcagaggttttcaaccttgaaaagctaaactgttgagaaattaatatatgcatgttatcactgccaggggccaggtccactttaggcaccacactgctacagaacattatcttgtaacacaatcaagtaacacataaagaactatgcaaacacacattatttaagataggtgttacaggaaaacactatagctattttttctaatatgttttcatgccagcttcaaattctagctagctttgtacgtctacattatgacctattgataagactcctccaacctcttcaagctgggcatctctagctagctccaaaaaaattatgtgagctgcagctgctggaaaaatagggtttgctagacatgagattttgttcacattttatttattaaattagagccttaaatcagtttattctagccttcaaactctttgttatactccctctatttctaaatgcatgatattattgacttttagacatgccatataactattcatatatttaaaaattagtgaaaatatgaaaaatattaaattgtttgtttacttagtgtttgtgacatgtcacagtatgggaacaacgtttcttgtatagaagggataagcagcttatttcatagtgtactggttaacgaatattgctacatatcagtatggagtaacatagatacttattcatgttatgattatcttaaaaattaatgataattttctcttagattttagggaagtttctttaattagtaccactatatttctctctgttgaggctagtgactactgctttgcatgccctgctgtaataatgttctaacagttttcttaatgttctaaaaaaagttatcttaaaaaagaggttgaaaagtcaccagcgtcgtacatttttaaaacccaaggtagaattaagaagataggagttgaagctttaccaaaatgcctttaatacatatataggagtatggtgtaaaatttatgcactgtactgtaacatacagaaaagcatctttttcaatagaatcataatgtaagataatttagttcaccacggaaataaatttgctaatcaaatatacacattttcctatcacgggccgctatatatatatcacacacgacaatcacgacgtgaaacattccattatgtgcgccaaattagtttattatgatggaccgtgctaactagaaactagagcactcgatcgtagcctccacttttcctgtgccactgcatccacaaacttttgaagaggtcacaaacacatcatttggctgcttgctgagcattttgcttggacagatagggatgcactacctcctaactcatcaaatcatgcataccacatcatctcatccctttctccacggcaacactctagaacaatccgttttcattgtacacaacaaaaggcactcaatatattgttcagaagaaaagaaaagtttatgcgctttcttgacatttaaactaggttacaaaggcatcaaaacaaaatacaagtcctgaatgttcactatcaatgtttccaagtaaccatttcttttggactctccaacctaacattggtcgagatcacatattgcgccttctaaacaaacaaatatctggatctcaaaaccacgattatggcacacttattatagccaataaatcaaggcaaaatttacccgaggacatccaaaatttgtgtaattggttgaaggataccgtaaaatcgtggctctgctaagggacaccacaaaaatggtgtaattggatataagacaccggaagcattattttataatatttgaaaaaagcgtggagagagaaatttaaaatagacaagtttgctcctacctgctctttctccacctggccacgacgcagcggcgcgctgcgcagggaggctggcgcaagcgcgggagcgcaccgagatagggaggcggcaacggcgagtggtgacgaggaggaaagcgtggcaggctcaggatggggtggagatggagctccgatgctcaccaggcacaacggaggcgtggacggggacgacaaagacggcggtggtcttgccggtgctcggggaggtcccagttgacgcctagcggcggcggtgcttgggacagagcgcacgacggcggtggggagggcatggcatccgagcagcgaggtaaagggggagaggtggtcctgggcgctgtttataagccgtcgggggagaggaggagccgtggaggagctcggccggttggttcgccggcggccaaacaacaaccaattaattcgcacaatagccgtgattcacgggggatttatgggtgaaacaatgtggatgggatggggagcaacccccccttccccgacctaattcagtgaaacgatcggcggttgggggtgaatctgcacctcctccaccaccaaatccgccaccggagtagcttcttcctctccccgaccccaacgactccaaccagccggccacgtgatcatcggcctcgctgatgctgccattttgtcccctaccccgacccccaaacccactccttttgttgctctgtatcgagctgaagcatgaagaagaacagcgtgcagggtacatttgtactttgcacgatttctctctctctctccatttgcatcaaatataataaaatgatgggaaattttgctacaggacacttgttatgtgtggttttagtcctaggacactgtccaaactcacttttgggggcaaacactacataaacgtggtaatttgttagtagacaccgcaccgattaaaataatactttccagttggggaggggagagaaatcacgtgaaatgtcaataatgcccttgggcccacatgtcagctctatctcctttctctcttctcatctctctctatattctctctcctcatctatctcagaggcgcacgggacggcgtcggtcgcggcggagatagcgaggacggcgtccggcggagtggcagcgtcggccaagtggagtggcaacagtggcgagtgagcgcgcggcaggcggcagctagcagcgtgcgagcgagcgcagcgtaggcggtagctagtggcggcgagcgagcgcgtggcaggagccgcggtagcgggcagctagcgagagcagcgcgcaccccatggcgacgcaagctcccaccttgcctgccgccgcgtcctggagtggctccgtcctccccctcctccgtggccaccccccatgtccgcgcaccccgtctccctccgccctcgccgcgggctgctgcgtgcggagggcagtcggcagcggcggaggtggttgagcagtcggtgaacaccatctggttcttctccgtggacgccgtggacgcaagctcccaccttgccgtgcaccccatctccctgtgccctcgccgtgtaccccatctcccttcgccctcgccacgcaccccgtctccctcgccgcggcatccgccctcgccaagcaccccgtctccctcgctgcggcatccgccacctcgccgacgaccgtaccgtcctcgccttcaccacccggcgcgccgcaaggatcgcgtcacgcaggatgacccggtcaccctgctcggcgggaggaagaagaagaagggagaaagaaaagtgtggaagatagatggagtgctgacaagtgggcccaagggaacttttgatatttcacgcgatttccctctcctatccaaccggaaattattattttaatcggcacggtgtccactggtaaattaccatgtttatgaagtgttttcctccaaaaatgagtttgggcagtgtcctagggctaaaaccacacataagaagtgtcatgtagcaaaatttgcctaaaatgatacctccagtgtccagcaaccaattacatcaattttatggtgtcccttagcagtgacacgattttgcgtgtccttcaaccaattacataaattttatatgctatgtagcaaattttatcataaatcaaggtagcccagccagcaacctgtaataactttgggcttatggtcaaaccacgtgtcatctcagttgttcatcgatcataatttaccatcgaacttctcacgtaattatcgaccttttatttaccatccaaattaattggggccaataatgaagagaaaaaattgcaatagtctatccttcgttatcttttttttaactccattctcttgtccttttgacacacaggtgatgtccttatccttgcatatatgccaccactgggttcccttaataattttaggcaatattttatattccctctgatcagttccaaccaaaaccaggcaatgcatcacgaagtgagtgtagctcaactgtttaggttctttgtggagaaactagcccacccgaatttaaatcctaaatttaatacatgtgctcgcatttacggctaactattctttcagtaatagacgacgtatctgtcgacaacgaggcacgcatggtgacttcgtcaatctcaagatatgccggcccagtccttcagaggtactcataagggtttaggtgtgcgtgtgtgctttcatagagatgagtgtgtatgcgttgtgggcgcctgtttcttaagaaaaaaacactaggcgatgtgcatcttgcatgtttatcatcggtttggttgttccgggacgatatacaccagagattgtctaaccatatatatgaatgattgagaactctagataaagcttaggtattgcaccaaatcttcttttgcaaagtgagcgtagctcaactagttaggtttcttgtggtggaaccagtccacccgagttcaaatcctatatttaacacgggtgctcgtatttatggttaattattctttcagtggtaggcgacgtacccattgtcagcaagacgcccatgataatttcgtcagtctcaagatataccggtccagtttttcggaggtgttcatagtgtgtttccataaaaaagatctttgttacgacaaggccctaaatgggctagtgggctacgtactacagttaattgtgaatttcatataccattcgcaaaaaaaaactatgattttggtcattattttgtgaaacctaaagggattgcgctatctttattttgtgaagttacgatgtagttacagtttagttacaatataattattatatttgaacactaaaaaacttgcgacaagtagcatttacttttaggccatataaagagaagctagtgaacatggatgcaaattgcgtctatatattcgggtccatcaaatttggacaggagaggattggcaaaataatccacaggaacaagcatatattcttgctaatagttcgtgtgaacttgctgcatccgagacaagaattgcgaaaactgaaatgatcaatgcatataccttgccggcaaggcaactatacatcttcttaatgtcactagtaaccatgatgtgcattgatattcatcatgcagaaacgttctatttgttgacaattacatccttgatttgaaaatggttctctttcatctaatgtgagatgcacgttcagatgcaggccaatgagatcttactatgttctgctgggtgcacgtccagtcacggagtgatgactcaaccatgtgggctagtagtagtggtgagagttcaagtttcaacttcaacatcgactgaggttgactggtttaatttgtatcaatcacattttttttactacatggaaatttcacaatcaatgcaaaaagggatgaccttattattcatttactttttcgcggttgccccacctatactcatagtctcgatcccggtcttcaagtagctagaagggttaatttagaggttggactgcatttagcacttgagtttataagcaattttacggttattgaggaggtactatgaggtaccaaaaatttagtataaaatttagcatgatacctcgtattacctaggtaccaaatttacaatagaaaaagtggtaccttatggtatctactccaggaccgtaaaattgctcttgattttatatgttagagaactcttaattaggtaggcatgtggtaccatccacgacgtcgatttatgagtctgcaaagatctttgtaagtatgaagtcatcctaacagatcctatctctcaataaagcttttcccgacacataatttgtcagtatacgaggtctttgctagcagattatttgtagttaagaaatttggggaatggggcagtgacacttttctggatcacaattcagatccatccatcttggcatcaacatcctcaaataacacgttttcatcctagagaaaaatagaaggatacccactcttagcacatgattgtgtatttaataccgacaagtatgccatgtcaatagtgattaattttcacatggatcttcttgcgatactaccgagagtgccttataaattaaaaccgcttgtgaaaattatgattgttagtgcagattcctacgagaaccacatgtattctgaaaaatatgggatagagatagacatcataattagataaaatattttatttaacattaatttaattttttaaaaaataacaattacaactttgaatttctaaataagcataacacatagcaacgccacccaaatcccacttagtgtaattaatgacatttctctcctttctcattaagccacatcacctcaattatttctaacctttggagtgattgatctacggttcaaattatcttcctcctttttcttctcttatgatgtcatatcacctaagttttctctttagatgattaatctatattatctcatttcttttccttctctcattaattgagccacattatcttaattttgcttttaagtgattaatctatatataatttagattgttatagaccacaccatcttaattgtttatatttttttggtttaatagtagataaaagatgagaattatataaaatataaaaagttatgtcatctagctatcttatatgttatttctcctattatcattaaaaaactcccacaacaatgcttgggatttcatcttgttgagcataaatctaaggctcttgatataaattttgtagtagtttcatatgaaacaattggagaaaaaaacaatgtaccacattagcctaaatttacacttcttccattccaaaatatatggcgttactattttttttttcaatgtttcataattcaaggcgagcatgcatacatacatgtaattaactagcaccactctctcccttgagtttattttatttttaaatcctccatcctcaagatcttaaatcacattgggtgcatacattgtatttgttgaggtgacaaatgaggtggtgataataattcttttttggtttttgcgttagtgttagttgtgtcttaaattttgggatggagggaggaagaatatcttctgcagagcatttcaagtgactcaggcccaacccaccaccttaataggtaactctaatgtagaccatgtgtgctggtgacaatgtgcctgatcaaagttaggtatttatgtcatatacaggtacatagacacacttccagctaatgaaacaaccatccacagaaggcaagttctcttccaagtgtcaaggatgttaacttgccaaagaagctcccctctcataggaaactaggaaagtgatcatgatcatacaccaccacctctcacaaaagttgcaaatgtgcctcctgcaaccagctagtatgcagttccaaggatcaagcaagcatgcatggacagggcatcctatcaccatggaaccatggccaaaaagaaagagtggctatgattgattccctataccaggaactgccccatgcaagggaagagaagaagcttaattcaagccagcagatcatgcaagctgcagattcatctgcagtggtactagtgctcacctttcacagctatggtgggagacatcactgcccccaccccatcagctgatcagctccaccaccaacaccactaccactacttctgcagaaccaaatgggcagggatattccatgtcaccttccacatccccagggggctctcgtctagctccccgatcgcgttgtcggcgacaccaagaggcgtaggccaaacaacagcgacaacgatatggcattgcagattcctcttgtttgatgttgtcccctctatgctagctaggtagccagccctttcctctacctccactctcttattcccacacttctgcttacacttgatgtgtagcaggaaaggaggctccaatggtcgttgccgatatcttgtcctaggttgaaaagggattttttgggttctagggttggacttagaccaatgttggtcatgatgcattgatgatgggtaatataagctgccgatcagattagttttgaccttgagaaaataacaaaaacttgtgataggtgactaactttagatttcaatgcaggaatacatacgtaaaacttgaaggtgatgagccaaagtataaaggctgcaaaatttgtcaaagatgaaagtggtgaatttccacgcagactgatggatctgatcaatacttattgtgtacaaaatgcttatgcaacagaagtagtagttcttttagaaattttcctcgctaaacatgtataagcatttttaccaacatgtgcatggagaaattatcttctatggtccattcctctattatcttccattgtgaaattatcttccattgtagcctaaagccgatgcgcagatacatgcatggtcatttcttgacacatagagacacaaaaagaataaattccttggaaaaaaatatttttcttttgcaccgggaacgggccagaggtccagggcacacaagaaatattcctgtgcaaatgcacaggttaaatcaacaattaatgtacctaatccttttttttcacccagctttttctgaagccatttgctgtgtggttgtgcactttggaggcccatatgcagtacatgtttgtcgctgtctttagggacacttgcagaaagcttttgtgtacgatggtaagagatagtggaacttgcttcagacagtgagaaacgatatgctccctgattgggcttacaagctgtatacaagcttgtgctgtcgatcaatcaatggaatctggaattttttttatttttttcccctcaattgctttgcttttataccttgcatttggtgttatatgtatggtttgatctcctctattcctcttgtctctgagcattttgtgtcatgcattgttttcagaaaaatatgtgatcaggaaacggacaagagctgagcattgcacgggtttgttggcgtttttttgacctattggttaggtccaggtagtgtgtgacctttgatgttttcttcactttataatatgcatatgaatattgaaggttgcttagggcatgagcaatagatgctactctttagagtggccttaatgtgctatgtgggctcaagccacacataggtcacaccacccataatgaaggttgctctaaatacttgttgtgtttcagctcctaattgtaaatgtatcagctcttgtgatatttcttattatctaatcaattgaaacctttatattttagacctaaaaactaaaaacaatgtatgtatctggtggagaaaccatcattcgtcggtcggccgaattccataataatcccggttgcaacaaaaaccgggactaaagatgatctttagtcccggttaaaaagggtaacgggcatatttgatctttagtcccggttggtaacaccaaccgggactaaagatcatctttagtctcggttcaaatgctgtcagggcttgtcaggcccccccggtatctttagtcccggtttttaacaccaaccaggactaaagattgtaactttagtcccggttggtgttaccaaccgggagtaaagatcccggcgatctttagccccggttgttaacactaactgggactaaagtcccatccctttatatatgtcttcttcctcctccagcccgagcaagcttcaaaatttcttcaaaaaagaggggaggtcatgccaaaatttatagtgaatttattttggtgattatatacaaatcggaggtgcctaaaaggttagcaacttcatcctccaatgtttttttttgtcatattacatttggagctatgttttgcacacttttttgtctccaaaattttgttgtaagttgatgagagagaaaatgtatatggggaagaaagaatatatataaatttagtttatttgctaaagaaggttttataaaatagttgagaaggaaaatatagtgaaagttaatcttaaataatagaaaacaaactaaaatgaaaattaaaagaagtacaacatattaatattagtttaaaactttagaaatagtaaataagaattatttggtggaatattttataatttttgtatgaataatgatatgtcattattgtatgactcttgaaagagtttgtaattattttatcattattgtatgactgtcatttttgtacgaataattatttgtgtacgattttttttcatttcatgtagatagatcggcaatggatgtacgctgaccggcggtccaaagagtttattgatggcgtgcattattttttgagagtggccgaagctaacaggcataagggttttatttgttgtccatgcaataagtgtaagaatcaggagtattctgcatccaggactattcatttccacttgtttaaatcggagttcatgccaagctataactgttagacatcccacggagagcaaagggttaaaatggaagaagatgaagtggaagacgacaatattccggactttgctcagtacgctagatttgaaggaaatcaaacgggcgaggaggaaagggatgctgatggtaacaacgttgcggatgatcttggtcagatgttgcaggacgccaaggaggactgcgaaagtgaaaagggggcccataaattgaacaagatgttagaggaccacagaacgtcgttgtacccaggttgcgagcaggggcacaaaaagttggataccactctggagttcttgcaatggaaggcaaaaaatggtgttagtgacaaggcaattggtgatttattgaaactcgtcaagaacgttcttccggagggaaacaaattgtccgagacaacgtacgaggctaagaagatagtctgccctctagtactagaagtttagaacattcacgcatgtccgaatgattgtatcctatatcgcggtgaggagtacgagaacctagaagcatgccctgtttgtaaagcacaacaatacaagattagacgagatgatacaggagaagttgacgggcaactaacgaagaagagaattcctgcgaggtgatgtggtatttccctataataccacggctaaggcgtttgttcaggaacaaggggaatgctagaatgatgcgttggcacgctgaagagcgtcaacaggacgggatgctgaggcaccccgccgatggttcgcagtggcgaaacatcgacagaaaatttaaagactttggaaaggacgcacgtaacatacagtttggtttaagtacggatgacatgaatccttttagagagatgagcagtggccatagcacttggcccgttacgatgtgtatctacaacctccccccttggctatgcatgaagaggaagtatataatgatgccgattattattcaaggccccaagcaacctggtaacaacatcgatgtgtacctaagatcactggtcgaagatcttaaactgttgtggaagaaggaaggtgtccccgtgtgggacgaggacaaacaggaggagtttaacctacgagcgctgctgttcgtaaccatcaatgattggcctgcacttagcaacctatccgggaagtccaacaaggggtacaaggcttgcactcactatatggatgaaacagaaagtacgtatcttaagcactgtaggaaggttgtgtacatgggtcatcgtcgattccttgcagcgaaccacccggtatggaagaaaggcaagcactttgaacatacgtggaccaccgtacgaagccaaaacatcgccgcggtaaaacagtgtttgctatggtgaaagatcttaaagtagtgtttggaaaggggcctggcagccagcctatagagagcgaagatggttacgcggcgatgtggaaaaaaaaactccatattttgggagttaccctatgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaaatggctaaagatccacaacatctcaaatatctttaactcatactcatgtttaatatgtccctaacaaaaggaacacactaaacactttcatccaagcacatgatatctcaacatagggagttctaagttctaagttttagttaggatcatacaacttataacttagatacacatggcccgatgggctgatagataggttcgcgaagcatctt

SEQ ID NO: 18808 - DNA, 11266 bp, Oryza sativa
  unsure (1)..(11266): unsure at all n locations
gacagctagagaaataatgccccttcttgccgcaattgtagcaggtgacattggcattacgagatgcatctcccgcagctttaaatgcgcgagaaacttgacgaactaactgagtttgcggacgtgagggcacatacatctgcgaggttggctgaggtgccataggacgaaccgcagnagatgaagcaagacgaggcggagtggaactgctgctgccagcaaatttctttgcagcccacttacgcttacggtcttcaaccacttccttttcacttgattcaacacgaagggcaaccagtgtcttcatgctggtgatttcatgagcagcaagagcatgcttgagttcaggtgcaagacgatctctgcatagctcaaccttctttgtttcagtgttcaagtcagaagcggcatatctacccagataattgaagcgttccatgaactccatgaagggcatgtttccttgcttcaagttaagaaattctttctttttgatttccatgagaccagcagggatgtgagcagacctgaatccctcacggaaaacagtccaagtgattggctcgtcaggaggaatgagagtcttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcagaggagaaatgaggtggatgtgttcgttgaacatctgctagcttggagggtgcttgattggcctgctgtgccatggcagcccccatgttttcagagttcgctaccatcctttcaaaaagtcggttctgattagccaggagttgagcaagagatggttcatcatcatgctgttctgcagtggcagcacggcgactacccccggcacgtccagaagaatatgggccagtgcgaggctgactcgctccctcaccattggcatcatcagtaagagcagccatagagcgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttttccagtacaccattctatggaacttcggagaatccgatgggaggttgaggcactgtggttgacggagtggccatagtcaaacggtattgtctcccattccgctcgaactcatagaatggccccagcagcaccggatctccagcaagtgcagggtctggcatggttcgacgatttcgatgaaaaccaactctcatgcgggctctagtgtttatattatgataaatacccatgggaggaggcaaagtctctgtaagaggctggagttcatgattcccataaatgatggcattatcaaaatgtccttgatgcccgagtggttctattcgtctatcaagcatgaccaccctagcttgcaatctacgcaactcagttatagtttttgcgagatatctatccatagcacgaaccaggccagctaagaatagtcctggagtgtcaatctctctcatgtttccctcaagacctggatagtaattagcggaggattggtttgtgcgagctggaaagaaatgaaagaacccgtccaaccctggcctataatgtcggtaatacacaatcgcttgtaatgcagcttcctgcattgctgagggtgcatcccaaccacaagcttgaaagtaaaggggtggttcatgggtccaaagtccctgtatacacagctcagccatatatgctcgagagatgaactccgctcatgagaaaagaaatgatactccggtggatgatcataacctagatgttgcagcataagccacaggatgtgaggcagtgattcttcctcaaaacctccagaatagcccgatggttgccacatagaagacatctacaagatattggaagtatagaccaattagaatttcaattgaaactctttaggaacttggaaatggtgttttggttattatgtcaggttctgtccagcatactgctctgagtaaaaaatgagaaggacgactgctaccagttctagaatctgcgcagtttaaaaaaaattatatatttttttttaaaaaaaatgcgagcatgtaaaattcgtaccaattttgggacatgctaagaacttaatgtagaggctttacaaacatctggtggcctttatatgacaagcaaactatggttaaaacaaatcaattccatcctaccccgtactaccactttctaggccatcgataaaattttaaaattttaaattcaaatttagaagggaaaaatttagtcatctatttactgagaagttttcaaatcattcaagtactgacttgaatcgaatttgtttcattcattccttattcttctctatgagttactacttctctatttatgcatcttccggtcctatagagtaagatggggttttaaaatcaaaacaagattcataggaaaggaatttatccaaacagggctaagaagtaagaatagattagattttgcaaatatattttagtgaggacattaccctcaaaatattttcttttgaagccttactaccgctcagtcttaaaagggttcctacagtcggtcttggctctgataccaaagctgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaaatggctaaagatccacaacatctcaaatatctttaactcatactcatgtttaatatgtccctaacaaaaggaacacactaaacactttcatccaagcacatgatatctcaacatagggagttctaagttctaagttttagttaggatcatacaacttataacttagatacacatggccgattggctgaatagataggttcgcggaagcatcttctacccaaaagatctttcatgcaaccgactaggatagaccctagtaagaaccatcctggaagaaagaaacttccccaacgaaatcatcctccacaggagtgatctcacctgcaaccaattctaaacatgcaacaatacaacaatacaagcaagagtcagtacaataaattgtactggcaagcaccaagcaagcctagtactctacatgcatggcaaattcaaagtaaagctaacatgggataattttagcataaagcaaatttagtttgcaaagagcatttcaaatttcagatttattttcaaataaatttcagcaagcatacacttagcaattgggcaccaaattagatgataaacacatataacatagctccttattgccttccatggcagcaaggatataaaccacaaatcacatcacattttgaagttcaaattcagctttagaagaataaaacacatgtctaaactcatgacatattcacacgccgctcttgaccgtgagcacggctaatcgattagttttaactctgcagagtacgtacactttacccacatgatgcgaaataataatcatgcaaaagcatggcacgcgatacataagtacccgatttattactcacaacaaagcccttccaagattcatgatttagccttacaccagcacgatacgtgttactccatcctaagccatactcgatatatgacctagaaccgttaagtggcgggcccacgccttaaacttaacgccgtggtggcggacgcaacgggaacccacccacgtggcacaataccgttgtattggacagacttagtcacctaaactaccacgtcggggtaaataggaagttcctctgaatcaacgactaattcctcagaattatcgactaactcatacacaccggcctaccagaatgtaaggctaaatcataaataatttactaagcttgggctatcccatactagcacatgtggttgtactgtatacgaaatgaattgacgctgagtgaagtccttaggtcggtttgggcacactctccccctatcagtacacaactaaacacaatatgtgtaccacatgcggcccaaacctaaaatccacattttccaacattttatttaacaaatatcacattttatcattttaatccagatcataaaataaatcatttaatatatgtaattgagcccaaatggtaagtaaactcatcactaagcatggctgagcatttttatagacttgctatctcaaacatcattcttaatgtgacacaatggattgttcctaaggttttggaataatggttaaggtcttttgtggagttcaggtgataatgcaagttaaggagttgatctaacaaattttacaagattttaatggattagtgtacaatagacatgcatattttgcaaacttttcaaaaacatccaaatcataggttcaatgtgatcaaagaagggaggtggcttgccttgctcttccactccttgctcagctacaaagtaggcctcctcgagactcggctgcgaatcgtctaaacatacatatgcaaaaatttaaaatttaaacatacataaaaatccaacatgctctaaaatgaatgcttttttttatggagttggtgtgctctgtgttagtttgattttcagtgaaagaaacttcaatctaacagtttacattcaaagttacagatttttttttaaagtgtttacatgttaattatggtcctaaatgcatttcgaattattgagacataaatctttatgattctgttaagtcaaacatttttatgatgcaaagcatgaaaatatgattccaacataatttagtttgcaatttttagagtcaggatgaattttctaccactttctaaagttctgacatttttcagttgataggaaattagtttttgtattttctcaaattttcatacatcattttcctttctcaggtccaccagacagagactaacattttgcgcaaaagctcctgggttctcaggaaatagatcccgcagcccctagcacgtgttccaggattttattcaaaatgggacttgagttctatgttatttacagattagtgcacgaccccatatgtaagtgattgctcgggctgctaatacatccctgggagtctttaaatttcaaaagccatgcccttgctctggacagaacagagcagcagcacagccacgaacttcacagtatcaccagcggcgaacagcggcgattcagctcaagctcccaaaacaaaaagtgtagagaacaaccgtacgaacctattggtgtttttcttgcaagccttggtgctctatagcggctgtcagggtgttagaagcggcggctaagctcggcttgcacatgcatgtgagttttgaggctcgatctaatcgtgcatgcgtatggtaaggactctagggactactaggaggctcaccaagaagcaaacgcagctcagcgaagtcttggcgacggtgtactggttcggcgacggcgcggctgctacggtcgtcgtcgacggcgtatccccaggcttctactgcaaagagaggaagcatgcctctgtttagatcagcacaaggtagctctaggcggaaaatattgcgccgaagctcaccagagaaggagaaagaaaggaatggcgtcggcggctgggattggagaagaagaagaggatctcccactgtggtccacctcgcgtcgattccttcgggattcttgatctacaggtgttgatgaagctcgtgacgaagtggctcagcctgtaacgaactatggaagccgggcgacgagcaaaggcgaagcagcggcgtccagagcgcgacggtgttccgatttgacgcggtcacgttcccggagattggctgcaccaaatgaggtgttcttggtggtgttagagacggcattgagaggggattacagaacgcatattgaacggaaatgggctcaccggattgcgacggagtcgaggacttatctcgccggcgccggagatggcgcctccgttcccggcgaatccgaggcggggtacctcggttcttccgcgaaacgagacaagggcgagagggagagaaagttggtcggccggtcgggttaagtatggtcgccggcggagatggacaggaggagctcgccctctcccgtgctcgacgcgtgctcacacgcgtggcatgcgagttcaggcagtgggcccgtgtggagaggaatgtgaggctgacaatggggtcccgccatgcagccctggcccacatggcagcgactagtgagagagaaggagaggagatctaggttttggccaagtctggaacagaggtggaattccatctttgggttagtttaaaattagttccaggcagagttagagctagtgaccaaaggcaaagttgtaaagcaatgattgaactacagtttggatcgagttttacagcctaggagttcaagatccaattttggcagagtgtcaaagagtgctccagagaatctgtcaaaatcctgtgcttaagtgtttagagagttgtttggttgatctaatgagttgataagctaaattaaaatccgcatttagtttctaaggtcagcaagaagttaccacaaattcttcccagatttttgagttgttccaagaatttttctttgatccattggttttagttaaatatgaacatgatcctataaagcatatgcatacaccacaaaatgcacaaacaagcaagcatataagttttaaacaaaagttttatttattttacttcttccaccatttccatgttttccaaacacccaaagtcatggtatgtgacagcctaccccccttacaaaagaatctcgaccccgagattcgtcattctagaagaaactagggaattcggccttaagtcggtcctctcgttcccatgtggcttcatccgcagtatgattgctccattgtactcgaagtatcttgatggagcttttgcgggtacgccgttcactttcttcgagaatacgaattgggtattcttgataggagagatttggctttagattaatgtcttcaagtgaggtgtgctcaatcggagttcgaagacatttcttaagttgagaaacatggaatacatcatgtatattagacaactgaaatggcaattccaattgataggctacttgtccacgcttagatattatttggtatggcccaatatatcgtggagcaagcttgccatgaatttggaatcgttgagtacctctcatgggtgatactttaagatagacatggtcaccaacatcaaaacttagctctcgtcgacgacgatcagagtagctcttttgacgagtttgagcttcttttaatcggtcccgaataagagtgacattcttttcagcttcattaatgatagcaggtccaaagaattgtctttctcctacttcggaccaataaagaggagtcctacattttctcccataaagagcttcaaatggtgacatttggatacttgattgaaagctattgttgtaggagaattcagcaaaagatagacatttctcccagttagtgttatgttcaagcacacaagctcggagcatgtcttcaagtatttggtttgttctttccacttgacctcctgtttgtggatgaaaggcggtgctgaggaacaatttggttccgagaagttcatgtaaatttttccaaaatctggatgtaaattgtgttcctcgatcggatactatgacttttggtacgccatgaagccttacaatatgagtcaaatataactctgctagcttggctccaccataagtcacatgcaccggaatgaagtgagccactttagtcagtcgatccataataacccatatagaatcatgtccattgggtgttttaggaagaccggtaataaaatccattccaacttcatcaaatttccattcaggtacttgcaaaggttggagtagcccagcgggtcgttgatgttcagctttgacacgttggcacacgtcgcaaattgcaacatatgctgctatgtcacgcctcaggctaggccaccaatattgagtgcgaatatcctggtacatcttagtgcaacccggatggatagacaaaggtgtttgatgtgcttcatcaagaatggtttctcgaaggtgttgattattgggaacaaagattcgtttgccaagcataaccataccatcagaattaagagtgtatatagattgtggctttgaattgatttctttcataatttcagctacttcctcatcaatggactgagcagctttaatttgagaatagagagtaggttgtaatgctagtgcagcaacataaccatcctctaccaatcccaaattcaatttctgaaattcagaggacaacgatggctgatttattgtctcaataacggcaaggtgatgtagcttccggcttaaagtatcagctactacatttgctttaccgggatgataatgaataccgagatcataatctttaatgagttctaaccatcttctttgccttaggttcagatctggttgggtaaagaaatatttcaaactcttatgatcggtaaagatttcgcaccgattactgaccaaataatggcgccaaatctttagagcatgcaccacagctgctagctgtaagtcatgagttggataattgatctcgtgtggtcgtaactgacgagaagcataagccactacttttccttcttgcatcagtacacaaccgagaccatgatgtgaggcatcgcagtaaacatgaaaaggtttaagaacatcaggcatcactagcactggggctgttgtgagccttcttttaagttcatgaaaacttgtttcacatgcctcagaccatatgaatttattttcttttttaagaagttgagtcaagggtctagcaattttggagaaattttcaatgaaacgacggtagtaaccagctagtccaagaaaacttctaatttcaggaacattttgtggttgcttccaattaagtacgttctgtacatttcttggattcacagcaataccaccttcagaaagtacatgaccaagaaattcaacttcttttaaccaaaattcacattttgagaatttggcataaagttgatgctcacggagtttatcgagtaccatacgtaaatgttgcgcatgttcctcttcactcttggagtagatgagtatatcatcaatgaataccaccacaaatttatcaagatattccatgaagattttattcatcatattcatgaaagaagcaggagcattggttaatccaaaagagactacggtgtattcaaataaaccgtagcgagttgtgaatgcggttttaggaatgtcctccggtctgattttaagctgaaaatatcccaatctaagatcaatttttgagaagacacgagctccggttaactgatcaaataaatcatcgatcctaggaagaggatatttatttttgatggtgacttcattcagaggtcgataatccacgcacattcgcatggttccatctttctttggtacaaacaacactggacagccccaaggagatgaactaggacgaatgaaacctttagccaattgctcattgagtttcttctttaattccatcaaattttcagaagtcattcgatatggccttttggctataggtgctgtcccagggattaaatctatcacaaattcaatgtcacgatctggaggcatccctggtaattcgtcaggaaacacatcggaatattcattcacgatgggtactgattttaactccggtatagagagagattgtatagagggttgatttgaagtggaggtttgttcaaaggtaaacctaacaaattgaccatcggtgctacgaagagttacagttctatgagcacaatcaatggttccctcatgtttagttaaccaatccatcccaagaatgacatctaggcccaaggtgtctaataatatgaggttagctttaaactttaccccgtctattataagttctacacctttgcatagaagtttggtgaccatggtggatccaggagattggatgcgcatagcatcgctaagaaattctgttttcaagtcaagttgttttgctttcaaggttgacatgaatgaatgagttgcaccggaatcaaaaagaactgttaagggaatggagtgcacaagaaatgtaccaagtacgacaccaggtgcgtcggttgcttcttctgcagtgacatggttgagccggccccttccaaaagttggagctggcttgggaacagcaggagctccacgctgtccaggctgaacttgaggaggaccacgaggctgctgcggtgctccctgcgagtacggtccggatgttccagtcttcggataaggacagctaggagaataatgccccttcttgccgcaattgtagcaggtgacattggcattacgagatgcatctcccgcagcttgaactgcgcgaggaacttgacgaactaactgagtttgcggacgtggaggcacatacatctgccgaggtggctgaggtgccataggacgaaccgcaggagatggagcaagacgaggccgagtggaactgctgctgccagcaaatttctttgcagcccacttacgcttacggtcttcaaccacttccttttcacttgattcaacacgaagggcaaccagtgtcttcatgctggtgatttcatgagcagcaagagcatgcttgagttcaggtgcaagacgatctctgcatagctcaaccttctttgtttcagtgttcaagtcagaagcggcatatctacccagataattgaagcgttccatgaactccatgaagggcatgtttccttgcttcaagttaagaaattctttctttttgatttcatgagaccagcagggatgtgagcagacctgaatccctcacggaaaacagtccaagtgattggc

SEQ ID NO: 18809 - DNA, 19089 bp, Oryza sativa
ttagagctagtgaccaaaggcaaggttgtaaagcaatgattgaactacagtttggatcgagttttacagcctaggagttcaagatccaattttggcagagtgtcaaagagtgctccagagaatctgtcaaaatcctgtgcttaagtgtttagagagttgtttggttgatctaatgagttgataagctaaattaaaatccacatttagtttctaaggtcagcaagaagttaccacaaattcttcccagatttttgagttgttccaagaatttttctttgatccattggttttagttaaatatgaacatgatcctataaagcatatgcatacaccacaaaatgcacaaacaagcaagcatataagttttaaacaaaagttttatttattttacttcttccaccatttccatattttccaaacacccaaagtcatggtatgtgacaccctattgggaattcttggacgtccgccacgcaatcgacgtgatgcacctcactaagaacttttgcctaaaccttcttggcttcctaggtgtatatggaaagtcgaaagatacactggaagcacgtaatgatctgaagcatatggaacaatgcggcgaccttcacccggaaccaaaggagaaaggaagccattacttccagccagctacactcttagcaaggcagagaaggaaagtatgtttgaatgcttggagagcatcaagataccgtcagaatactccacgaatataaagcgaataataagcacgaaggagaagaagttcacaaacctaaagtctcatgactgtcacatgttgatgacacagctgctaccagttataataaggggtatcctcccagacaatgtctgggcaacaataagaaagctatatgctttcatgaacgcaatttcgcagaaggtcatcaatccggatagattagaagcccttcagaatgatgtggtacaatgtcttgtcagctttgagttgatatttccaccttcatttttataatgacacatctgctttgtcaccttgttaaagagatcggtattctcggccctgtgtacctacacaacatgtttcctttcgagaggtacatgggcgttctgaagaagtatgttcataaccgtgctcgtccagaggcaagcatcgccaaggggtggaacagaggaggtcattgaattttgcatagaatttatcgaagaccttcgcccaatcggggtacttgaatcacaccatgaagggagattacggcgaaaggggactctcggaaggaaagcaataatgacggtagacaacaatttattccgtaaagcccatttcacggttctgcaacaatcttcattggtggctccctacatcgaggagcacttggctctaattcgcgccagaaacatcggtaagtccgatgcatggattacacggcatcacattgatactttctccgagtggctgcgacaacatctcatgggtaacgagacgattaaccaacaactggccttcctggtgaggggaccatctggctcgatcgcgacattccagggatatgaaatcaatgggtacacattcttcacgagagcccaagacatgaagagcacgaaccagaacattgttattcgtatcgatgccatgggacacgatggtacaactagcacgtattacggtgccatcgaggacatatgggaacttgactatgaacctctcaaggtccctctgttccggtgccaatgggttaggttgactggtggaggtgtaacgatcgatgacagtgggatgacaacggttgaccttaacaaggtttgatactcggacgaaccttttgtccttgccaatgatgtaacgcaagttttttacgtcaaggacatgtctagcaaaggaaaaaagggcaaagggcctgatgagccgaagcgccacgtggttttcccaggaaaaagaaaaatcgtcaaagtagaggacaagactgacgaggattacgatcagtttgatgggaaaccccctttcacggtgacgattgaccctagcaccctcctatcaaatgaagacactccttactcacgtagcgatcacaagaaaggaacaatagtgaggagaaagtacgtgcggtcaaccgtcaccgccgatgtattaccgtaattgttgtgtacacgatgtaaactatttttgatgtattgaatatccaaacaaatcaattgttgtatgacatattttaattatgtatgattattagaatttttatcaaattgaaatcatccatatgctagttatatatgattattagaatttttaaaagttttaaaacatgcacgtggtatttacatatgttaattagaatttttaacaatttaatatcatgatatgctaattatatatgattattagaatttttattaattttaaatcatgcatgtggtatttacatatgttaattagaatttctaataatttaatatcatgcatatgctaattatatatgattattagaatttttaacaattttaaatcattcatgtgcttattatatattatccacttagtttactacaggtaacaataatttttcgaaggttttgtcattaatttttcggctttaaataattgtaatgcattatttactatttttgaaacacatatgtaatgaaattcaaaattcagtgctatttttctttagccccggttgttgttacgaacagggagtaatgatctgtacccccggatgttctcaccaaccgggactaaagatctaggggtatatatattcccggtgtgccctcgtcttctccaccaacacttagacgtttttccatcgagatcgatctcggcttctccttcgccgccactgcctagggcaaccccgcgccgacgccgccgtcgtctctcgccgtcgcttggcggtccttgccgcctccaccgtagacaccgccgccgcatctcttgggtgagagtcgccgctgcctctctctctctctcactctctctcgatctcgatctctctctctctccaaaccgccgccgcctagctcgttgctgacgccactgccacgccacggtcaaccgccaccgccgacgaccgacttcgccgcggccaccaccgccgacgacgccgacgccactgccacgccaccgcccccgccttgagctcaccacgccgccacgccgccgctccgccgccgccactgccgcgcgccccgaccttgccgaacgtgaacgaacgtgattgaaacgtgaacgaacgcgaacgaacatgaacgaaacgtggacgaacgtgaacgaacgcttaacgaacgcgaacgaacgcgaacgaacgtgaacgaaacgcgaacgaacgtgaacgaaacgttaacgaatgcgaacgaacgtgaacaaacgtgaacgaaacgcgtgaatgcacttgtactaaaagtgtgagaacgaacgcgagcgaaacttgtacgaacaagataattaaacgattattaaacttagcatacatatatgattatatatataggttaaaacgtgaaatacaatatatgtaacttggcccatttagactaatacattttcctggtaatgttgcagagaagacgtcgtcgtcgtccctcaagccgaagttgtagctagccatcgaaggaattcgtgcaggcaataatgtaaagaagtgattgttagagatttaatataagattattagagttttaatataagattattagattattagagttttaatataagaatattatattattagagttttaatataagattgttagacttagcatatatgattattacaattttaatataagattagtagagatttaatataagattagtagagatttaatataagattgttagacttagcatatatgattattaaaattttaatataagattattagagtttgaatataagattgttagacttagcatatatgattattacaattttaatataagattagtagagatttaatataagattagtagagatttaatataagattgttagacttagcatatatatatgattattacaattttaatataagattagtagcgatttaatataagattgttacacttagcatatatgattattataattttaatataagattattagagttttattataagattgttagacttagcatatatgattactgcaattttaatataagattattagagatttaatataagattagtagagttttagtattacgcttagcaaatatgacctatagacttaacaaatattttttgtatgcacagatggctgatcgcaatgaggaacagatactgtacgatacaatcgcagaaggaagcagccagtactggaacgaagaagaggggaacgaggatccaaaccagcacttgaacgaggaggggaacgtggagagggatgcggaggggaacgaggaggaggaggctagtggaagtcatccctccgctggacagaagagggcacgcggacaacgaggtgccgcgaagaagatagagaatcggcacatcataactgaggtggacgaagacggccgacctagtgccccggcagaagcagccaagaattttatacgccacagcggttgggttgtgagggacaacgtccctgtcaacatggtgtactagcgcaaacaatggcacgcggggataatgacagctttgtcccggaatcagagaaagagatcatgtggtctgtggaccacaatgctcgagacgttcacgctacccgtgggtacggagaacatagtgaaacagtggactctgaagaaaatggcaaaacagttccagagcttcaagggagatctcaacaacaaatacatcctgaagggactaacaccgaacttcgacgtattcccaaagctaagggatcattgggacgagttcgttgcttacaagacagggcaacaaggacaagcgatgatggcccgaaacaaagaaaatgccgccaacaagaagtaccatcaccacttggggtcaggcggatatagcgtcgcaatgccgaagtgggaggagatggaggcaagattgattgagaggggtatcgaaccggccaccgctaaatggctggatcgatcgaagttctggtactatgctcacggtggaacgcttaacccagttgatggctcccttgtcttcagcgatcagatacgcgaggctgccagtcgactaacgaacgcagcggaagcctcttctcagggcacattccgacccgacagagagaaggacgagctgttactcgccctacagactcccgagcatccaggatgaacacgagggaaaggcgtgattccctggaagattggattcaaggaggacatccacacgtacaggagtcggatgaggagcaagagagatactgaggcgaagattgtagatcttgagtatagggtatcgagctacgagctcagcatgcaagaggaggtggcaaggaaggtggatgaacgtatggccacacatcggtcccaggatccccagccgtacattcctcctgcaatggtcagcccatcaggcaatcgtagcagctgcgcctcaacagggcaggtaggatcacagagcatggacgccatgcaaacccaggacaaaaccacctgccccgttgatgagatcacgcagcggacaccatgtgagctgcatattcccttcaagaacttatcaatcaaggtatgctcgtagtttgatgatttttgacttgtacattccgcaagttgctacttaggttgattactaatagataacctctcatcacgtgaaggtggcgtcgggaatggccatcccaacggacccttccgggacttaccactgcaggccgattccagcaggatactcgagggtcgaagttgaactggtggaagccgcgtacgaggacctcgagttggactacccaggaggagacagtgagacgcatctacgagacacaagccatgccattatactatcgcgacaagcggtacatcatcctccctgggcgacaagcggcgtctcgtgcaccatctcctccggctccgccatctcctcctgcaccatctcctccggttcctccgccacgtcctcctgcaccatctcctccggctcctccgccacctcctcctgcaccatctcctccggctcctccgcctccctgcctccttcgcctcctccacctccaccgtgtccgcctgcacctcccaagacaaggtctcgccaagctccaccgcctgcccgcacaagggcaacgaagaaggcgaaagttgacgccaccaataacaaggagccgcagtacgattgcagtcaagaggagcttgatgcttatgtggcaggagaagtgaagaggcaactcaagcctcggagtcctgaaaagaagatacctattgacccgagcatgaagaacttctttaagggaatgtccacaacaaacaaggaggcctcacagatatcggactatgaccgaacacttcagaaagcctatcacaagaagtccaaaccaatccctcagcttggagaacaaccaaaccaagaggttgagccgttagtgaccagcaaagattttggcataacggaattcatttcaaacaccggtctaactgtggatcagctaattcgaggcgcaccaatcccgaaggcggaagtggcatacaagtttgaactcggtaaaccgcttgtcacgcctgagcagctgcagtccctaccaacgcagatgtacaaattccatgaagggtacatggaaatgagcgccaagggtagagagatgttcggagcgaggatcagaaaccccgacttcttgcaaggagaagatgttctctggatccatttcaaggatctctttgatctgtaccatctagacgccctcgacgtctctcttctgagcgcatgtattttgtgagtatctttgagttcgatttgtttcgttcaataattagctcctggcatatatataagcaataataatttcctctcatcgttgtagaatggagattcaaagggcccaacggcggagggtctacgatactgggttcatcgacccttgaaaaatcaacaccgaaatgatcgacaagtacaagaaagacacagaggacaatctcgtccatctcctaacgcagcagcatttcaagacgtacatactactgccgtacaacacagagtgagtttttattatcgttcgaacaaatttcgttcccatacatatagcatgtacattttcatatatatctcatctcacgcatattccagattccactgggtcctgttattcttcgacttggacgcatgcagagtcactgtgtatgactcaatgaataaagaggagaagatttttgacaaggtcttccaactgatagacaggtaatataatgccatctattccaaagtcgcggggattctattgctattatgttggtctcgggtaataattaattaatcatagcttgcaactgcatatgtagggcttgggatcggttccgtcaattggtccacgggacttgggaagaaaaacctggacggaggtttcattttccagtgagtacatgcatgatccaaaattatattgaattgaatctctaattacagttaatataaagagtatattaaatctctcatcgtttctcatgtagtgtgcaaagcaggaccagggaactaacttatgcggctactacgtatgcgagtatgcccactgcctatcaaaccaaatatgcaccacacgagagctcgatgtacatatacataaaccattcaaaatttcattgcgtatcgatttgttaagttgtttattaatttcatatattgatatgtcattatttttcgaatgatagcgtattcacatgagggataatctcccacacaaggattttatcacggctgttcaagaacaactgatgggattcatcaacaaagaagtccttaatcccaatggtgaattctattacgacggatcgacaattcataacgtcggtccttcctcttctgacataacgccggcgtcgaagtcgtagctatagctactgagcaaatgaattgtactatatatgcatgtatatatatatatttatatatgtacacatttactttagtgttaatatatattttggtaacatatatgcacataaaatgttaagtgctttcaattatacatatgtgtgtaatatatgtatttatacatatacacatatgcacatatatatatatatatatatatatatatatatatatatatatatatatatatatatatatatatatatatatataaccatgcagcaaacagagccatgcaaataaaaaaaatgatacaccaatctttagtcccagttggtaacacaaaccgtgactaaagatggtttggccggccacgtggctgaccgatctttagtcccggttggtaacacgaaccgggattcgtagtcccggttggacaaccgggactaaaggggggttacgaaccgggactacaaacggtttctccaccagtgtatacccttaacatcgtgatggacacccagttagcctccaaccgcactctttttcctctccctcccccactctctctcctaccaattaaccccctttgtccttctattcaacacagcaccccgatatgggtaatagccatactcctgtttatatgtattgttctatcttggatgtattataccaagtacaaaaggagagcaagcaacctaatctagccaaccaattgatcttgatgagcaaagcggcaggttgtactcggcatctagcgaaagggcttcctcctggtataaactcgatgtggcgttgtgtaaggcttatgatttgatgcccttccctcctgtaaagcatcatgtttatactgtgatataactccttgcgcaaataaaactcagggtctcaaataagtatggaaaaacaaggccttatttctactggaacggactttacagtcattccttgtttgtatatttatccatatttagaaatacctttccatataagaataagtatgaaataatcacaatgatagtaagtgcgggtatacggggtatgccatatctataatactcacactctttaccgatgcagccaacaatgtcaccttactctgccccatcccatccctccctcctatctcaagttagtgatatctcgatgacacaaggacagtgaggttacgtcaatttctctatcgaggccatgctaatttcgtcgacgatagcctgatctgcttcctgactgcccaatctagtacaatctgcaccaggatcctccaccaacttgacatgctccaagtctccggtactcttcttttttttcctactccctccctggttccccttatttttctaggcttggaccaccaaagcaaccgcctcatgcacaagtcaccgtgcgctctataggtcacatgtgcccatacagagctaccgctctggccgagctggcagtctgtctccaaggtggcattgggaggccactcgctaacttaccacattaatcatgtccttagacacctatcttttattgtgagcaaagaaatattgtataggttttaaattattgtaatattctaacaagattcctctcctatcctaagggtcatctaactatcttggattaagcaattaagccatttcattaataaataagaaatttaaccatccgtaacgatattaagagtaccaacctcctgctaaatgaggtaccgtgctacatgagttgctgagaaataccaaattatagtatcttttaagtacctaaagttgctcttaagggtattaacagttgttgtatatataatctttctatgtcatatttaaaagatatacagataacccatacaacaagttatcctagcatacaccaacagcccatacaataagttatccatattaaaattaagacttagggtgaaattcagctaaatggattggctttttcgtgtattacgtaaattgagaagagctgctagcgcatgattaactaagcattaactattataaactttaaaagaaatttatctgattttaaaaaatattgcacataaaatgtttattaaaaataacttaccgtttagtagttacgaagcacacaagacgagttagcagccaaccaaaaagctactaattgaaactcacccgtcaccattaattcaagttgcgtactaagtctggtaatcgatggacggcgtcctactttttttccttttcgctttagcattctctccagacggttacgtcacaccattatttatgtcataataattaccaaaagctgattcaaggcaaaggtttttttttaatatatagtgggatgttgcgagcgtcactgctgcacagatctttttagcccggtttgcaacccctttattcccaggtagcaaaccggggctacgaatgcgggactaaaaatcgctatatttagtctcggtttaaatacccggaactaaagatcacatggtcccgttgcacttataaatcgggattaaaggtgtcttttagtcctggttttttaaagaaccggggctattgtggaatttggtcaacccgtaaaaaatggtttctccagtaatgcgtcttttatgtaaatatgcaccttgatttattgttatacacaatttaaatagaatatatatgtaattcaattcaattcaaagtgtaatatccgaactgagaaagacatcagtttacaaaatctactccatgaaaaatattaacaaaaggtaatgcacccagactcaccatcatcgagaaactccgctatccctgtaactttttcgtgtgaactccacttgtaacaatgctccatattttctcccatcatcactatcatcgtatcaagcgaaattggattcctccatcacttgcatattctaaactcctcgaagactaggttcaccttcatttttattgttgggtttaatcccatatcggtaattaatgatggaggagcacgacataaaaggtgggagcattccgtatccataagattagtcttttggataacataggcccaagatctaaagttatgcttccgattaatcatgtagtagagtaggcccaatatgacctaggtgacccacggttggtgggctatactgcgcactctagcaagtggtatcatagcctaggtttgaaaacccagaataattttcatgggtcacacagtagggagccccggtaataagtctttgggttcacatgggttgatgtgatgggaagattgttggacccgatgtgtgacgagagagattgttgggtttagtttcacatcaataattgataacggggtagcacaacttaaaaggtggggcacacatcacccatcagactaatcttttgaattgtgtaggctcaaagacctaaacctaaagttgtagctctaattcgacctgtggtttggaaacccagaataactttcatggttctcatggtgggggtgccccagtaacaagtattcgggtcacatagattgatatgacggagaagattattgggcctgatttgtgacatgtggagacagttcttacatatcagactaactagttttttgggtcatgtaggttcaagattaaagctgtggctccgattaagccatggtggagcagacctaatatgacataatgacccacagttaggggttatgctacacgcttaaaagaagagaatatacctcagaatttattgcagattgaatatatatatagtctaaaattcatgtatacttcattaatacaagggcaaggtaaatatgaatgcacttaaatcgcagcatcaccaacagtcatcatatttcattcccaaaacggattttgaggggtttttttttacaaatcagatccaacatattcccaaaagccttacattagttttggagttcccatctccatatatttcattatgtagatttgagggtgagagagcgactcccaatctctcgttcgcgtgtttctctctccttccctgcgcttctcctctccttcccgcgcgagcggcgaaatttctattgggagcatgcgtgtcatcgtgatctctttctgtacgcgtgaatggaaaaaaagggaaattcctgttggtagtttaacagaagggtccacttttaatttttgggaattaatttaggctatctcttggaggaaggagttttttcacttcctatttacagtttaggaaaccaaaaaatcaaattttggtagtttaacataagggtccacttttttttattgaatttaggctatcccttgaaagaaagagttttttcacttttttattttcagtttagaaaacccaaaatcaaattttgggaatggattattgctaacctgtgggtgatgctcttattagttatcgtcggaggatattcgtgtttgtggatgccggccggattgatttctattattgagaaaaaaagctgtttacatctagctcattgatcacacgcgggatatatataaaataatccaaacattcttgtttcatgcaaatctgaatgtatttatattttgaattaaggatcatttgcatgaacactttcccgcgccaagcgtctcgcatctccggtatgtgatgagttttatttgatcctaccaccacaaacggcgcagaaagcaactggttctagtataagattaaacttgcatatattgcgattgagcaagatcttaaaattaaattaaagctgcactgaaacacaattttaaattcgcggaaggcttttctgattgatcatacgtacgacacacatctggacgaatgaaaaagaatatcagccaaacatatcttttcagatatatattttcgtactttgatatatactcctattttttaggttattttcgtactttgatattagtttcatggaccgctcttttaccctgtggtccatgaactaacacttaatgatctagaagacaattttaaaggagaatattacttttggaatcgaatccattcgatggataccccaaattttgaccagtgatcgaaaaggtaataaaagaaagataaaatccaatctcctactttgggccgcttgagcaaaaagaaaatttggattccagagaaaagctaatagcggccggtgaagaacatatattattatcattattattacgcccacagatgctagagcccagccttgccctgcctgtctgcttcgagtttagagctcttctatttcttcacgttcttcgttgcaaccattcgttcgtctcccgcatcgtgggtatattttagccgtaaaacagcccatgatagagttcatgatctttggaccaccttaaaccacttctttacaacattaacaattttgagcatatcgactctagtacgctgatgagctctcttacatagttacatatacacaaaccctaatttacattattacatatacgcagaaagttgcatatgcacataccctaatttgcatatgcagaaagttgaacatggagaagaagaaaacgtggtcctaaatagaatgtattccctcaaatttacagatgtgcacgcgcgttgaacaaagcaaatgttgatgaaaaattatactagtatatcattctggccccaaattaccatggtccttctctagggttgacgtgatataccacaacgtggcatattcatcaatcctataccgactaacaagtggagcccacttaaaaaattttcttttcctccttttccttttccattttcttttctcttcttccttcgagtgttagtgtagaattagtgatgatgccatgtcatcgccacgtagaatctcaaagggtcatggcaattcagctaaagggtcacatattctgacaatttgtgagatttgaatctctgtattttttatagttctaggacctagatgggataatcatgtaaggatagggagcaaccatctactttataggctattatgataaaccaattagaactgaaaatgtacttgaataatatacactttccaagcaacaatgtaaagtccgcagatgcacataaactaagatatattggatctaagaaaatgatataggaccatacactgctcctacaagaaagacatactacaatttatttacttcaacatcattaaattaagggaatgaagtagtagaaaatattgaagaaaaggtagacgcatgaggggatgaggagggggaggagaggggaggggggcggagaagtagatgtggggggggtgagagaatgagggaaggaggaggagaagagataaggttgatgagaggagataaggagatgagatgagaggaagagataaggatgagatcgggggcagtaaatccaattttttttagcgcgcggttgctgattttttttcccgattgtttaacaactgggactaaaaatagttctttagtagatagtagaggggtctgacaccgtctgccttttttgacccaagactaaaaatgatatttagtcccgtttggtaagtgtttttaggtttttgaaccgggacaagatatattctttagtcccggtacctatttaaaccaggattattgtggtttttggccaacccagcaaagatgtttctccagtagtgccatgacaattgatttttgttgcacgatgagcacagtaataactacttccccagcaaacctaggaaaatagttatactcctccaacctaaaataagtgaccactttgcatttaaaatttatcccaaaataagtgccacttcataagtattactcctatttgtttcattaatcacatctaattcaaatttcttcctatcttatcactctcactaccctccctatcacaaacatcactcatttaagagtaataaggagcatctatgtcatttactgtaacaccccgattttcgttcgggattaaaaatcactaaataatgcatttctagaaattatattaaaagttaaagcaatttaaccaagtgatctatcgggggaattaaaattttcatttaaaaatcatggccgagaatattttgtaatattctttgtgccctaaaatactctctgaaatttcccgtgaattttcggagctcaagaaacaattttaaagtcacaaagttcattaaactcatttaaataaaaagaaaacaaataaaattcccccttctccctttgggctgctttcggccgaatccccctccttcctccgttcccctcaagctaggccacccacccccccccctctcctctttgggccgctcagcccacttgctcccctttccctccagagtccactcaacccccacggccctctctctcagcaccatctcctacctccgggcgccccccaaccgccgccatgctgccccaggacgccgtcgattccgcgtcaccccgtcacccctgttcgcgcccaagtggtggaaccgcattcccaccacctcctccaccccttcccccacttttcccccaaatttcggtgccggtttgcccccaccacgcgcccacgttgccaccccacctcgccggctgttgccaccacgcccagccatggtctccactccccgagcactataaaatgatccccacacctccatctctctttttccccattcgcccgagctcccctcgcgctctctcgtgctccccgcgtcgttccccgcctccgctgctctccagtgagcttcgaccgcgcgccaccaccactcccgccggcactgcacttcgccgcttgcgccaccggcttcgccacgccatgctgcataccggcctccactccatttccctcctccaccaccggcaccaccattccaccaccacacccgagccgccaccacctttaccgcctccgaccgccgcttctcgccgccctagttgaccccgcattccgtcgtctccttccccgacaccacagccgtcgtccgcagcccggccacccctcctcctcctccaatcctcgccggaacccagtttccttcgcacgtctgtaagctccatcgtttcctccccctccgaccagcgtttctcatcgcgccgcaactcccttccctctcctaatagctccattatctcccttaggtccctccgaccgtcggccgccgtttcccgctcgcggaacaccgctggaccgccgttgtcgtgcctccccgaggagcccgctgccgctttcctgtcgccttctcgccgttacacgagcacggtgaggactccctcccctacctcacccccattcaaccccttcaccggccgcctcccgggcttgctcgtgacgcgccgccgtcgccggtggtcgtccggccgagtcgccgccgccgcgcgccgctgccggttgtgccagacagccggctgccgccttccctgccgcgcggccgatctgggctgtcggatcggccccagtctctatccgggccgcccgcgtggccttccggtgccgcccagtgtggatgccaccgtggcgccacgtcggtgccacttcgccctccccgtccgtcatggctgccacgtggtgcgcctgtgggcagtgcacgggtagactcgctccaccgtgcgccctcctctcgtgagtcaccgacaagtagggcctacttgtcagcgccacctctccccctcggttgatgccaaaaataattaataattacgcaataaatcaataataattctagaaatccatttaaatggctcaaaacttctaaaattcatatctaattcatacaaactccaaattggaccattcaacttgcaaaattcatctaaaattgagctctacatgtttgtttaatttttatgtactgtttatttggtttttattagtttttgcctcattttgagtgccagcgtgtagaatccgtcgtttcggaagtccgtggtcgcgaggaaaagaatttagaagatccaagtgaagaagcaaggcaagtcacacattccccttgggcattttgagcctaatttacaaatgttttatcgtttgcaaataaaattgcatgttttgctaattacatgggatcaggggggtattacctatctgctcgcttgtgccatgtttacttgagtatgtcctttgtcaaccgtgggtgataaattgcctagcttgtattacctatgttgacccagctagaactatatgcttagccatgcttaattaccactgctgctttgaaactggttgctgagttgtattccttgaagacgcaactggcacaacatttgctcatgtgatgatgatgttgttgacttgaccttgtgtctgctgaagcttcggcttcgaacactttcttgcaaagtgacctggctcataacagttgaaacatacccgttgctcccttctattgttgtcttctcgagactaatcctgctgatctggcactgattgaatagcttgctcaatgttaacttcattgcttgcattagtctctgagttgatctcaccactggtgttgaactgttgcgactgatcttgagatgtcgaagccgattcaacattttggagtggcttcatacactgcctctggctactatcctgtgcctccttgaaaacaatcattcttttcttacggttgtccatcttgttcttcttatcttccagtcgaattgctttgtcaaccagctcctgaaaatcagcatagtcatgagagattaacataattggcagctcaacctttaggccttccaagaacttctcctgcctttcttcgtcagtacgcccatcttctggagcataacgagctagacggctgaattcatgaaggtactctgtcacggtacgatccttttgcttaagtgtcctgaactcacgcttcttcaaagcaaccactcctgcaggtatgtgtgttttcttgaatgcttcagtgaactcgacccaagtgattggttgtccttctgctctgttcatccggaagtgatcccaccattctgaagcaggtccttgaaactgatgtgaagcgaacacgactttctcctaattagtgcattggagcagttccaacttcttctcgacagtgtgcagccagtcacctgcttccactgggttagtagtgctagaaaaagttggaggcttcacacgaagaaaataagctagcttgttctgcagcggtggaggaggtggcggtggagcattggcattgttgttcccttgttagttctgcacttgttgcactaacaggttgatcagttgggtttgttgagccagcacttgagcaagggttgggttatcttcattgttattgtttccacttccactggcacgagggttcaccatctgttgcaaattagagaagatagaaggagagtggttatactaaagacaaagacgttaaccaggttgccattgatctagtgtgtgttgtaacgccccgattttcgttcgggttttaaaatcatttaataatgcatttcaagaaattatattaaaagttaaagcaatttattcgagtgaattaatgggagaattaaaattttcccttaaaaatcattggccgggaatattttgcaatattcttttgccctaaaatactctctgaaatttcctgtgaattttcggagctcaagaaataattttaatagcacaaagttcatttaatcaattaaaaaaaagaaaacaaataaaatcccctcccctcccttttgggcttggcccaagccttcccctccactctcgtgggccgcgcgcctcctccctctctcggccggcccgcgccttgcgaaagtctactttacgtcccccggtttccctcctctctctccatccggccgacaggtgggaccgtgggccccacctgtcagctcctcctcctacctctcgccggccaaccccaaccgccattgccgcccacgtcgccgcaaaatccggcgccctcccgcacccgagctcgcatccaacgacgtgggcacgatcccctccacgtcctccaccattttccccgctcgtcccacaaaaaccggcgccgaccgagccaccaccaccccccatcggcgccccacttccccgctggttgccgcccctctcggccccgtttatgccgctccgaccctataaaaacgaaccccggagcatcctctctcttttcccctcctcacccgagccagccgcgctctctatccccctccccacgccgctcccgcgcaccccgtttccggcgagctctgccgcccgccaccgctgctccacccaccgccgcgccaatccgccaccaccgtcgaattcgcggcgccgtgccgcagcccggcctctactctattt

SEQ ID NO: 18810 - DNA, 10051 bp, Oryza sativa
  unsure (1)..(10051): unsure at all n locations
accacctccccaccacaccaccctaccggccattttttttccgtctccggtcgccgttcgccatcaccccggctgccgccgcgtcccgctcttccccgtccgccgcccggtcgccgccttccgccgccgggagcccctcctcattgtcaacctatggagcgccgccgcctccctccgccggctgctctcgccatcgccgtgcccctcggtgagctccgccacctccctctccctcactgcccccgtttcctctcgccgcttcccgcgctgcgtgccgccgctccctgcgccgcccggcccgtgtgccgccgtcgctttggtcccggccgccgccgccgccagccttgtgtgcgcgctggccaggccgcgccgcccggccgtccccagccgtccgatcggccttggccgatctggaccgtcgggtgcgcggccgcgtggccgatcgccaccgtggactcggtccacggtgggccgtgccgctgacgtgtggggcccgccccctttgtggacgtgatccgcgcctcaccccttgctgacgtcagcgaggtccatttcctttgtaaaaataaataataattgcgcaataaatcgagtttaattctagaaattcatttaaatggcttaaaacttctaaaattcatacctaattcattcgaactccgaattgagccattcaacttgcaaaattcatctaaaattgagctctacatgtttgtttagtttttatgtattgttttcttggtttttattagagtttttcctcattttgcgcgccagcatgtagaatccgtcgtttcggaagtccgcggtcgcgaggaaaagagttcggaagatcgttttgaagaagcaaggcaagtcacacattccccttgagcatgttgatcccaatttacaaatgttttactgtttgcaaataaatatgcatgttttgctaattacatggggtcagggttttacctatctgctcgcttgtgccatgtttacttgatatctgtcctttgtcaagtttgggtaataaatcgactagctcatgttacttatgtgacctagctagaactgtatgcttagccatgcttaattaccactagctcagttgatgggataattacagtattagacctttttagtatcagaatgagctgcgtgctcgagacatctggccatgctttatggtcgtaattatccaaataaaaggcaactgaatggtgggctgtgggtgcgtggttttgctagtcgcacccatggcaattaaggaccggttcgcggatgccctggaagaacttatcgtacttaccacaagccagcgtgggcaacggctgggcttatagtgtagcttttctctagccgacgtacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagaggggggtatgtgaagggtcctgtcacggcctctttccggtatgtcatggtggcatgtcggcgtacggaaacgtgtcgtggggctgtatcttgtgggtacagttgtacacctctgatcagagtaaaactattcgaatagccgtgcccgcggttatgggcggtcgaccagattcaccgtgattagtctcacacttaataaatcgacccaatacactgtagttcaggtgggttggttgggcctgttcaacgtagtgtagcgttgatcagtggagatttaatgttactttaattactcaacagttttactgtttttctcaataaaatgttttacaaccgcctttatgcaaatagccacaaaccatccttgtatccccttgcacgtctgcatcgttggtgtggcttgctaagtacggtggttgtactcagccttgctattattcccccttttcagaagtgtagtgcttctgaactgaagacgaagttagaagaccaaggctcagaccccagttgagttttgcctatggagtggagctgaagccctctaggatcgcctttttccgctgctgctgcttttgtttcggtgtgaggactaagtgccgatcttctgtaagtattttacgctttatttacgtttggaactgtatattacttgtcgttttgtgtaccttggctggtcctggacagggatttaatacacaaaatagtctggaaatttgggctaaatttctgggcgtgacatgtgtagaccattatattgtttaagttgattaaacaagcaacctagtatagttacacgctcatcactgaactacatcaatgatggaaatgcaaccatacctacacacaagcaagcaacaaacattctaccctactaactattctgcaaagtcccttggtggtttaggttctagggtcagatccaaacttcatcccatcacaaaaacttggcacttcaattcaaccatcatcttcttattccttgatccacttgacttccataagtagaccacatcgacgtcttcgagtttctccatcaagtttaacaactactcaagttgaaggaggaaaggggagagaataaaatgatttccaaagaattctagagaaggaagaaaggaaaattttcacaaataatgtttttcgaaaatttgtccttaaggtttgaccatttagcttatcctgcagtcaagatggctcttataccaacttgtcacgcccagaaattcacaaataatttccgaacttgtttatgcataaaaccctcatccaggaatcagccgaggtacacaaactgacaatttaatatacaaatccatcataataataacgttacatacttacaaaagaaaagaaaaacagcagcggaattacggtctagcgaagctccggctacactcccacaggcagctcaactagggtataagtcaaccgtcttctccttatggatcctttttcttcaactgaggtttgattgattattgcaaggtgagtacatggaatacttcgcaaaccacacagcaaatatgcaagtgtacaaggataccaaaggatggcataatataggctcatttgcaaaagcagcatttagcaaacatttaagagtagtaaaacagtagagtaattaatcatcaatattaatcaacactgaacagcaccccaatgctgcacagccccaaccaaacctgaacaaccaaccccggtcgtacatatcaaacccccaaaccaggaatttgtcattccaaactaggagtcaaattaattgtcacattattatcattaatgagtagcgtgagactaatcacgaaaaacattgctcaacccgcctatgaccgcgggcatggctattcgaatagttttactctggccagaggtgtacaaatttacccacaagacacaactccacaatatgtcaccatatcaccatgtgcccatgctgaacatgtcaccatttgtgtagttgtgacaagacccctcgcataactcaactaaaagcggcgcacctttcctggattgtagtcaccccctcaaaaaccagaggtatggactccccagcgacccccacggacttctcaccgcttcacagtctggctccccacaatgagccttgctacacaaagtatccagccgttgcccatgctgacttgtggttagtacggttaatatctcacaacagtagctcatgaaccgatccttaattgtcatgagcacaacaatccaaacttccaaccgtgtgctcacaacccaccattaatcaagttttagttgactattaattatccaatcacgattgaccatcgtgagctaccattaaatatccatctttaggtaatagtgaaacattaatcatcccaattgtgtgctagtgtttctaagcatggctaagcaattatattaatatctagtcaaaccaatacttgctcaactagtcaaatcataataacccaaggtatcaaggaatagagtaatcaatgcaaattggccataacaaaggtataagttcacaccacccgatggcattcgaaaataaatgcacagttgaaataaatagagaatttaaatataggatcaacatgctcaaagggattgtgtttgggatctgtgtgacttgccttgcaataatcggtcttcaattaatcttctggaacacttccaacacacacacgtacccccgaaacgatggaaacgagaaactaaaacgcaaaacaaagaaaaagactaataagaaccaaataaacagtacataaaaagtgatcatgattttatatgaatttggaggcttgaacggcctcattccgacttcatatgatttagttatgaatttcacgagattaattccaagaaaactcctgaaaatacttgaacactataagtatttaaaaaaattataagcagaccatttaatgattaacttattgtttaaataattgctaaaatgttctttgtattattaaaattagtaattgagctctgaaaaatccgagaaaatttcagagagtataattaaccatagagaatttaataaaaaattaaatcgagccatgctttatatttaggaaattttatttcccacatttaacttcacttgtaaattaatgaacatttaatataaattataatgataatttattaaataatttataaatcctgaaacgaaaaatcaggctatgacattcgcctaggcacgagggaggctgcccgctgcctgttgaggagtgggagcgaaacctgaggtgtggtgtacttggtcagggggagttatatgaagggtcttgtcacaatcactcgacatggtgacgtgtcaggcctgatgcggtgacatgccggtggattgtgtcttatgggtacagttgtgcacctttggctagagtaaaactattcgaatagccgtgcctgcgattatgggcgatcgatcaaaatcaccgtgattagtctcacccctaataaatcgactcaatgcaatgcactggatagttcaggtgggatggttgagcctgttcaacatggtgtagcgttgattagtggagatttaatattaccttaattactcaacagttttactgttttgctcaataaaatgctttacagctgcctttatgcaaatagccacaagtcgtccttgtatccccttgtacatttgcatcattggtatggcttgctgagtacagtggttgtactcagccttgctattattttccctttttcagaagtgtagtgcttctgagctgaaaacgaagttagaggactaaagctcagacctcagttgagttttgctcgtggagacgaagttagaggaccaaggctcagaccccagttaagttttgcttgtggagtggagctaaagccccactaggatcgcctttttccgctgctactgctttcgtttcggtgtgaggactaattatttcttctgtaagtatttacgttttatttacatttggatctgtatattaatttattgttttgtgtaccctggctgatttctggacagggatttaatatacaaaatagtctggaaatttgggctaaatttctgggcgtaacatttaccttccctcataatttagcacgtatataagtggtaaatttttcatttattttgagatggaggaaatatttaactgaaaaaaaaagatagtaaatcagtaagattgcaatactaatccaggatacgagttcgcacgttgcacaaaagtgccaaaaaatgatgctgagcatactcgaaataaaggtcaaatgaacatctccatcgcaaagataaacataaaaacattacttactgaattaataaaagcagtatttggtgtgtattaaccgtgtcttcatgaagacatttgaatcgcagcaacataaaaaatcaattttgaacttagtatcaatcatattgtgaaaccattagcaaccatgtagcacatcatggtaacaatcaggaaggtttcaaatcgaggattttgctctctggtgaagaataggaaggcactggtatgaagcaaaggaacatgaatgctcctggcagcctcagattagactctgaagctgacaaaatagatggcgcagaaaaatcatgtatccgcatcaggccaaaaaaatattacagcaatcatgaaaccaacaatctgcaaaatgtaaaaaatacagtttaataagttatctggccaagcgattcgtgtaaataagatgatatttcacataacaataccatcctcaaatccaaattgagcaataaggatacggcctataattatgatgcatgcacaacaagattatctgtgacgagtacagggtacagcaaaaaggatctgcttcctgcagcactaagtgaaacatgaagaatcacttcgtacgagcaatgcaggaatcagcatacaataataggaagacaccttatatagtaagtatacagttgagaaattagtattttagtttttctagcagtagataaaaaaatttcatggatagtttagtgacacttgtaaaatggataccgtgcaaatggacaccccaaatttcttaaattctgaattttggagagaagcttattatgtgtcggctgatatgttcacagctggtggactttagtgactttagtaactggcaacaataattgggttaccaatactgcaagcaccaaacatgaagaatggtagcttagaaactaggtgagtgcattgaaaactacatagtgagaccgtcagcaactcaagcaggacaacttgttggtacacgtgggagtgggagcagcatatgctgctgggaggtggctatggcaggtggtacatccgtgcatggcagataataaagtcataatatgctgggattaaaacagtatgcaaaatatcaagatgacaatttataagttacaaaaagagaagctgggataataaatggctaatgccttacgtgttagtacaagaaattagggtgttccataatttatattttgcagtctaactactcattagtcactactaatattacattcatgtcaaaaacataatatcacagcagataaacttaccaggacaagcacagtagttctttcaatcccttgatgtcgaatcccaaaaggcaggcgatgagtcaaccactagagtcttgaagtaactatttggaataatgtgcagacctgatacagggtcccaagccaaagcaacacgtgctaagcaccgcaatttacaaatttctacattatgcataccaacaaaccaaaaaattactccttccatcccaaaatgtatgacgccgttgatttttttataacatttgaccattcatcttattaaaaaatttagtataaatatgtaaaagtataaatcaagattatagtttcttttatgataaaacaagtcacaacaaaataaatgatatttatataattttttaataagacaaatggtcaaacggcatatgaaatgtcaacggcgtgatacagcgatggagggaatataatgtattaaccgcacagaagctagagaaggttcctcaaacaaactctatgaattactgccttagtggtagtatggtacaagtatataaactgatgtatggtaaacaccttacatcaggatagaatgtagagtctgttatttgtcattattactgccaccaaatcaccatcaaaatactaggataacagtacaaaaggtgtttctatcaagaatctcggtatatgcttacttagaaatggttcactatctttctcggcatatcccctcgagggatgaaaacattttcccttctcagcattcaaattggtcaccagtggttttactccacatccagcagttcagagaaaacgacaagtttaaagccagcaggtgaacctccttcaaaaatattatttcctaagataaagaaatttaagttaaaacacgttccatatcatacagttgacaaatatcataatccatatttttgcaagcaattattacttacttcaggaatatagcttaatgacacaaacttcaatttgcaaggtgcttcaataaaactaaaaaagtgcacctcgaaggtgagattgaatattgcttggttgtatgggcattttgaaataaaaaagaaactgttgtttgactgtatcagagggccatgctgactttcttcagaagcaaactgtagaaagaacccagtaagtaaaagacaagaattggaacaggacaaagtacataacacaaaagatgtcatgggcctgagagtaacggattccctaggggatggccccctcgcggtaagtacgtagctttagttggatagtgtttgttaggatagagtagattagttggatagagttaattaggatgggattaggttatggagttcatctatataaggagggtcaggtcaggattcgatcaagattatcggagtacccatagcctgtctctccggcacggcgttgatctagactctgtcacgctgttgaggtccagggccattcctgttacttccttctattataatctaatatattccccttcacccccaaataatccctgcacgtgacaaaaggattgtacacaccttgaattacatcagagggatgtttggctctatcttcccatcctggaccatcgaggcaaagagaatcaactcgagatatgaagagacataaacaagtgattacaaatttaccttatgttgaattagcaataaatgccatattacagaatctatgaatgatatagttttaaattatttaaggagacagagcaaagaggctcacctggacagaagaaaccagggtcaacctcacaattacctccaagatcaatgccactgccaccagaaatcttcttatcaaatctgactcccaactttcaaggattcattttcttcaaaaggaagcctcacttcacttgtgaactataatctggaactctgcagattgtatcatttggaagaaaccactcagaggatgcagatgatgacaccaaaagattgttttaataaaaggaaaaagacccagaggtgattgcaagtaaaagatgcaaatggtaacattaagaggttgtttgtaaaaagaaggcatagaaacagataattcataaataaaatacatatagttcagaaaacctgcacaccatcacatgtcagattgacaatcagaaattcaaaccaatcagggcagtttgttcagtaagaaaatctacaccatcagacaatcgttatagaacctaagtacaatactagtatatacaataagtttgagaaaatatcacatgccatgttcataagaaaatggagctagttattaccatgattactagatgagatctgctttcttggatgtgtttggaatacaaaaatcctacaagaattaaaaatatgacatcctgtctggtgtgtacaaattcctacgatattcttaagagactcatgcgttccaaacagtgacatcagttgaatatttttgaaagtaagcttatgtctatgccagacataacttactgcgatgcaaatgttttccagattggcattacagtagtaatttgtctctcaaaattcctcacccttggtactatcataccacaaaatgtacttttaacttttaagtgaacacagagatgaaaactgcttcacatattgaggtacatgaatttaagaattcaacaaataacattagaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18811 - DNA, 1012 bp, Oryza sativa
tttttatttattctcaatacatatatactatcatattttcaagaactctaatgtaatgattagttaaaaataaatttattttgggataaatgggagaggcttatcatactttcacatgatgtaatgattactttaaaaataaatttattttgggataaatagaaaagtctaaaactgaatttattataggacggaaggaataatatttcctcccataaaaatcttgtctctgaaataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttggaagccggcgtccaaggcactctgaacgttctgaggtcgtgcgtgaaagccggcacggttaagcgcgtgatcctcacatcgtcggcggccgccgtctccggccagccgctgcaaggagacggcaacggcagcagccatgtcctggacgagtcgtcctggtccgacctcgactacctcagatcaaccaacgggatatctcctgctcaggtacacacaaacttacaaaattttacatgttcagtcagagttgatagtacagtcgcttgcgtgagagcacagcggtggtgtttgcgctgcaggcttacgcgatcgccaaggttctctcggagaaggaagcgagcaagctggcggaggagaacggcatcaggatctctagagtcggtgtgcccggtcgccaccgtcggcgcgtcgccggcgccggtggccaacgagagcgtcgccaacgtcctctccttgctgtccggtgagtacgtaagcaccggcagtattgtttggagatcatggatggaaactctttccctccgcacggaaa

SEQ ID NO: 18812 - DNA, 597 bp, Oryza sativa
ccaatacaagttcaaaatcagcttacataagtagaaatgaaaacgacaaatttgactcaaataaaacgtgtaatttgcaaccaaatttgttatttttgttctaataattgtataagttgaaatttgaatatatctctggattggtatatatcttattatttttctagaatcttttttatcacaaagtaggactttctttctgttgttcatgacgacaattcagaaaatatgctactgcggaccaaagattccacccctgaatctgaaaggaaggaaaactttaactgtgcttagttcacgtcaaaattggaggtttgcttgaaattagaatatggaaaagttggaagtttgtgtgtagaaaagttttgatgtgatggaaaagttggaagtttgataaaaatgtttggaacttaacaagggctgaatacgtatgaacagaagattaaaacgggaaataataccacctgggtttctgaccgtcgtgttgacagcatatcccttctgaagcagcatcttgatgagcgccgaagcgatatacccgttcccgccggtcacgcacgccgtcttcatctcaaccgctgacatctcgtcgggagg

SEQ ID NO: 18813 - DNA, 464 bp, Oryza sativa
  unsure (1)..(464): unsure at all n locations
nnnnnnnnnnnnnnnnnnnnnnnnnnnnnnnnnnnnnnnnnnnnnnnnnnnnnnnnnnnntgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctggg

SEQ ID NO: 18814 - DNA, 1087 bp, Oryza sativa
  unsure (1)..(1087): unsure at all n locations
nnnnnnnnnnnnnnnnnnnnnnnnnnnnnnnnnnnnnnnnnnnnnnnatcgcttctgcgctcatcaagatgctgttggagaagggatatgctgtcaacacgacggtcagaaaccccggtaagattctcctccttttttcactctctagttcgtgttttttactttttttgcagtgtttcttccattcatatgatcatatcctcggcctgctagtaccatatgagctaattagcgagtgttttcgcttaaccactcattagcaaatggcaggcttagccgcacatgtggacaatatcatatctttcgaaagggagaagttgtcaaatcttatccttttccaacttccaaccgatagttacatatatatatcgtgacatatgatggatcaaaatatgatgcgactttatcaatacgatggtgtgaattttcagagtttcagtttcatctctgaagattccactaattgctgcggtttgtattcagatgacatggcgaagaactcccacctcaaggacttgcaggcacttggccccttgaaggtcttccgcgccgacatggacgaagaaggaagcttcgacgatgccatcgccggctgcgactacgccttcctcgtcgccgctccgatgaacttcaattcagagaatcctgaggtgaacagctaattaacatcactattgactctgatactctgtaactgatgtgctctactaatcttgatttcctttttttttttttttttttgcgatgttgatggtggtggcagaaagatctggttgaagccgccgtcaatggaacgctcaacgcgatgagatcgtgcgcgaaagtagggacggtgaagcgcgtgatcataacatcgtcggacgcagcgatctccagaaggccgctgcaaggcgacgggtatgtgctggacgaggagtcctggtctgacgtcgactacctgagaacagagaagccgccagcctgggtgacgttcctctctcttgacattttcacatctccatcttatccataaattcaagaaaacttttaccgtacaatatatactaaaaatatgccactactaagatgggctgccagacaaacaatt

SEQ ID NO: 18815 - DNA, 14952 bp, Oryza sativa
ttccttgtgctttaatatattatagtataaaattaaagggggtaaaattgtctttccatactattggatgagggtaattatgtaaactcacaacttatagcgaaatactccctccgttaaaaaaaaatctcgtaacatcctagagtgtctagattcgttttactagaatagtaggatgtgtcataagaggttgagttatttaaggacagagggagtagagataggcattattttcaccaccatgagacactgcgctgttgcaaactagaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacagtgtgtccaaggtgcttttggagaaggccgcatgcaagttcgcggaggagaacaacatgagcctcgtcaccgtgttcccggtgttcaccttgggcgcagcgccggcgccggtggcgaggacgagcgtccccggcatcctctccttgctatccggtgagctagaagcaccagcaacagcaatcaaatcacaagctagctcccacaaagggcctgtttggggggagcttctagctgctgcagtatattctagaattagaagttgctctaaacagttcagcttttgatttagattataagaagatataattgtaaatccaaaaaatgaagctgggaaacacaatttttccagattgtaatcttaaaactccaaacagaccccaagtctcaacactctttgcaacgcgtgttacacagtttaagttggctgctgtttttttactactacttctcaggtgatgagacgcatctcgaagtcctgaagcccctgcagtgggtcaccggctccgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttgaccaacttggaaatccaaaatagataaatattgttgtgttcgatctgacgagcgagtgatcgtctctgtatctttgcagcttcgacgggatgcttgagaaaccgagagtctgctgttcgtcggagaagctgatcagggaagggttcgagttcaagtacacgaatatgggcgacatactcgatgaccttgtagagtacggcagggccctgggaattctaccacattgaacgaatagctgatgctgctctaccttcaacctagctgtcacgaggaccgaactggagtatgcgcttgcgaaataagtgatcagtgtttttaaagaaaaaaaaatagtacagtgttttaagatgagcctaatacacagtggataatggcaatgaagtttaatacccttagagcatatccttcgttcttgcatgtcatttatatattttttataaaaaaatttaacaagaatcatttggttgatacgtaagaaattaggggatgtccattttgagggacctaaggctccgttcgttggtctgttagggatgccacttgtttttttagccgcttcataaactgttaaaagatgtatattatggacatgtttttaagtttctttaaaaaatctaataaaaccatttggcatatttatagtagttaatactacatccatttcatattataaatcattttgaactttttttgtcaaacattttcagtaaaaggtttgactaagtttatagaaaaaattagcaacatttacaacacaaaatttatttcattaaacactacattaaatatatttcattaaacacgaccgtgcctgggccgtgccgcccggatggccatctatacatccggtcatagatttggtttttatttgtagtactcgtcaacaactagcatgtgtcacattcgatacttggttgattttttatgagacgaaaggagtactcctcaatcagatatcaaccaaacaaccacccactttcatatcaactgaacagttctgtaaggacagttccgtaaatggtccatccttctttccatagatggtccaaccccgcacatagtgttgcatcctcgtcctaaaataatttgaaatgtttggatcagggactaaaactttaagccatgtcacatcggatgtttggacactaattagaagtaccagaacattagtgtgccggttggcacactttctttatagcccgatacattgtttagcgtgtgtttgaaacatgaaaattttgtaagatatttttagcatttcgttcaacttctatgttccattaaatattgtattctcttgcatatcgttctgagcataatctcctgtaatgttaatttgggattgtgtgttctctatgtttctggtggacgattaattatagatgttgagtttctaacaaatttttgatataattaaatactataaagtattaagaaagtagaaagtaggtggagttaaataatagaaggttctctgaaaaaaatattagaagattaatatttttttaaaaaaaggagtgattgtaataaaaaaaagttacagaaaatcgtaaacttacaaagcttgctctcaataatccataatactcttgatgtccacaaatattaggtggaaggatccaactcctaaatgctagaagtagaatttgaagttaagtagtggcctattgacggtctttgtgttcactccacccctcatttttctaggtcactatagtctgctccactctcttttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccagtaagctatttctctcaggaggacgtagtggagcctggaggggacgaagtagccggcggcacggcgatgtcagcggttgggatgaagacggcgtgcgtgaccggcgggaacgggtatatcgcttcggcgctcatcaagatgctgcttcagaagggatatgctgtcaacacgacagtcagaaaccctggtgagattcttcccccttttttgttgttcatgatttcagttacaggctgtgattagtttcatgccaaaattagaagttcaatgaaattagaacgatgtaatgaaaaagttagaaatttatgtatgtaggaaagttcgatgtgacgaaaaagttgaaagtttaaagaagaaaaatgaaatctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatccggttttctctaatcgacgtcacagttgacagttgtcttgtgtcatctgatgataagcatgctctttagtctctagtactgaaattaatttgctcttaacttctacgatgacaaattaagctgggtttcctgccaacgtttgatggcagaaagagatgattgaagccggcgtccaaggaaccctgaacgtgatgagatcgtgcctgagagccggcacggtgaagcgcgtgattctgacatcgtcggcggccgccgtcgccctccgtccgctgcaaggcggcgtcggccatgtcctggacgagtcgtcctggtccgacgtcgactacctgacgagagagaagccaccatcttgggtcacattctactcctttcttttttggtcctccatcaaatcattcatatacattttttaccgggctgatgaaaatgacggctggctgatgctagcacaccccattgtttttgcgtttgcgttttgcaggcgtatggtgtctcgaaggtgcttttggagaaggcggcgtgcaaattcgcggaggagaacgacatcagcctcatcaccgtgctcccggtgttcaccttgggcgcggcgccgacgccgttgaccacaacaagcatcccaactacgctctccttgctgtctggtgagagcctgagaaacatacgtcaaatttaagaagctactcttttatttgttcagattcaagatatatcacattttatatttgatttgtttattttagaattaagagagtatgtacttccattatgtgttacgattgacgttgtttctttttcaggtgatgaggcgcagctaaaaaccctgaaaggcctggcggccaccggctccattccggtggttcacgtggacgacgtctgccgcgccgagatattcctcgcggagaaggagtcggcgtcggggaggtacatctgcagcagcctcagcaccaccgtgatggcgctcgcacgtttcgcggcagcaaaataccctcagtacaacgtccaaaccgactggtacatatacacgaactggcactttcagtttcaactttcaagtgactgatcgatcgacacatgcatttcttgagagaacctgatgagccagcgataatctttgtttgctcgtagtttcgaagggttccctgagaagccgagagtgtgctattcgtcggagaagctgacgagggaagggttcgagttcaagtggacggatctggacgagatattcggcgacctcgtcgagtacggcaaggccctggggattctaccgcactgaattgatggttgctccgtcaatttggagttttggacataaaaattctcttgtgaaattgttagtcctcttgtcttgtgaaataagtcattgttgtgtgttacggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgagtaaggaaaaactaaatctacttgatcggctgtagatattaacgatatataattcttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgatggggtcgggctgcacccccctcggccccgagggccgaggcgccccgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggtcgagggcttctaggcgctcgtccccagctggagctagcgtgttacctcccagagatggcacgttagccctgatcagatatatgccaggcttcatcctaaccattacaggcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaaggcgcacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttcctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtgctcacatttctcgccggagcctcaaggccatgaagcgagagcttctggccgcggcccctactcatgaggcgacgcgccgggcgcggtggtcggaggttgccctaactttcgaccagaccgaccacccaccgtgcgttgcccggggagggcagattgcgatggtggtttctcccaccgtttgcaacgtgaagttggggcgtgtcctcattgatggaggagcagccctcaacatcctttccccgcagcctttgatgccatcaaggccccggggatgatgctccggccgtccagccaatcatcggtgtgacgccggggcacacttggccgttaggtcatatcgacttcccggtcaccttcggtggacccgccaatttccgcacggagcgagtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccagtcaaggaggttgtcctgggcgacggcccgtccaagaccacacggatcggtggtctcttggatggcaaataggaagacgcgctcgtctctttcctgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaggaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaggccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagacccgataccctcaggcccagaaaatgctttacgctgttctgatggcctcgaggaaactgcgccattatttccaggcgcatcgggtcactgtggttacgtcttaccccctcggtcaaatcttgcataatcgagagggtactggacgggtggtgaaatgggcaatcgaactttctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtgccagctggactggggatccccccgcctcctggtgttaggcgatttcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccaccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctgaggggggggtcgggtgtcaggtttcgggctcgggccaaccccgtaccccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaat

SEQ ID NO: 18816 - DNA, 637 bp, Oryza sativa
  unsure (1)..(637): unsure at all n locations
ctccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttnnnnnnnnnnnnnnnnnnnnnnnnnnnnnnnnnnnnnnnnnnnnnnnnnnnnnnn

SEQ ID NO: 18817 - DNA, 511 bp, Oryza sativa
  unsure (1)..(511): unsure at all n locations
gagctcggtaccctaagaaataaacaaagttaaaaaggtttataaaaagaaaaaccctaaaagaagtcttctttcccccccttcctctcttgggccggctcggcccacctcgctctttccctctctctcctccccgcggcccactcggcccctcccccgcgcgcgcgccgctgacaggcgggcccgcccgccaccctcgctgacgggtggggcccacctgtcatcgccttcctcgcgccgctcccgccgcccgcccgtgccctagcgccgccgccgccgcggattccgccgcatcccgccgtccccgcgcgcattaaagagggggaaatcactccccgtgattccctctccgtttccccccgcttttccctctctctctccctcggattcgctcggaatctttcccctaaacctcgccggcatcaatggcgcccgagatcgccgcggccgtttcctnnnnnnnnnnnnnnnnnnnnnnnnnnnnnnnnnnnnnnnnnnnnnnnnnnnnnnn

SEQ ID NO: 18818 - DNA, 768 bp, Oryza sativa
  unsure (1)..(768): unsure at all n locations
tgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtacctttgtaataatgtaaatattatcgatataataaagatgtgtcttttataccatgtttgtgtggtgtacccggcttttcctgggacggggattaatacactggtgttcgggaaaaggcaattttcccggtcgcgacaagatggtatcagagccatctcgactgtaggataagccaagtggataaaacctaaggacatattttataaataaaactatttgcgaaagttccttttttttctccttcccctaatgctatttgcaaaaggtttactcccttcttccttcttcggatttccactagtactagatggttagtttgcgaagaagaagatgtcgccaattgttcgccgaagctccggaagactgcaggatccgctagcgaagtggaggaagcagtgaagccagctgtgaagcagtgaagatcttggagaacccgtcgcagaacctaagccaccctgtagggtagtgttgttagtcgtgtgttccttgcttgtgtgtgcagcgcgtggtttgcatcggggggttgtgatgtaaccatgctaggttgtttgcttaatcaannnnnnnnnnnnnnnnnnnnnnnnnnnnnnnnnnnnnnnnnnnnnnnnnnnnnnn

SEQ ID NO: 18819 - DNA, 437 bp, Oryza sativa
ttcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacaacgcgaggtcgccgagctctttggcaacttccctccgccgc

SEQ ID NO: 18820 - DNA, 697 bp, Oryza sativa
caagtctctgatcgctgccaggccactgttgattagatatcaattatgtcacattaattactattccttcctccaaaataagtttgttttttacctatctcacacaaaccaatatttacctacaagcctataatatactcactttattaaatcccaatataattatttctatttttatttattctcaatacatatatactatcatattttcaagaactctaatgtaatgattagttaaaaataaatttattttgggataaatgggagaggcttatcatactttcacatgatgtaatgattactttaaaaataaatttattttgggataaatagaaaagtctaaaactgaatttattataggacggaaggaataatatttcctcccataaaaatcttgtctctgaaataataataataataataataataataataataataataataataataataataataataataataaacaactttattatgtacgtgtccaatccaatactatgttgttttattttgaaacgggagagtacttttacttgtatcgtcacgattaatttacttggtttgtctagtaaatcctctccataataaccagctgaaataacgatctagagtattatttggtaatggcagaaagaactgttggaagccggcgtcaaagcactcttgacgttctgaggtcgtgcgtgaa

SEQ ID NO: 18821 - DNA, 651 bp, Oryza sativa
tttgagggaaaaattacccacctctgccattatgaaaaaacggtccgatattcttttcctcgtctcctccttctcgcgagtcgggacttcatggggcgagcgtcggccatcgggcgcattgggtgtccgccatcggcgccgcccccgcccttccccaaccgacgccgcccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgccctttcccgaccgacgcctcctcctcccgacgccgccgccccttcgctcgtcggccatggaggtgggagacgaaggtggtgaggtggccgacagcggtggcgtcaccactgcctcatcttcctggcgccaccgctcctcaccaccgtgcgtcctcttcgtcgctgaaccgccgctaccgctccttctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaa

SEQ ID NO: 18822 - DNA, 704 bp, Oryza sativa
  unsure (1)..(704): unsure at all n locations
nnnnnnnnnnnnnnnnnnnnnnnnnnnnnnnnnnnnnnnnnnatcccccagatctaccggcgcccgccaactggaggcctgcgccgggggctggctcggaagtcggaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtctttctttttatctatatttaatgcttcatgcatatatccaaagattcgatataatgtttttgggaaaaaaacttggggaactaaagaggcccaagcgtgctgaaagctcgctgtgaacaaagccgcaaaagtgggagaaatcacagcagctgagctgtgcacgcagactgtagtagtagtagagcgctagactgaccactggtccctatttcctgacgcgtgggttcccccgttgcc

SEQ ID NO: 18823 - DNA, 907 bp, Oryza sativa
aaaatttcttctgtcagtaaaatagagaaattgtttttagtaagaagtgctagtatgctgaaacaattaccaatattgtattggcagtttctttcgtagcttgtcagcttcaacaatttgaaattctgcggatgccaaacgttcttccagatcttttattatcaccttttgttcttcatatcctgtcatcgcctcaattgcagtaacatcagcaagctgcaaaagtaaacaattagatcaaatgtcatataatcatatctcacatgtaaatcagcactgacaaaatattatttctaaccttcagtttatttgttgcaactgcaagttgtttctgcaaagtttgaatctgttcttgttgcatactacatgtttcctgagcagaagcataatggtgagccaaatagttgcgcacagaaagtattgatttggttaatctgaaaccactaacctcaaaggctgacacttttacactcaagctttcacagtcttttgtagacttgcctgctagttccttgtaattagcaagctcagcactcaaggtatttacttgagaaacagactgatcacggtcttctctaatttggtgtagctcaattctaaggcaatccacttctttcataagttgttctttcattctaatggcctcttgttgagaagtctaacagaaatcaaaacaattaaatgtttaagtgaaacaagaactatactgcccaaaaaaattatcaattcacgaaaaaacacaactcaccctagaagaatccaaatggttcttcattgaattgtttaaatctttcagagaagccattgtttccatcatggcactcttctctttttgcagttttgagatgatgtccccactcttagaggcatcagcttgaagattactgttgtattgctgcaagctggt

SEQ ID NO: 18824 - DNA, 582 bp, Oryza sativa
catggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaa

SEQ ID NO: 18825 - DNA, 984 bp, Oryza sativa
atttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgcttcccccgccggcgtcgcgcgtacgtaggagacgacacgacgacttctccgtgagatcgcgcgaaaatcacgacctcaaccgtgcgacggggggcgcaagcgcgacatcacgcagcgttttctccccacccacccgccacgcgcggcaccggcaagcggcgacgcgcgacggctgcgcggtcgttttcggcggcacgccctgcgcgcgcacataattcattctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcaccttcccgcgaccgatcgatccgtcaatcttccgctaccgtgtatacgcaacagtgtcggctgggacatgtacatacattatactaaaatacagtactacgagccgctttctgaaaagaaaacgaggccattattttcccctttgtcttctcttggattttctggtggaggacagacgtcgtcgccattggtctatggagtcatgtgcaaacat

SEQ ID NO: 18826 - DNA, 945 bp, Oryza sativa
cgccttcctggtcgccgctccgatgaacttcaatccagagaatcctgaggtgaacagctaattaacatcactattgactctgatactctgtaactgatgtgctctactaatcttgatttcctttttttttttttttttttgcgatgttgatggtggtggcagaaagatctggttgaagccgccgtcaatggaacgctcaacgcgatgagatcgtgcgcgaaagtagggacggtgaagcgcgtgatcataacatcgtcggacgcagcgatctccagaaggccgctgcaaggcgacgggtatgtgctggacgaggagtcctggtctgacgtcgactacctgagaacagagaagccgccagcctgggtgacgttcctctctcttgacattttcacatctccatcttatccataaattcaagaaaacttttaccgtacaatatatactaatatatgctactactagtatgtgctgccagtacaaacaattcaaagatttttatgaatatttccttgtgctttaatatattatagtataaaattaaagggggtaaaattgtctttccatactattggatgagggtaattatgtaaactcacaacttatagcgaaatactccctccgttaaaaaaaaatctcgtaacatcctagagtgtctagattcgttttactagaatagtaggatgtgtcataagaggttgagttatttaaggacagagggagtagagataggcattattttcaccaccatgagacactgcgcttgtgcaaactagaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacaaggtgttcaaggtgcttttgagaaagccg

SEQ ID NO: 18827 - DNA, 589 bp, Oryza sativa
  unsure (1)..(589): unsure at all n locations
ttgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccagctgatagttacatatatacatatcgtgacatatgatggatcgaattattatgagactttatatgatctcaaaaagatggtgtgaattttcagagttcagtttcacctctcaaagattctactaattnnnnnnnnnnnnnnnnnnnnnnnnnnnnnnnnnnnnnnnnnnnnnnnnnnnnnn

SEQ ID NO: 18828 - DNA, 1244 bp, Oryza sativa
  unsure (1)..(1244): unsure at all n locations
ttgctgcaaaaacatattgtttagcaatttgaaaagcatgcgcgagaaaaacgagagagaagattgagaaccctcagtagcaaacacgacctaagtgtgctagaataaactccttcttccaaaaacccaacctagtattagaatgtaatataatttagtataacgagagttttcatggtatggagggagtatctggttcggactcacgtgtccgattcgatttcaggcaacgaggagatcaacaccctgagaatgattgaccagtactccggcgggctgaagctggttcacgtcgacgacctctgccgcgccgagatattcctcgccgagaaagcgtcgccgtcgccgtcggggaggtacatctgctgcgccctcaacaccaccatgcggcagatcgcccgttccctggccgccaaatacccgcaccacaacgttgacatcgatgcgtaagacaaaatcatgaactggtctcaaagattatgcgtgtccactgcgagctgactccgacggtggcggcggaacatgcagactcggcggcggcctccctgagaagccgacgatcctcctctcgtcggagaagctgaccagtgaagggttcgagttcatgtacaagacggtggatgagatgtacgatgatgccttcgtggagtacggcatggcactcgggattctgcactactgacgccgacgacaatgctgttactacccagcttcgcaaccaaacggctcttgcaaaaataagtatgtgtaaaacagcagtgaatttgttcccatccgcttttatgaaaaacgtgcctattgacacgtcaaactgttcaataaaattgtgctcctttcaacattttctcaatttctacccctcaattttcacatgcacaattaccaaacgattaaacaatatgttttttacaagataaaagtatagaaaagttgttttaaaaaaccatatcaattcatttttcaagtttttcagttaaatagtatttaattaatcatgcgctaatccgtcactccgttttatgtgtcgggaggaaaggattcacaaccctcactaaagaacacaacctaattgtggctctatgattttcttttttgaaacaagcaagagatctgtcatttcattaagtagcaaagaaaatattctggtggaacaacgaagcctcacaaggtctttcaaggtccccagttnnnnnnnnnnnnnnnnnnnnnnnnnnnnnnnnnnnnnnnnnnnnnnnnnnnnnnnn

SEQ ID NO: 18829 - DNA, 958 bp, Oryza sativa
  unsure (1)..(958): unsure at all n locations
nnnnnnnnnnnnnnnnnnnnnnnnnnnnnnnnnnnnnnnnnnnnnnnnnnnnnnnatgctctgctttgactcgctgacaaacatcgcagagtgcgacgaattcggctatttctcttctcatgctggcccaccagaatttctctttgaggtcctggtacattttagtactgccgggatgaattgaatactgagtttgatgagcttctgtgagtatgagatccttcagttctttgtcgtcaggcacacacaatctttctcccaaccagattgtgccattctcatcctcatggaaatctcgagcttttccaaccctcatattctttttcagctcagctatttcaggatcatttacttgagctgctctgacttgatccacgagcgtaggccgggcctctagggcagctacgtacccgtgttctacgatgcccaaatttaggtgctcaagatcttgctgcaatttgtcacacatgacttcggtatatactgcattgcaatagctctttctgctcagagcatctgctaccacatttgctttgcctggatgatagtgtatccccatgtcataatctttaatcaactccagccatcttcgttgccggagatttaagtcgggctgggtgaagatgtacttcaggctcttatgatcagtgtaaacttcacagcggttgccaataagatagtgccgccagattttcagagcatgaaccactggtgccaactcaaggtcatgagtgggataattggtctcgtgtgggcgcaactgtcgcgaagcatatgcgaccactctgcctttttgcatcaacacacatcccaatccttggcgagatgcatcacagtagacctgggagtctttcgtctgatctggcagaattagaactggtgcggagactaacttcttcttgagttcttcaaaactttggttgcactcagctgaccatttgaatttttcatctttctt

SEQ ID NO: 18830 - DNA, 897 bp, Oryza sativa
  unsure (1)..(897): unsure at all n locations
nnnnnnnnnnnnnnnnnnnnnnnnnnnnnnnnnnnnnnnnnnnnnnnnnnnnnnnnnnaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagag

SEQ ID NO: 18831 - DNA, 3234 bp, Oryza sativa
cggtgtgactagctgagtacaatggatagaactcattcttgctctcttttccgcctctccacagttgaagtccttctcaggtgaagatgtctcgaagaggttggtttcgtcatcccgtcaaggatacctgtggaatggagtcggccgccctagaagtcaagtcgtcggccttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcccttattacacgaatacaaggcactgccttaaacaaaaagggaaggtgcttatcattggtacattgtatcctcaacatgaatcatccctaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacaaccccccgatgcaaaccacgcgctacacacacaagcaaggaacacacgactaacaacactaccctacagggtggcttaggttctgcgacgggttctccaagatcgtcactgcttcacagctggcttcactgcttcctccacttcgctagcggatcctgcagtcttccggagcttcggcgaacaattggcgacatcttcttcttcgcaaactaaccatctagtactagtggaaatccgaagaagga

SEQ ID NO: 18832 - DNA, 7755 bp, Oryza sativa
cagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctctcggcgcggacacattctagattgcggcgtgcctgctccgccagcgctgcctcacggagggacaggctgtccgtcaaccgttgcgccgcggcctcggcctcttcgagagctcgctcccgctcggtaagcgcgtcctcgcggaggcggagtgcagactcctcttcggcgcaggcagactcgtgcgccgccagcgttgcctcccggatggcgacggcggcctcgcggtccgccaggtccttctccacgacgcaggcgcgctcttccagcgccatggcacgcgcctcaagggcctcttcacgccgccggagcgccgtttcggtctccgttgctcgctgctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccaccttttgagcgatctccgccagcgccgtcttacgggcttcaagatctgagacgtgccggcggtgtgccttgcggcccgcttccaccatggcctccaccgatcgccgcccctcctcgacacgcgcccatgcggcgtcgagctccgcacgctccgcctgcagggcctccacctgggcacttaacccatccaacaccgcggtgtttgcggcggctaaggcctgcagaaggggctctgcgctcagcggggcgacggaaggcgtggggaagagctgccttggagaagatgtcgcgcggctcggcccgccaatggacgtgccggactcggggatgttccccggacctgtttggtcctgggcgtcgcccgaaggagtgggcccaggcgacgcgcccgcagcctcgtcgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcggcctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccacgatgagtgagagatgaacctgcgagggggtcggttgaacgaccactttggaggggagatgaggtttccccgagatggttctgtctcccccatcttgcggagccgtttcttcttgcgctccccctcgggctgtgatgttggcgcggccccctccgggcgcctgctgctggcacgcactgccccgccccctcggggaggagatgggggaggtgttcgtcccagcttcctcttcccccggtcgtcgatagggcggttgctccccgagcccctgacgcggggcccagaagcacgaccccctcctggggtagattgatcccccttgcggctcccgcctgcgccgtcgtggccctttggagctccctcctctgaggccccgactgccgtcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcgccatacaccatggcccctgtgagcccctgggatcgcaggcccgccaggcggtcgaggacagcgtcatagccatcccccagatctaccggcgcccgccaactggaggcctgcgccgggggctggctcggaagtcgaaggcgcgcttcgtcggcgaggggagtgtagaaccaatcgctcttccagtcgtcccacttcttgcggagggcgcaggggatgtagcggttcagcgccggcccccgtggctggaagtagcagccaccgactaccgatggcggcgacaccgactgcacggtaaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatagcggaaccagccctgccattgcaaaagggagaaagaagacggaccgccccgggtagtctgtgtcgcgaccgggaaaattgccttttcccgaacgccagtgtattaatccccgtcccaggaaaagccggggtacaccacacaaacatggtataaaagacacatctttattatatcgataatatttacattattacaaaggcacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgggattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctttcggtccacggtggaccgggtgcacgcggctgacggcggccggcgccgtgggtcccacgcgtcagccgcacccgcgggcgcgggcggctgacggccgggcccccacctggcagccgcggggcgcgcccgaaggcgggcttggcgggcacggcctacgggagacggcgcgcccgcgccccgatggtcacggccggccaccaccggcgcggcggaaccgcgccccagagagcggaaaagaaagggaagcgaaaggggcggtccacggttcaccccgggacgaacaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgaacggcgtaaacgtaggagagaggcacggggaacaattatatagcgccgggagggagagagagaggccggaggggaaggaaacggccgcggcgatctcgggcgccattgatgccggcgaggtttagggaaagattccgagcgaatccgagggagagagagagggaaaaacggggggaaacggagagggaatcacggggagtgatttccccctctttaatgcgcgcggggatggcgggatgcggcggaatccgcggcggcggcggcgctagggcacgggcggcggcgggaagcggcgcgaggaaggcgatgacaggtgggccccacccgtcagcgagggtggcgggcgggcccgcctgtcaccggcgtgcgcgcgggggaggggccgagtgggccgcggggaggagagagagggaaagagcgaggtgggccgagccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggttaggtgagcacagtggggct

SEQ ID NO: 18833 - DNA, 1661 bp, Oryza sativa
tccctagattcgtggaggctacaagaagataggttgggcggtcttctcttcttggtcgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaaatcctttttcttttttctttttctttttttttctctttttcctcctttctttcggatgggccgccggcccatctcctcctttcctccccctcctccctgctgggccggccgcaggccgaggcccagccggccgcccgcctccctccctcccggggtcgccgacaggtggggcccacctgtcggacccgtctcccacctcccgcctctcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagaggggcgggattcgattttgaatctccccccaccttctctctctcctcccccacgtcgccggcgaaatcggagcgcctcccggccacgtccgcctccccctccgcctataaaatgctccccatgccctcctctctcgtttttcgctctcaccgctccatcccgtgccccctaccgagctcgcaccgccgccacttacgccgccgcccgtcgccgcactccggccgtgtgccgccgtcgctagagccgccgccgcactaagccaccgccaccactagcttcgccgccg

SEQ ID NO: 18834 - DNA, 5630 bp, Oryza sativa
  unsure (1)..(5630): unsure at all n locations
ggcctggccggtacatcggctcggggagccggagccgtggggcccgcttgccagccgtgccccccccttgagccgctgccgagtgggcccgtgtaccagcgcccttcccctctctctccccgtgccgctgaccggtgggccccgcttgtcggcgccgcgccaccccgtgctgacgtcagccctggaatatattgcgcaataattaattaaggactttttctttattagtaaaaacacagtgaatcttctaaaattcataactaattcatccgagctccgtttaagtccattcaagtctcagtaaatcaagaaaaatgtgtagaatccattaaaaatggttttgtttcctgtttcagtagtcttatagcatgttttgcttgtgtgctttgtttgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtatccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgttttcttcctttctcttatttctacctatcccctccagatggtgaagacaaggaatgatccccgtgactccagcgacgccaggggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgcccctgaggacgtgcgcaccgatgctgagaagcaggagaagtttttgtttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgattacaacggtggcagtcacaacaacagtaagcagcgcaaccacaactcgactccacccccactaatggcaccagctcagtcagatccgccaactgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggggaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctatnnnnnnnnnnnnnnnnnnnnnnnnnnnnnnnnnnnnnnnnnnnnnnnnnnnnnnnnnnnnnnnnnnn

SEQ ID NO: 18835 - DNA, 1719 bp, Oryza sativa
cagagcagctcaagtaaatgatcctgaaatagctgtgctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagaaatagccgaattcgtcgcactctgcgatgtttgtcagcgagtcaaagcagagcatcagaggcccgcaggactgctacaaccccttcagatcccggaatggaaatgggaagaaatcggaatggatttcataacaggtttgcccagaacgtcgtcggggcacgattcaatctgggtggtcgtggatcgactcaccaaagttgctcattttattccagtacacactacctatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtgtctcaactgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcacctcttcgccagctcttccgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagtgcaattttaattccaggaaaaaaaaatcc

SEQ ID NO: 18836 - DNA, 23907 bp, Oryza sativa
aaggcgtagtcgcagccggcgatggcatcgtcgaagcttccttcttcgtccatgtcggcgcggaagaccttcaaggggccaagtgcctgcaagtccttgaggtgggagttcttcgccatgtcatctgaatacaaaccgcagcaattagtggaatcttcagagatgaaactgaaactctgaaaattcacaccatcgtattgataaagtcgcatcatattttgatccatcatatgtcacgatatatatatgtaactatcggttggaagttggaaaaggataagatttgacaacttctccctttcgaaagatatgatattgtccacatgtgcggctaagcctgccatttgctaatgagtggttaagcgaaaacactcgctaattagctcatatggtactagcaggccgaggatatgatcatatgaatggaagaaacactgcaaaaaaagtaaaaaacacgaactagagagtgaaaaaaggaggagaatcttaccggggtttctgaccgtcgtgttgacagcatatcccttctccaacagcatcttgatgagcgcagaagcgatgtacccgttgccgccggtgacgcacgccgtcttcctctcgaccgccgacatcgtcgtcgtcgatcggtcgctacaacaacccaccagcccagatgagacgaagaggacgaggaatttatgtttgttgctgtactttgggaagagttcaatttgtctagtgaggtggtctggcgtgcttatcagtaagattttttttaagtactaccgaaaagaaacatgctgacatcatgcactatatccagaatatcaccttattgtaaaataaaaccggtgcggtgcgagttgggtggttgattgagacatgtatagagaattagctaagagttattttaaaaactactaatttttaagaaaaaaatagccatccaataaaatagtctcaagttgtttagatccaagggttattttaagagctatttaatctttaatgcactttctcatggagagagataaagagaaaagacattttttagtgggccccacctgaaatagccctaattagtattcttaagggggatagtttttttggatgtgttattttcaaatagccctgaaatagctcacctatttataacttttagattatttgcagctatttgaaagaggactgaaaagtaacccatgaatctaaacaggtcctgagtcggagcgtcgattacgcacgtcagctgggttaaagtgtcaatatggagtggacaacaagatcgtcatatcacgctctcagcaatggtatgcgtagctggtagagtcaaaggagcatgcgtgcgtctggaccgatggattcatggccgtccatcggcatccaactgacgttaatacggccgtgcgtcatacacgttgtccataagccgatcgagagatgggacggacggtaggtacagtgctactgcaatcgcgccgtgtcgtgtgactatccctgtgcaccgtgttcattggggctgatgccgagcaggcaggggcagcccatcgcgcgcgctagaaagctagcaggccgaggtgggccgcgagcccgcgagggaggagaaaattgcatatgtactactcattaaaaactggcttcgctataatatcattctcaaaatgggatttgcccaaacgccactcataatatatgggtattcgctgaaaatgccacttcaggttttcttccatttcgaaaatatttttcatcaatttcaatttttctcagactataatgcccctgagactcttttttctccacggttcaatctagcgagcgtaagaaggtgagaagagaatcggcagcgacacgggcgccgcccaccaccattgcgccaccgctacctccagctccagccgccgcgccgaggtcctccccatctgtgccgctcgtcctagtccgcgcaattgtgccgcctcctcggtgacatacaccatgagtccatgacatacaacctcaattcatgagttcatatatataacttgcaagcggtttaattttcatttaatttcgcatcaagcagagctgccgacttgtttaattttgtatgagcaagttcgttcgctttggttaacccaaacgaactttaaaaagaagttgcaaaatgtttttcgaacatacaagaagatactactagaatagaagtcgctttgtgcttgaaaattatacacagttgttgatttcagaatgtaaaatcggcacatcattgacacaaaatgtgaacaaaaatatttaccaggcaccagaggaaattacacaggaggcaaaaaaaccactatgaattcagagaagagaagaaaaaaaaatgaaagctaagctcaggggtcctcagtgatgcacgagaggtgcggctgccacggcgaggcatggctcccggtgctcatgcgccgccggtgttggtggtggtgttgcttctgcaccctcatcatccttgtcgtctccggcgacgcgctgcactggctgcccaaccaatcggcgacggcggcgttgccctccgacttgctgcggacgtggtgcccgtggccgacggcgccgccggtgctcgtccttctcttggcgtcgaggacggaggcggccgggatgaggaagtagatctcgccgcactccagcttcgatttgggcgacacaatgtgtatccggcccttcgccccctgctcgacaagcactgccggctaagcacgtggttggggtgcgccgccagcacctcaccggggacacagcacggccgtacgcgtcgatgcggccggctcggtgcctagggtttcgctgaggatagccgacggctggggaggagactcaccggggataggcggcgcgcgcagctgttgggggtcagggaccggtgaaggcactccacggcaggcgtatgcagtggtggtggacggcagccgagtgtcgctttccgctttctcttctggacttctcgcgttcggtcgctagattgaaacgaagagaagaaagagtccgactgaatcagttgactcaggggcataatagtccaagaaaaattgaaattgatgaaaagtattttcgaaatggaaaaaagcccgaaagtggcattccagcgaatacccacgtgttaagagtggcgtttgggcgaatcctatcttgagaatggcattatagcgaagccagtttttacgagtggtacatatgcaattttctcgcgagggaggggatcgggaatgggcgaccatgcgccgagagcctgggagtgaacgggaaggaaagcttacgcggcgccctcatgcgcttttttttggctatttttttgcgaattttttattttagaaattgaatctttcatcttcaatttcatttggaagttttgaatttgagttgaaagttttaaattttgaaatgaaagtttcaattctgagttgaaattttcaaatatagatttattttttttcaaatcatggttaaaagttatcgaatttgatttgaaagttttaaatcttgagttaaaagttaaaaatccttatttgaaaatttttaaatctgacttgaaattttaaatattaatgcgaaaattttcaaatcttcacatgcaagcttttaaatctgagttaaaagtttttaacaagaaaggaaattggataaagtgttgcactacgtactttgctagcgcatatacactaaataaggaacccccgaggctgcatagcacgtttctttttgggcaaagtggatggccactatccggataagctcttttgggctgagtttggatgtggtgctagaaatttaggatttttcacaaatgctaaatgagactaaattattagtgtcaggttaattgaatactttctccattttcatagtattgttgttttgaattttttttctattctacctttttaaatttaatcaagtttataaaaaatatagcaatattttaaaacaaaacaaacacattattaaaatatctttaatgtagtatttaatgaaattaattttttttacatgttgctagtttttttttataaacttagtcaaaccctttacttaaaaggtttaactagatgatttataatatgaaacggagggagtattaattactataaatatgacaaatggttttattagattttttttaaagaagctttaaaacttttcataatatacatcatttaacagtttgggaagcggctaaaaaaacaagtggcatccctaacagaccaaatgaacggagccttggtccctcaaaatggacatctccttatttcttacgtatcatccaaatgaatcttgttaatttttttaaaaatatatataactatttaaatgacatgcaagaccaaaggataccctataaggtattaattttttttgccattatctactgtgtattaggctcatcttaaaacactgtatttttttttctttgagatgtttaaaggcacagaccacttatttcacaagcgcatatatagtttggtcctcgtgacatctaccccctctatcccataaaaaccatcctaaaccatcctagtactgaatgtgacatatcttagtattacaaatctggatatacacctgtccagattcgttgtactagaatatgtcacatccagtcttagtttcgtttttttggacgaaaggatatgtcacatccagtcttagtttcgtttttttgacgaagggagtaggttgaaagtagagcagcatgagctgttcgttcaatgtggtagaattcccagggccctgccttactccacaaggtcatcaagtatgtcgcccaaattcgtgtacttgaactcgaacggtcgaacccttccctgatcagcttctccgacgaacagcagactctcggtttctcaggcatcccgtcgaagctgcaaagataacagagatcatcactcgctcgtcagatcgaacacagcatgcatgtatatctatgttggatttcgaagttggccaacaattcgatcgtaccggtcggttttgacgttgtactgcgggtaccttccggccatgaaacgggcaagcgccaagacggtggtgttgaagctgcagcagatgtacctcgccgacgactctgccgacgacaatgacgatgactccttctcggcgaggaatatctcggcgcggcagaggtcgtcgacgtgaacgatcgacacgtagccggtgaacgattgcaggggcttcaggacttcgagatgcgtctcatcacctgagaagtaataaacagaagccaacttaggtgtgtttatattcagagacgcggtaaagttttggcgtgtaacatcggatattatatagggtgtcgtaagagttgttggggcattaataaaaaactaattacagcatcgctaataaaccgcgagatgaatttattaagcctaattaatttatcattagcgaatgtttactgtaataccagattcgtctcacaaattagtcgtaatcttgtaattagttattttctagcctatatttaatattttatatagctgttcaaatattcgatgtgacggggtgtaaatttttaaggtgggatctaagaaccacctgcaagtgttgagactttggtgggagctagcttgttgatttgatcgctggtgctggtgcttctaactcaccggatagcagggagaggatgccggggacgctcgtcctcgccaccggcgccggcgctgcgcccaaggtgaacaccgggaatacggtgacgaggctcatgttgttctcctccgcgaacttgcatgctgccttctccaaaagcaccttggagacacagtacgcctgcaaacgcaaacgccattttcaaccatacaatatttatttttggtaaacttataaaaaaagtctatgtttagtttattgctaaatttagtcaatatataagaaatcctgccaaaattttgataatattagcatcttgccaaaattttaacattgccaaaacttggtaaggtttatttttgttacaatctaaacaggccctaaatttagagaacttttctatacaatatactgagtattttaagaatttttattaaattaacaatggtattttaataattttcatccattgtgctagtttgcagcggcgcggcacctcatggtggtgaaaataatgcctatctctactccctccgtcctaaaaaaaacacaacctcgtactctctccgtattttaatttatgacgcggttgactttttgactaacatttgaccattcatcttattaaaaaaatgtatttatcatttattttattgtgacttgatttatcatctaatgttctttaagcatgacatagatatttttgtatttgcacaaaaattttgaataaaacgaatggttaaacgttgataaaaaagttaacggcgtcacacattaaaatactgagggagtgctagaatgtgacatatggttttttagacggtgggagtatttcactataaattatgagtttacagaattaccctccaccaatagtataaaaagacaattttatcccctttaattttatactatattatattgaagcaggaggaaaaaataatatttttttcgattatttgtactgtcagtataatactgtaaaagttttcttaaatttatggataagatggagatgtgaaaatgtcaagagaggaacgtcacccaggctagcggcttctccgttctcaggtagtcaacgtcagaccaggattcctcgtccagcacatgcccgtcgccttgcagcggccttctggagatcgctgcgtccgacgatgttatgatcacgcgcttcaccgtccccgccttcgcgcacgatctcatcgcgttgagcgttccattgacggcggcttcaaccaaatctttctgccaccatcaacgtcggaaaaaaaaacgaaatggagagcagtagagcacatcaaagttggatgaacatggattggaaacggacgaaaactagctatctcgtagtcagtagggatcttaattagtggtgccaagtactaccttgtaaaaaaaaataaattcctatatacaatcttagatagacacatgttttcaggtttgtaggtaatattagttttttttttttttaagacgaagggtgtaagcttttcacctcaggattctctgaattgaagttcatcggagcagcgacgaggaaggcgtagtcgcagccggcgacggcatcgtccaagctgccttcttcgccgatgtcagcacggaacaccttcaaggggtcaagtgcctgcaagtccttgagatgggagttcttcgccatgtcatctgaatacaaatcgcagcaattagtagaatctttgagaggtgaaactgaactctgaaaattcacaccatctttttgagatcatataaagtctcataataattcgatccatcatatgtcacgatatgtatatatgtaactatcagttggaagttggaaaaggataagattttgtcctcatgtgcggctaagcctgccatttgctaattggttaagcgaaaacactcgctaaaaagctcatatggtactagctggcctatgatttcacacctgaactgaatggaagaaacactgcaaaaaacatgaacttagagagtgaaaaaatgaggaggagaacctcaccggggtttctgaccgtcgtcttgacagcatatcccttctccaacagcatatcttgatgagcgcagatgcgatgtagccgttgccgccggtgacgcacgccgtcttcctctcaaccgccgacatcgtcgtcgtcggtcgctacaacctctccagcccagatgacgaagaggacgatgaatttatttttgttgctgttctttggaaagagttcaatttgtgtagtgagccagtgaggtggtctggcgtgcttatcagtaagtattcctaaaagaaacattctgacgagcactatatccagaatatcacctttattataaaataaaaccggtgcggtgcgagttgggtggttgattgaagtgtcaatatggagtggacaaatagatcgtcatatcacgctgctctcagcaatggtaagcatagctggtagagtactacacaatactacggtggtgtttgaatattgaagatgaagatggagattaaggggctgtttggttcagatactaacattgactaggtttaccatgctttcttaaccaaacttgccaaagatgaggccatcaaaatccaagccacactctagccaacaaaatgaaaccatgccacactttttagagacacttacatgtgggacctagattacaaaagaggaatcttgccacacttgtggaagccaaccaaacaatcatctaacatggtcaaacttgtctaaccttaagtatggcaaagtgtagtaacttatggccatcaactaaacagcccctaagtttttatgcaaaacaatatgctattaacgtatgattgattgagttttaattcttacaaacttgaaaaatagattaatatgatattttagtgcaacttttatataaaaagtttttgtacgaaacacatcatttatcatttaacagtttgaaaagcgtgtcacgaaaatcttaatatttatctaagtcttgtggaagaaaagaactggacctgagtcatgcattcgtgcgtctggactgacatgtagattcatggccgaccatcgacttacaactgacgttaatccgggcgtgcgtcatacgcattgtccgtaagccgatcgagagaggggacggtaggtaaagtacaatcgcgccgtgtgtcgtgtcgtgcaccgtgttaattgggggaaaaagtacacccaaggtccctcaacttgtcagcgagataaaaaaacatacttaaaccataaaaccatatatatatatagtcccttaactaaacaaaaccgatcacccgagatccttcggtggttttgaccccgatttcggtctatgtggcggctgagtcagcatgggaccaacgtgggtcccatatatcaggatgccatgtcagccggtcctcggttcctcctctctgttgagcgcgagcgcgaggcttgcaggcgagcagatggttgaggactctgcgagctcggaccggtgcacgacgcggaaggggtccgggtgaccggcgagggcgcggtcgacggctgcaacgcccacggcctcggcggcggagaggaggagatcggcgaccagcgccgccgccgccgcgcttcctccacgcgctagccaccaccgcctccacggggacctcgccgtgggcggcggccatcgtcgacctcgccgcccctagggccctccacgccggcgcacaaggggcttgccgcggaggatgagcggcgtggagctccagacgcgccgccagcgggaggcgagcgcggcggtgcgagtcgcgcccttgaagggaggcgggcgacgaggaggtcgtcggggagcgcgctgacgcggtcctcgccgtcgtatccctcggcggcggaaagcatggcgccgttgtcggaggcgggatggccggggaaccaccggaggcggacttggacgtggcgctgtcgtcgtcgtcgtcctcggcgtcggggaagaaggtgggctcgccggcggcggaggctagggggttgccgcggctagtgtggatggaaagctgaacattgcttcttcagctccaatatattgtaattcacgagcctttttattttgatggttgcttcttcagttcgaaagatgtctctgtttttattcttgttcaagccattggcaagtctgaagaacctagactgaattctatactgtagtacagttctaccatcgtcagtacagtataaagaagcaatcttttgaatccttttcaagtaggagtatagtatgagattattatagcctgtcaacttgctgtttgtaactagccaatgctaatcttttcagctcgattatgatatatatcacgtcgtcagatttgtgcaaaattggtatagagacattctgaccgggttatggtcgatgacactgtccatcatctgagagtttgcaagtctctgaactctgaacattgcccagaatctcttacaggaatctttttgttggtcttctcatacagtatatatcattggccccttgcaagcagaggacaaattctctttgcattcgtatgcattttaattctgcgaaacctgtagcttgtcctgtgtataaacaacgagaatatcatctgtttatcattccaatttccaagtatcaacttctacctcgaccaggagtaatacagattctgaagtttataaacacatctctgcctgaacaagatggacacctactgttttcagttcaccatttgatctttaccagataaacctgaagttcaaaccgtgcagcactgcagccatgtttcccaagatagaatgacgcgtacacaagcttccagcgtgtcgagggcgaggtcgacggcggcgccgcaccgcgtgtgccagcaaccccaggcgccgcaccccgggagcggcccgctattgggagccgccaccgacgcctgcctgctgtacagaaactgcagcacgagcacgagcaccagcaccttgtaccgcaccagccgcgggaaccccctagcctccgccgccgcgcccaccttttttctcgacgccgaggacgacgacgacgacagtgccacgaccttcttcttctcggcaccggcgccggccacctctgccgcgtgccccacgcagcaccaccctccccggtggcgccgccgcgccactatgttcgttgccggccggcttccaacaggagaaaagagtgagagagagagagagagaggaggaagggaggatgctgacggcggcgttgcctccgccggcgcgacgccggctgccggaccttctcctctcccctccccccggcggcctcctcccccacagcgccgcccgtcgccggctgagaaaagtgagagagagaaagggagaagaggggaaataagagggaagagatgaggtggcgtgggttccacgtgggtcccatgctgactcatccgctataaaccgccgaggaatctcgtatgatcggttttgtatagttaaggaatcccgcatatctggttttgcggttcgaggatgattttgtatctcgctgacaagttgagggaccttcggtgcactttttccgaattttttttatttttaattttttttattaaaagttttacaaaaataatttttcattttgaaaattgacagaagtggtcgcctaccgccctctgggagggcgatttttaaaaatcgccatcccagagggcggcgaaaatgacgtggcagacggccgttcgctctcgggcgacggccgtcaacgaaatttgcatgcggcccccttgccgccctccgctagggcgattttgtactgtgcggggggccgcctgcaaatgggcggcgagggggcatggaattttgcaggcggcccccttgctgccctgggggagggcgattttatactgtgctatatttttttttataaatatcaatagttatcaaatctttttatattgaaaactatacaagattaaaatctccaagactggtaaaatacaattttattattttttagggcatagttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattatgtattaccaatgaataggcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtacgcgctactggatctgacactaccatgaagcgccgaaagtgcgttgtcgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaactcgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggactatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagtgccggtcgtgcctgcgaacgcgctcgaaggcagacgaggccctgcgatgaggaaacgtgcagttaaaacatggtgacatattcgtgcaaaagctgaaacaaaaatgaactaatatctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtgccgtaggtcgaggtcctgctccgacggtaggcacgcgaggccgtggttgcaccggaccagctggaggtacgacgtccatggcgctgcgacaggagaagacgcgcatgaccgcacgcatcttctcctgcatccggtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaagtaatacaaattcgacgtacccccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacatgtgaagagaggtacattatatggctcgatgatcgcttaattatcataaaaatttagaaatgaacaatccgaactcacgagtggtcggcaaggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggcaggagacggtcaaactcgaacacgaagtccgggtaacctcgtctcacctggacgtgagcgtaacgacgctgcaataaacatgatcggaattagacatgttatgtgaagaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgtggcacgtcctgtggctgagcatccgcgatgaaccgtgcgtagtggaccagccggaagtccacagcgtgcccgtgggtgctagtgaacatcacccacccgaacaacaacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactggagcaaccaagccttgctaggcccgactgtagagtacgaaggaagggtgttggccggtcctaggtgtggaaggcgcatcacctgctcgaagcgcgcagtgatatcctccttccacccaaaaacacagtccacgggaccaactggtgctcccgccagcggtagcccgagcaggtacgacacgtcctgcagtgtcggagccatctccccacagggaaggtggaacgtgtgcgtctcaggtctccagcggtctaccagagcggcaaggagtgaccggtctgcatcccaccgcttcgctgggtcacggtcgtccgccgccgcctcaacaagcctacaaagtggtggaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaacagattgatcagaaacatataaataattagttcaacataagtaataaatgttcataagcgaattactaacacattcctgcacaagagtacaaacaaacaaaagtgtcaccatacggaatatttctgattacaacaataactgcagttacacgatatgagtacttagtccgaatactcatcacgataacattatgatacaacaccgaatagttcgcaatactactagtacaacaatagtcggaggtactcattacaacaacattcaattgaaattacacgatagaaatatttagtccgaacactcattacagcacaacagcattttatttcctaaatcgatagcattgttacaccatggaatcgcctgctgcgcgacgacgccttggccttgcgcgcctgcttgttgttccttcaccaggtggtcgcctaccctcacttgcctgtccagatggactagcatctgcgccgcttggaacttctgcattctttgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacattggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgcgtgccgtgaaggatgaattcaacaatagcaaccaatggaagtacccgaactcctcgcattacccagttgtacacctctgctaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccaataccagctttcagtgttctcactctctacaaatgcaaaagccataggtagaacctggttgttcccatcacacccaattgctgtcaatatctgacctcggtatttacctgtcataaaagttccatctatgcatagaacaagtcgacaatgcacaaaagcattgatgcaagcacccaacgagaaaaaggctctttgcagcacactctttgttcgatcatcaactgatgtaaatgtatgtaggtcatagtaagtattattattcctctgggcaatggtggctaacaaacgaggcaaattatcataagaagcttcaaatgtgccatacctcatctcaataatcttttgtttggctctccaggcctttgcatagcttatggtgtacttgaatttgttctcgatgtgcctaataattgattttggttcaaagccaatgttaccaacaacactgctgtacatctcacttgccacaaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcactttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctaaaatgtgaccttatttgacattgtgcctgatgaaaacaataactgcgttaacctcgcatttctgtactacgccctaagttacattctctacaatattgttctccaaaattctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgtaaaagatgtatgggagcatacctgtgatgaagtgagcgaaccagcagggcttcgccgctccccttctgctgccctcccctctctctctttcgttttttttggatttttagtgaatataatgaaatttcagagaggagggactgggctttataggggggaggcaaaaatcgccctcccccagggcggcaagggggccgcctgcaaaattccatgccccctcgccgcccatttgcaggcggccccccgcacagtacaaaatcgccctagcggagggcggcaagggggccgcctacaaatttcgttgacggccgtcgcccgagagcgaacggccgtctgccacgtcatttttgccgccctctgggatggcgatttttaaaaatcgccctcccagagggcggtaggcgactacttccgtcaattttcaaaatgaaaaattatttttgtaaaacttttaataaaaaaattaaaaataaaaaaaaatccactttttcctaattggggctgatgccgagcaggcaggggcagcccatcgcgcgcgctagaaagctagcaggccgcggtgggccgcgagcccgcgagggaggggatcgggaatgcgcgaccacgcgccgggagtgagcgggaggtcgcatgcgcgatccgttgactgatttctctgcactaatttccaccgttcgccttgtcccacgtagggatggcaatcgggcgcgacgggcacgggtagtgcctacctatacccatgcccgtgagattatttgtgctcgtgggtatacccattactacatgacgggtaaggatggttacctatgcccattgcccgcgggcgtgcccgtttacccgccacaacaaaagcagtggaacaaaaagtctacaagctactaagttcgaatcgaacttaaaacatcaaatattctccacctcggtgtcgtgtctctcctctggcggcgatagagtaagaggagagaaataataagggaaataaaagggaaaccgaagaaatcaaagaactgggcttatgtattctagtggattttgctcctagcctacatataagttagatttcgtgggtaaacgggcaaagcgggcatgggtagtgattacccatacccatgcccatttactcatcgggcatagcttttgacccaataagatacccatgggtataaaatggagaacaaacccaaccctaatagggtttttacccgcgggtaaacgggcaaacgggcacaattgccatccctagtcccacgttgacgaccggcggaggttgatgccaaggatattgtcgttgccggcttgccgcgcatccatcgccccggtgcctggttacgtgcccgtcgcgctcaaaaatctcgtccacgcactgcacaaaagatcaggccggccaccgtgcccaggtgaaacacgaggtggccagtacgtgacagagccaggcagcgtgtgacgtctgtggtttttgcatgctcgcattgcccgcatccgcatgccgtcgtgtagcgtgagcaattgaccgatcgatttgtggccttggccttctcaacctgctcggctgcacctgacagcagcagcagtgtcgcagcaggtagaaacgctgttcagagagttttttttttttcaacgcgtgccagaccacaacattcccattacggattcacatggatccatagtaaagagggcccacatgttagtgactcaaagtcatgtggcttagtccgtgtttagattttttttttttgctaaaaaggtcacatcgaatgtttggacacgtgcatggagtattatttgtggaaaaaaaccaattacacagtttgcatgtaaattatgagacgaattttttgagtctaattacgccatgatttaacaatgtgatgctacagtaaatatttactaatgatggacacattaggcttaataaattcgtctcgcagtttatatgtggaatctgtaatttgttttgttattagtctacgtttaatacttcaaatgtatatccgtatactaaaaaaaatttggccaagaaactaaacacaaccttttttttggtggcagaagtttttaccggtcttcgggaaaccgggaaagtacgttggtattgcaaaaactattagaggatttcagctaatcctttccggagaattagacagcttaccccctaagaggatctcaaattctcaatcctcctcttacatgaacagaacgaagtacagccaaaccgccaaatgtattggaacttggtactagtactactagcaatgtagcaatagaatgctagacacaatagtatttttgaaagcaacacacgtttggtcgtaatcgccaaagcagtggaattacgccgcccatcatcaccatcagttggggatcaaccccagggccttgccgtacgcgacgaggtcgtcgtacatctcgtccaggttcttgtacttgaactcgaacccttcgccgatgagcttcgccgacgagagcgagatggtcggcttctcggggtgatgctcttcgatgctgcgtacatagcaacgcatgatcagattcagataaccaaatgcacgaatgcataaagcttaatttcttaattaccaatcgcatctgacgttgtactgggggtacttggccgccaggaagccggcgatctcggtgaccgtggtgttgaggctgccgcagatgtacctccccgacgccgactcctcctcggcgacgaagatctcggcgcggcacacgtcctcgatgtggaccatcggcatcgaccacccggacgccttctcgatgcccttgaggatgttcatcatctcctcgtcgcctgaaaaaaaaaattcacagatcatcgatgcagcgacccaaaaacgttcagaagtcgagttcttggattgcttcttgtttcattcattcggtgatcgctagatagttcctcaccggttatcaacgagaggcaggccgggacgctggtatcgaccctcaccgccggcgatgctccgacggcgacgaccgggcagagggtcaccaggctgagaccgttctcctccgcgaacttggtcgcctccttctccgaaagaaccttggagatcgagtacgcctgcagtgcatgcagcaacaatggcgccgaactcatgttctacgagacattgctgtggttcagtgacatggaacagctcgtgtgtatatatgtgtacctgcgtcggcgacagcttctccatggatctgaggtactcgatgtcggaccaggacgactcgtcgaggacatggccggcgccttccagcggccgcaggctggagacggcggccgtcgacgacgtcaggatcacgcgcttcaccgtgccggctctcgcgcacgacctcatcacgttcagtgtgccctcgacgccgccttggactatctctttctgccatggccaagttcagaattcagtaactaactaactgactacagatactaatcgagcttgcaggttgcagcagtggtcacctcgagatcgtcggacttgtggctcttgtcgtacaccggagcggcgacgaggaaggcgtagtggcagccggcgacggcctcgtcgaagctgccttcatcctccaagttggcgcgaaagaccttcagggggccgagtttttccatgtccttgaaatgggagaccttctccgggttatctgaaattcagagttacaaaagcagtttcagaggccaaaccaaaattgtactgacacaatcaatcccaaaactgaacgtgcaaatactcctctgaaacaaattatgaactgatgacatgttcttcgattttcagttaaaactgaacactggaaaaacatgtaacaagaaagaaagggagtagaatctcactgggatctctgacgcttgtctgaacagcgtatcctttctccaggagcatcttgacgagcaatgaagcaacgtacccgttgccgccggtgacgcacaccgtcttcctctcaacctccgacgacatcgtctctctctctctctccggtcagttaatacctctcctgtgacagagaaggtgacttgggtttactcccaggtagaatccgagcagcacactgatgatgaggtttcttttgctgattgcgctgttgtggcacttgccaggacaaatcccggagagcaggaacataatacatttgacttagccaacactattttacaagcgacgacgccagtcgccagacagagaggcagaacaagaaatgcttttcgtgatgcatgcaccatacctgctcttctgattgattttccttccttagataatgacctgcactgatcgattatgtcgatcgatgaacatctcacgcttcacatttttaatgcggtcgatcgtgttttcaaaaggtaaagcttttgctccaagaaaaaaggatcatcttatcttcccagatgacgtgtgtacaggttcattcttagaattgaacttttttttttaggatagaggtagtacatctgacgctgaagcctgtgacgatttaacatcgttgaaaatgataggatccgtttctttctctatgcaaacaaaagcgagagaggaacagcacacgcgccattgaaaagtaacccaacgctgcatgcctgcgaattggacttctcgtttgtgtgtgtgattaatcataccaaaaagtaattcctgcgatgcccgcaaagttgagctgagagagctagcataaaaaaaaaagctagcaagttagttcatgttattagtactccctatgtttacaccattgactttttagcacatacttgatcattcatcttattcaaagaaatttgtgaaatatgtaaaactatatttatacatgaaagtatatttaacaatgaattaaatgatagaaaaaaaataataattacatattttttttgaataagacgaatgatcaaacatgtttaaaaaaatcaaacggcgtcaaatatttagaaaaggaggaagaagttgtcttcgcatctctgtaataactttcccacactaaggttgtgtttagttcacatcaaaattagaagtttggttgaaattgaaatgatgtgatggaaaaattagaagtttgtgtgtgtagaaaagttttgatgtgatggaaaagttgaaagtttgaagaattattttggaactaaacacggcctaacacgacctgatcttcagatgctgaactggggaccttgaaagaccttgtgaggcttcgttgttccaccagaatattttctttgctacttaatgaaatgacagatctcttgcttgtttcaaaaaagaaaatcatagagccacaattaggttgtgttctttagtgagggttgtgaatcctttcctcccgacacataaaacggagtgacggattagcgcatgattaattaaatactatttaactgaaaaacttgaaaaatgaattgatatggttttttaaaacaacttttctatacttttatcttgtaaaaaacatattgtttaatcgtttggtaattgtgcatgtgaaaattgaggggtagaaattgagaaaatgttgaaaggagcacaattttattgaacagtt

SEQ ID NO: 18837 - DNA, 5133 bp, Oryza sativa
  unsure (1)..(5133): unsure at all n locations
ctgcatgttccgccgccaccgtcgaagtcagctcgcagtggacacgcataatctttgagaccagttcatgattttgtcttacgcatcgatgtcaacgttgtggtgcgggtatttggcggccagggaacgggcgatctgccgcatggtggtgttgagggcgcagcagatgtacctccccgacggcgacggcgacgctttctcggcgaggaatatctcggcgcggcagaggtcgtcgacgtgaaccagcttcagcccgccggagtactggtcaatcattctcagggtgttgatctcctcgttgcctgaaatcgaatcggacacgtgagtccgaaccagatactccctccataccatgaaaactctcgttatactaaattatattacattctaatactaggttgggtttttggaagaaggagtttattctagcacacttaggtcgtgtttgctactgagggttctcaatcttctctctcgtttttctcgcgcatgcttttcaaattgctaaacaatatgtttttgcagcaactttctatatgaaagttgcttaaaaaaattaaattaatctatttttttaaaaaagttaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccggtgccgtctccttgcagcggcttgccggagaccgcggccgccgacgatgtgaggatcacgcgcttaaccgtgccggctttcacgcacgacctcagaacgttcaaagtgccttggacgccggcttccaacagttctttctgccattaccaaataatactctagatcggtattccagctggttattatggagaggatttactagacaaaccaagtaaattaatcgtgacgatacaagtaaaagtactctcccgtttcaaaataaaacaacatagtattggattggacacgtacataataaagttgtttattattattattattattattattattattattattattattattattattattattattattattatttcagagacaagatttttatgggaggaaatattattccttccgtcctataataaattcagttttagacttttctatttatcccaaaataaatttatttttaaagtaatcattacatcatgtgaaagtatgataagcctctcccatttatcccaaaataaatttatttttaactaatcattacattagagttcttgaaaatatgatagtatatatgtattgagaataaataaaaatagaaataattatattgggatttaataaagtgagtatattataggcttgtaggtaaatattggtttgtgtgagataggtaaaaaacaaacttattttggaggaaggaatagtaattaatgtgacataattgatatctaatcaacagtggcctggcagcgatcagagacttgacaagtggcaattactacctaggacaagtggacaacatcgagtggcacttggccccacaatggcactgagtttggtgggagatgtgctacgtgtctgcatgcatttacctcaggattctgagacttgaggttcatcggagcggcgacgaggaaggcgtaatcgcagccggcaactgcctcgtcgaaactgccttcctcttccaagtcggcgcggaagatcttcaaggggcctagtgcttgcaactccttgaaatgagagttcttctccatatcatctggaactcaaaatcacaatgcgctgcagtttcagaggccaaaccaatggtgttcttgtgaattcccgaaatagttttcttcggtcatatcaacttgaaacaaatcaaacatcagcatttatcttctaccaaacagaacaccgcaaaatcttctatgcacacagcatgctgttactgcccggatctatcgtcaccgcatacacacaaaatcaatgaactgaagacgatctacagaccattgttggggtgagaagtaagaagaatctcaccggggtttctgactgtcgtcttgacagcgtatcccttctgcagcagcatcttgatgagcgccgaagcgatatacccgctgccgccggtcacgcacgccgtcttcctctcaaccgccgacatcgccgcggttagttggctacttcgcctctcctagtagacgaagaaagagtgagaattgcttcacgcaccaaataggagcagctaggaccccaagcactgagcagagcgtactgaggttgcttttggtcggggtcattgttggtgttgtcatgtctcgtggtcatagatcatcatattgggaggtacaactactttgagaaaagagtactccctccataaaaaaaaagacaaacaaaccctgatttccgtgcctaacatttgaccgtccatcttatttgaaaaaattataaaaaaaagtaaaaagacaacttacgcataaaatattaatcatattttatcatctaacaacaataaaaatacgaattataaaaaaatttcatataagacggacagtcaaagttgaacacggaaatccagggtttgccttttttttggatagagggagtatgtgtattagaatatatcacatcatatactaagtgcatttatattatgcattaagtgtatttatattgggaccaaaggagtaggaatatatacatagcatgctcaatgcttacaccctctgtcctataaaaaaacaatttagcactggatgtgacatatctataactataatctggagatacctttgttcatgtttagattcgtatacatccattactagatttatttttttcggaacggagggagaacgtgtcttgtgtgggtctttgattagtagcaaacgtaggtaccctgatttatcctagactgagatcctttgatttaaatcaagtgattttaggatcactaacatgtggatacatactctattcgttccaaaatataaatatttttaaacttcgacacagttttcgagatgctattttgatcaataatatatatatatataatgttttaaataaaaaagagttgcatattatgatagtttgtttaatgataaatttagtaacatcaattttacatgattgatcttttttctactaatagttaaagttaaaaaaaataacttgacactattctaaaaatgtttatattttggaagtaagaaggatctatatgttggtgactcaaagtactccagtagaaaaaggaggtcgagagtattcgttcaacgtgtctttttttttaaaaaaaaaatccgggaacagcaattaagccatctaaccaacatcgttgctcctctccccacccaccctatagacttaggggctgcttgaataggaggcacttatatttctgtgaaatcagtctctcccattcaaatagggcattatgttctaacgagccatttggttctgatcaaggttttgaatatcagttttaaagagcacctaaaaatcagtttaaaaaattattgtatgaagtagtatatatgcatctcatacaattaatttttgaacttgaaactgttctcgctgttgctgctaccggtggtaatgtacgctaagatttgcatcttttcgttgtgatcactgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccgccgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatggtatcagagcaaccctagtgtttagatcgtttcggggaaagaaatccaaagaaagaaaagcacaagatccgcacggatcaaaagaaccaaaaaccctaaccctaattcttacctcgtcgccggccgtcgtcgacgccggcaacggagggggggaggggcaaagaggccccgcctaggagccactctacggccgcgcgcgcacctgcacgcgcgtgccggcgagggggcccgcggaggcgccgccatctccgtcgtcgccatctctctctcacacggtgggggttagagacggtggggggagcggagaagagaaaagaaaggagcgccgccatggcgcggcggcgcgagggcccccggcgtcggcgaccccgctcggcgcgaccgcgcccgcccgagagagagaaagagaggagaagctagggtttcggcggccgcccggggcacgaggggttttgatccccgttttcggcgcccggccgtccgatcgcaaaccctaagatcggacgtccggcggcggccggaccgaaatcggcccaagtggggagcgcgcggcggcggctttcccggcccaggcccaggttgcggcctgggggaggggagggggcgctcgcccgcgcgcaaggtggccatgggccgaccggcaaannnnnnnnnnnnnnnnnnnnnnnnnnnnnnnnnnnnnnnnnnnnnnnn

SEQ ID NO: 18838 - DNA, 2497 bp, Oryza sativa
atcggccaagtgggaagcgcacgacggcggctttcccggcccaggctcaggttccggcttgggaaggggagggggcgctcgcccgcgcgcaaggtggccatgggccgaccggcaaaggccggaacaaagtccatataaggtccctccggggccgaaaatgaataaaagagaacagtagcaatttttccattttattttgtcaattttcatgcaaatttcaatagaattttgaatagatttttgcatgttttacctctgtttaaatttgaaccaacgggagaattttcacagagagagaattacagagatttagctactgttcatatgattttatatagtcttccgctgcaaatagatgaaattgatgaaaattagtgtttctaaaattaaatttcgaaccaacgggagaatttaattttaggaacattaattatgtgctatgatgttgtaattttctgaccaacgttgttaattgcaatattatagttatggttatatgtgttatgtctaattctgcccaacggtgatgtaggcttaatgcataatattttaatgttaattttgttctcaccgcacatgattatttcaggtggctactccttgatgggttgcattaaagatattccgaccctaaaaggagataactacgcagaatggaaaagaaaactcgaccttgcttttatcttgggagaggtggactgggtattgactaccccatgtcctatagaacctgctgaccttgtcagaggtgaaaatgagtcagatgctgactggcaaaagagacagagggacaatgctcctctcgtcatgtcgtatgacattgaacaaaagaaatggtccttagccaacaagaaatgtttggctgtggtaaagaatacgattgagcctaccatattgggctcgatcccagagtgtgacgctgtctcagagtaccttgaaagaataaagagtcagtttactggctcttcaaagacttatgctacacagctgatcaagcagcttgtgacagaaaggtaccatggaggtggtgttagagaccacatacttagaatgagcaacatggcttccaaattgaagccaatggatttgggcataacagatgactttctggtccatctggttatggcctcattgccaaagcagtttgacaattttattgtcaactacaacataagtccagagaaatggaactttgagaagctcattgctaattgtgtgcaagaggaggagagaatcaaagaatcaaatggtggttcaataaactatgttaaagataagaaaaagaaccacaagtctcccacctcaaaaggtaaacagtctcagcatctgcctcaacaacaacagttcgctgttgagaaagatcaatgtctccactgcaagaagacaggacactacaagaaagattgtcctgactttttgaaaatgatcatggcaaagaaaggtgagaacattattacatttgtaaatgaatctcattatgttggttactctagatccacatggtggattgattctggagcaactattcatgcttgtaattgtttaaaggcattccgttcgacgaggactacgcaaagaagagaaagcaccattagagttgccaatggagttgaagaaaaagttgaagctgttggagatcttcctctagagctcgcgaatggcttcatacttttacttcgagatgtcttttatgttccttctttgcaaaggaacttaataagtgtatcaaagttggattttgatggatatgattgccgctttggaagtggcaaatgtgaactatggcataataatgcatgtattggtcttgctgtgttgcgagacgagctttatttgttatctctttctgagaatgtgaatgttgtgtcctcgttgacaaaagaaaacaagaaaagaaagcgaactcccgatgtctcatcgaaattatggcactgtcgtttgggccatatttcgagggggagaattgagagactagttaagaatgaaattcttcctccattggagttctcagacttagaacaatgcatagaatgcattaaaggaaaatttgtaaagagcatcaaaaagggtgcaaaacgaagcgcgggaattttagagatcattcatacagatatttgtggtccatttcctgtgaaaagtgtggatggctatgactcgttcataacattcacagatgattactcccgctatggttatatttatccaattaaagagcgatcagaagcattggataaatttaagatattcaaagctgaagttgaaaatcagcatgatataaagattaaagtagtaagatctgaccgtgggggggagtactatggtcgacatacgccttatgggcaagtccctggaccttttgcaaggttcttgctagagaatggaatagtagcccagtattcaacaccgggcgaacctcaacagaatggggtagctgaaaggcgcaaccgtacccttatggatatggtgcgcagcatgatgagctactccacactaccac

SEQ ID NO: 18839 - DNA, 13167 bp, Oryza sativa
aaaaccgccattcatattctcaacagagttccaagcaaatcggtgcccaaaacaccgtatgagctatggacaggaagagtaccctcgctaactcacctccgtgtgtgggggagtcctgcagaggccaaagtatttaacccaaatattgggaagttggaccccaaaacagtcagctgccattttattggctatcctgaaagatcaaaaggctatcgtttctactgtccaaacagttatacaaagtttgtagaaacgagacacgccgtcttcttggaagacgaaatgattagggggagctcggtagttcgagaaattgatcttgaggagaggcgggtgtctgtacccgctccgtcgactcaggaacctttcttctctctacctgctgatgttgtgcctgcaatgcctgtcattgaggtaccagcacctgttgttacccctcctgtggcaacaatgaatgagagtgaggaacctgttatacaggattcaacagaaatggttgccacaccagaggaggagctacaacaacctcaaatagataatgtgccagtacaggagactcatcaagagcctcaggtacaggatgtgccaaatgtgcaggcccctagaaggtctgaaagagtcagaagatcggctatccgtgatgactataaagtttataatatagaagagtcgcatatggaggatgatcccacctcatatgaagaggccatgagaagcgctcgctcatctgaatggttggaagccatgaaagatgaaatggaatcaatgaaactaaacgatgtttgggatttagaagaaattcctaaaggagccaaaacagtaggctgtaaatgggtctacaaaaccaaatatgactccagagggaatatagaaaagtttaaagcgcgacttgtggcaaaaggcttcacgcaacgagaagggattgattacaatgagacattttctccagtctcttgtaaagattccttcaggattataatggcactagtggcacattatgatttggaattacatcagatggatgtaaaaacggcatttctaaatggagatttggaggaaaaagtatacatggcacaaccgaaaggttttgtcatgaaaggaaacgaaaatatgggatgtcgtctaaagagatccatttatggattaaagcaagcttcgagacagtggtacttgaagtttgatgggacaataaataaatttgggtttcaagagaatgtcgaggacaactgtatttattcaaagtttaagaatgggagatttattttcctaattctgtatgtggatgacattctactggctagtagtgatgtcagtctactgcaggaaacaaagaaattcttgtcctcaaactttgacatgaaagacctcggtgaggcttcatatgttttgggcatagagattcaccgagatagaacaaagtatgcattgggactttctcaaaagacatatatagaaaaggtgttgaagaaattcaacatgtacagatgcagtgctacacctgctcctataatgaaaggcgaaaagtatggggcatcgcaatgtcccagaaatcagtatgagctcaatgaaatgaaaacaaagccatatgcgtcagctgtaggaagcctacagtacgcgcaagtgtgcacacgacctgacttggcatttgttaccgggttacttggcagatttcagagtaatccaggcctagagcactggaaattggtaaagaaagtcttgcgttatttgcaaggaacaaaaggcctcatgctgtcttacagaagatcagaatcactccagatagtggggtactcagattctgactttgcaaaagataatacaaagtcaacatcgggatacgtgtttaccctggcaggaggagctatttcatggaaaagctcaaaacagactatcactgcagggtctactatgtatgccgagtttatagcatgctatgaggcaacggggcaggtgaactggctaaagaagttcatacccggtttaaaggtggttgacagtattgagaaaccactaaagttatactgcgacaacgaacccgcagtaatgtacgctcacaacaatcagtcaagtggtgctgccaaacacattgacataaagtactatgttgtgaaggacaaagtccgggatcaaacaatcagtctcgagcacattaaaacagaaaggatgctcgcggatccgctcacgaaaggcctaccacccaacgtgttcaaggaacatgtagccggcatgggtttaagggaagccttatgaatcctggactacagggcccaaaagtaaagtatctgtttctgaatagagatgtgtatagtggctgtcgaatccatcggcgattgaccgtgacgatgaaacatgctctatttacaaatctgtgatggaatagaaaaagctaaaagaaaaagtgagatcaagggggagaatgttagatagatctctctccccttgagcccaacggctcaagggggccttgaccgcgccctgatcgggggcgcccagcccaatggctggtgggcccccgtcacactgcgccatataaaagaggggtggaggccggcacggcacatggtacgagattcaccgccgccgccaactccaccccacaaaaccctaatccgatcgagagggggcgcagccagtgacgggaaacgccaccggcgcgccacgcctcatcgccgggacgtctacgaccaccactgccgcagccgtcatcaccgtcgacctcaccggcgccgcatccacgtcaagccgcgacgacaacgacgatgtccggcgcctcttcctccacgaactcctcaaccggtcggtatctaaaccctctccctttcatctacaatgtcgttcatcaaacccaaatagaaccacccgactagatctaacctaggtgatcctagagcaaagtctaacaatcaccaccagagaaacagatgatatacgaggggaacaacatcgttatcagtatggcagaatcccgagggctctaccgtactccaagaaggcatcatcgtacatctcgtccagcgtcctgttcttgaactcgaacccttctccggcgagcttctccgacgagaggcggatcctcggcttctccgggaggtcgccgaggctgcatgaaagttcaccatcgtcagagctctcgataagatcatggagacgcatggggaattattactcagtgagatcagctcgatcttacgcggcgacgtcgacattgtactccgggtatttggccgccaggaagcgggcgagctgcagcatggtggcgctgaggccgcagcagatgtacctctccgccgccgccgccgccgccgccggcggcggcttctcggcgaggaatatctcggcgcggcagaggtcgtcgacgtggaccagcattagcccgccggtggccttctccatgagcttcacggtgctgatcatctcctggtcgcctgaaagaaaatcaagagatgaacaaataaatttcacaggaattgcttttcgttgccgcatttgccatggaccggccggttcttgattcgattagttatcaccggagagcaaggagaggacggcggcgacgcacggtttggcctccgctgccggcgccgggccaacggtgaccaccgggcaaacggtcaccaggctgatgccgttctcctccgcgaccctgctcgcttccttctctgaaagaaccttcgaaagcgagtacgcctgcattgcatccatgtcttaatattttcgatatgcacaaatctatcagggacccaaaaaagtttgaaatttaaacaaatcttgaccgaatttaaatatttttttctaaattaaaaaaaatatgaaatatttggatgaagtaaatgcttgccggaaatttcgaaccgaaattgtaaacgctgattgcatcagcacacggagctgttctcatgtggccgatttaatgggctctgagcctctgattgactgacctgtgttaaataaaatctgtaattttgtgtgtacctttccgggagatgtcttgttggctggtgagctgaggtagtcgacgtcggaccatgacgactcgtcgaggacatggccgtcgccttgcagcggcctgccggagacggcggccgccgacgatgtgaggaccacgcgcctcaccgtgccggctctcacgcacgacctcatcacgttcagagtgcctcgtacaccggcttccaccagttctttctgtcattaccatcaggctgaccaagtaaaaaacaaaactactcccttcgtacaaaaaaaaaatctataactgattatgatacatttagtataacgaatctggatagagatatattcagattcatagtattaggatatgtcacatctagtactgattggtttctatgagacagaaggagtgcgtgtatgtgattctgtgtatgtgtctgtgtcatcgcaacagaaagtagcattgtttcgcttatttaaatcgcttattagtaaataaaaataaactatgatgagaaaaagatcaaacttaaaattaagttctaaattttaaatgttagcttgtaaatgtaagcataagccaacaatgaagagtgaagtgcaaagagacatttttatggaggaatacttagtatcattaatggcctggcaaccataagagacttgaggagtggcaaccaccatctagctaaatccataaagataatcttaaaatatgtttccccttcctccgttttatactataagatgatttaactcttttctaattatgttttattatgataagttcataaaaaaaatacagaacatttctcacatataacaaacataccatctaaatacattcaaagttatttttaatgaaactaatttgatgttataaatattattaaattttctataaacttaatcaaattgttgtagacggctatgtaatacctgagggttctctgacttgaggttcaccggagcagcgacgaggaaggcgtaatcacagccggcgaccgcctcgtcgaagctgccttcctcctccaagtcggcgcggaagaccgccaggggaccaagtgcgtgcaagtccttgaagtgggagttcttctccatgttttctgcgactcaaaattgcaatgtgtagcagcagtttcagaggctaaaaccaaattccctttttaaaaaaaaaaagaaaagaaaaacgaggttaaaaccactgatgctactgcaaatctatgcacgagtatgcacgaaattatgaactgaagaagaagaatctcaccggggtttctgactgtcgtgttgacagcacatcccttctgcagcagcatcttgatgagcgccgaagcgatgtacccgttgccgccggtgacgcacgccgtcttcctctcaaccgccgacatcgctggtcagtcggctcgatttcctactagcagagaacgatcgagaattccttaacccaatagaacaccaagcactgatataatggtagtggtttgatgattgtgctaaggaccagtctcatcgaagcaacaagagggtgtactatgtccgtgttgaatccggatcagctgcagtcgctactgggactgcaatttaggcggtaccagttttcatcaacggatgtagatggaacggtccagatcagcgaggtgcactattcatcgtactgtagcataaatactgtagcacagaatataagttgcagtaatagctataactgcgcatgatctgaatccgtctgtgtgtatagatccaaagtttggatctaaacttcaattctttttcatcacgtcaacctgtcatacacataacttttcagccacatcatctctaattttaaccaaaatccaaaatttacgctgaaataaacacagcctatataggagaggtgaggttgctggcctaatcgaaacagtctcatcaaagcagaaacagagacagcatttatcatatcgtaattgtggctctcgctggagtcactgcaacgtatagacactgggccaggaggacacgtgatgctgaaccttctggatacgagtactgtccaaattcatagagcaaccactgtgagcgatgatataccggcttcattctctccactcacaaaagaatacaccagcacttgaaaaatcgatgatacacggtttgtgaaaccatatttgtatacgaaaatcattaactgaaggagtcaaaattttggccagtagaccacaagaattggcaaacgcaagtacaaaaaatccctcatttccacgccttccgtcctctgaattgctttcccgagcgcttttgcagttttttcttctcctgtcgagaacgcgctgccttcgctctgcttgcagcgaggggcattttcttcttgtgttgtttctgcctattgctcaagccaccggtctaaaacgcaatgagaagcatataagtagagaaggaataaaagcaactacgaaagaacaattcatgatcagatttcacaaggttgtgccatatagccaacataggtcaaaataagcaccaaaaaggaggatcatataaacgaatacctttttctgtttcacagctgttcttgcttggtattttcctctatcctctcttccagccttcaccatttctaatctctcctctttcgtaagctttctctttatgtgagcctacataaaggaagatgttcatataagcaaagtgtggatgtgtgtgcatgagcgcgctggcacgagtgcaatgcgggaggggaagagagaaaatgcacctcaagcttggatgggtcaacccgtttcagactaagctgatcagaagaaggcattttaaaggttactgattttgtgtcatggcccttgccgagtccatgttgtgccagagccagttttgcttctttttttgcctgaaactcataacaatgtcagatatacacaacttcactttctttcccaaaagaaagctccacagcatgaactacagctggaaaaaactcccatacctttagctccttaatacgcttaaaatcttcatcagataagattttaccagcttcatcgcacgaagcttcagccttcttggctcctgccaacttcttcagagctcgaaggcttgcatctgcagcattaagttgccctatataatcactcaactttctcttatttgccttgcgactgctgttttttgacttatcatcctggtcactgtcatcatcctgatcagagccttcatcagaatcatccaatttctcactgagttcctcatcatcatcagattcagatacatcattctcctcatccatatcagagtccaattctagctcatcatcattttcttcactatcattgtcagagatgtcttgatcctcatctagttcctctgtatcatcttcatccccagatagttgatcttcctctttcataccttcatctgtgtcaagcttgtttgcttcagacgaaccatccaaattttgtttagtaccacgagcagattgcaactctttctcatcattagaatcaaaagcatcagactcatcgtctgagccttccccttctgatgaaaaatcttcatctagcaactcagctccaggcacatcagaagcgatagttgcttcgccgaatgcttttggtcgagccttcggatcagcaggacgcccacgatctttcttgactagcagagaaggacagatctgaacccaaaccaaaagaaggtttagctgaagtgaacaaaaagaaatcacagaatatgcaaaaggataagaactgacctcccggaataaagtaattagagaacgagcggcaatggaaacagctttttcatgggactttttgtataaaacaaggtcctggagtagatcttcattcatcaactgcaggtataacagaaggattaacagaggcctgctagatgaataaaataaatagaccaagaatatcttcctaaatatcttacaacccgcacagtacctcaggtggtaatgtagtatacaaacctgcatgtgtgttctcaacttctcatgcataagtgactaacgtgtcaggctacacaagactaaatgtggcctggtaaaaccatgtttataccttttcaattcttcattaagttacacttatatgcttaaaacctgtagcaatcgactatcacatccttttggagtttggactacgcaaccagtcatttaagactagtaaaaaaatgaaatcacaatttctactagagcatgtccagggcacaggaattaggtacaacaaaacatgaccaccataaaaatttaatgaatccatcacacaaatttaaggggtgtctggtcagaggtcagtagcactagaaagcaagagtacagatttgagcaaggtaagtaccaaaggtattctcatgcagatctctcgcacaacattcaagccaacagcaatagcctaaaatgagattggttagaaatatgccatgttagttggaaaatacttaaatatattagatatgtgatgagtgttatgcaaacctctgggcgagaacgatcatgcacaaattgatttactatctgcttaaacagtggttcaactgcatcaggaggcacctgaaattgaagcatattaatttagctgaatttggacaaagcaaaagaaatgatataagtagtgaaatataggagaagagcaaaagtgtttcaaccatatcatggcaagcctgtactgctgcagcaagtaaagttgttacatctcgttgatgaggctgcatcacagaaaggtagaaaacttattatcaaaactagtatgaactagtataatgcacgtgaggtgcaacggtttttttttctaattgtctattatattatcattatgctaattttgctgtcatttcgtaaagatgaaaattttcataatattctattgtcatattttcctttcgacgggatctatggcatgtgggggctaagagatacgcaactcacagtccgtgggtccaccaccactaccatcttttatattagtatagagtatagataaacattatatctaccataaggttgctacaagaagaacacatgccaagttaagaacatacctgaacgtatctttgaagatatggatagaagttcaacaaaaccaagtgatgcagcccaatagtcctcgctataacctttaacatcatcatccttacctgcaagcacccaaccaacattctctaaatttgaattaacgtttattttcgtttaaccatcggatggaactcacaacagacattgtgtttaaaaaataaactattgcacatctgggttccaattctcctacttgaatgctggttccaactatatacactcatgtataaaacttcagcagaaagctaaaagtactaagtaatgatagttctgacaattatatataactttttaaatctttacagaacaaggaatcttcagaacaaggaatggggccaacctcaaaccgctcattgcatttctggagccgagagaagagcttctcagcaaaaccctgtcagccaaaaaacgaaagcttcaatataacagtcaatatgtaaatgataacactctgaacaattatgggattacaccatttcccacctgaggatcctttaaatacgtcagtggtgaataataattggagccagtgtcctcagtggatttacgttgttgccttttcatactacgaatcacacgctgcaatttagctttcttctttttcttagtagcagcagtgcccttgtgatttgcctgagaaagtaatatgacaataaaatacattatatcagaaggcacgtaacagaaaaaagatgtaaaacactataaatcgaaataatggtaaaaattcaaataaccttgtaaacatcctctttactaagaataatttgagggttttgagcttcatcttcactgctggatgcatcactatcatcttcttgctcaacgttttcatacccaagaaggaatgaaatagcggctatcataattctgcatgtaaaagatatattttagatcaacacctattaataaacacaaagatgctggcagtatgtacctagaagaaccatggaaacaagcattgcatatagcatttgctgtgcggtcatcaaaccagaccctccgacggtgaagatcacatagaatagtaaaggccctctttgctctcgactcttcctcgccctgggaaacagcgaagcaagatgcataactaaacgaggtaggaagagaatcatgaatgtattcttgccactatgttaaacccgataatactaatcagtgcaagtgtggtatagtggtatgtcacaaacctgtaggaatgtgaaaaggatgttttgcagtttacgattcctggcttcattcttgtgggtctgattcattctcctgatactgtgtacaatatgtgagaatgctagttttttgacagcccggtcccctataacttgaagctccataaataactccattgtgtcctccagatcaacaatctaaacatcaaaaagcaatgtatacgaggagaatttactctacagtcatacgataatcccgttccaatccacacgatttgaacaaaatttaacttaatgtgaaatgaacagatgaactaaacaggcgtcaccttccgattcaccagtagtatcagcgcctgcacgaggtgcacacggagcccggacggcagcgcgcgcgcgttggtgtcaagcaggccaccaatctggtcgggcaagtcagcgaggtcgtccgggtagaagggcgcgacgtgggcgaggaacagcgcgaggtcgccgagctccttggccaccttccctccgccgccggacgaggacgtggaggccagtgccgcctgctgccggaagaggaacaccgatgactcgaagtggcgccgcagctggcggagctcctcctcgtacccctccgggtcgcgcttcatcttcgcctgaagcgccgggaggctctgccgctccccggccccgccggtggccgacgccgacgccgcctccggcgtgaacgccggcgcgtgctgacgaggcatcggagcggaaaatccggtgtcccccgccgccgccgccgctgaggtgagaatgctaaaaccctaggccgccgcaaaacttcccgggagaaccgatggcaagaggtagtcgacgatgcgagtgactgggctggccagttacagtacacgtccggcccattaatctagctaaatttggaccagtaaggcccatttttcctccctctagcaaagaaaataagtctaatttgaaagacctcggtcaaattgcatcaatcaaccgcaaaaccgggtatatcgcactctccaacttcaaaaaccggtataaatcgactcctttgatggtttgaaaatcgattttctactgatgtgttaaattaaccgtgatcaaacttattatatccgaattttactattgaaggagacaattcaattagaagcaagagatgagggaagaaaaatatacttagagcctctttatttagggaattttttcttggatttttaagtcgcctttttagtttatatgatttataggctaatggattgaagtactaagtttaatagtagggtcataactctatctagcgtaagaaaaaaaaacttcttcaacataatttttgatgatgagtacaaacgaaagaactgcatatttgttaagcttagactttccagctcataaggttaagagcctactataagcttcaaataatctatagtcaatctaatagttaatttatacaatagttaactataaatatacactaggggtgtgtttggttggacttttcaacctgcttttccttttgcaaaagtcaagagtcaaccaaaggacccaaaagcataagtgcttttgctccaagtgcttttgagggaaaaattacccacctctgccattatgaaaaaacggtccgatattcttttcctcgtctcctccttctcgcgagtcgtgacttcatggggcgagcgtcggccatcgggcgcattgggtgtccgccatcggcgccgcccccgcccttccccaaccgacgccggccaacctgatgtcggcgcagcccccgcccttccccaaccgacgacgcccaacccgacgccggcgcagctcccgtccttccctgatcgatgccgcccccgcccttcctcaacagacgccggtcaacgcgacgccagcgccgctcccgcccttccccgaccgacgccttcttcttccgacgccgccgccccttcgctcgtcggccatggaggtgggagacgaaggtggtgaggtggccgacagcggtggcgtcaccactgcctcatcctcctggcgccaccgctcctcaccaccgtgcgtcctcttcgtcgctgaaccgccgctaccgctcctcctcgccgagacgccgctgccaccgctgaggccgacgacaccgccgttgccatatccatctctccctcttcttttatttcaacgtgtgtatgacatgtgggggtcgctgtcagcgggactagttatttcaaaagccacagctattgaaccaaatgagcttttccaaaagccaccgtacatattccccagctacttttaagaagggagtacctatacatctttcgaaagatttttataatcgtatcacacagatttttaatctttatattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatgcactgtaaatttgaatgagaaaatcgagtgagagataagaaaaaaattttcgagtgagatatagcaaaatcgtttaagaaaactacagcccacagatatttttttcaaagccagagctcaactaaacacaccttaagagcttagactttccagctcataggcctaaacaaagaaggccttcttcctctcgcgaaccacgaggcccagttggctagtaatcgttcgcggctagccggcccaccggaccagcgctttccccgccggcgtcgcgcgtacgtaggagacgacacgacgacttcttcgtgagatcgcgcgaaaatcacgacctcaaccgtgcgacgggggcgcaagcgcgacatacgcagcgttttcttcccacccaccccgcacgcgcggggaccggaagcggtgacgcgcgacggttgcgcggtcgttttcg

SEQ ID NO: 18840 - DNA, 4550 bp, Oryza sativa
  unsure (1)..(4550): unsure at all n locations
nnnnnnnnnnnnnnnnnnnnnnnnnnnnnnnnnnnnnnnnnnnnnnnnnnnnnnnttnnnnnnttctgctcttcccccacggtcgcgtggtcctttccgacgcccccgtccgtgacaaagccaggtttggtggcgagcgaacgagtgactcgatcatgccccgggtcgccgtcacgcagcagcgccctgtgtctgcccccgctccggcgatcgacggcgaccgatcgatcggcagctagcgacgcccgagcttacatgcgcgcgccgcgtcacctttccgcgaccgatcgatccgtcaatcttccgctaccgtgtatacgcagcagtgtcggctgggacatgtacatacattatactaaaatacagtactacgagccgctttctgaaaaagaaaacgaaggccattattttcctctgtttcttctcttgtatttttctggttgcagcacagacgtcgtcgtcatcgttctatggagtcatgtacaaacatatttaaaaaagtcaacggaaacattttgagaaggagggagtattaaatcagcccgcttgatcgatatgggacctgttttctttttctagaatctatcattaatcagaaacgtacgcttagctagcagaaactggtagtctggtacggcgttctactgtacatacatcttggcaagaggtacaccggtctaacatcgactataccattgtcacgttttgcgtgaactgcaagagaacgcatcactgggcatcgctaggccactatcggtgccattatgtaggagtacaaggtaatcaatacactccctaatcaaaacaggattgcaatccagaacagcggtgacatctgtattaagctcgcagatactgtaccaattataactcgattactcaaacaacaaagcactggcactttagtggaccacgtttggcaaggacgaaacgtggttttaaggcgaaaaaactcaggagctttgagaggggacagcagcggtcatgctcttttcccccaactaataaagcaccagaaatagtaaatggctagctgacaacgtacgccaagcatcattacaccaaacccccttcacaaatccatctttaaggccctcgtctgtgggccaattgtcgaaaatacgtcgtacggcgcgttagaaaagaatagtttataggttaaatttttctatatactagaaaaaaatgcccgtacgttacaacgggtgaagtcgattttaatcttattattgttatatgttttagttaaaatgaaattcactgtgagagttcgctttatatatttttagaaaatcatgagctatatttaggagtctaatcatctcaagttagcatgcaagttttttaaaacaaatttcttatatgatttcttctgtattaccaaaagtggacgattttaaaaaccgaatcaaatacggatacatatttttaaaagcaaacaaacttaaaaactgacgtatacacatatgacgtaccaaaataccgataaaaacatcttaaatttttataatagtagagatatgttcaatgaaaaaaattaaaataaactctaaaatttaaattttgacagcggttaattctatatagaggaaccaatgggagcctaagctcttttcagttactgtctgttggcttatgatgacacgctttttatactgtttgtaaaaaacttctctatatatatttttaaaatagtcttttaaagaaactataataattaagtatttaattaattataaactaatgatcttctcgtattgcgtaagacaaataagatttgaatacgctctaccgaacgcaacctaaaccggtaaggcacaaggcaattaagacctaatctcgcaacttgacgagacgagacaccaatttactaatactaacaaacagcaaatttctaattagcatcgcgtcgattgtccgatcattctcaggttccagtgcgcgaggtgactgacaagctagcttaactattcgttgagatttcaggaagaaaaagctgtcaaaagcttaataacaagacgtggcacctctaagctgttgattcccgaaaaggacaaagaaaacgaggagagcaacgtcgcaacatgccccggcccggcccggcccattatcagcaaggcccaaggcgacgcgaatctcgaagcccacaacatcgaagttgaccgttcaacagaaataccgaaaatacccctgactaaccaatcatattacgcgaatgaccctgcccgagccggccagccacttagacctggtcaccgccggcttgggctttaaactaacaccagtggcattgggtgtaaataaatcgaaatcggaggggtggggtgggtacccctgatgcgtcagcgttcaaaatatttcgaaatagctcggccgcctcgtcctcttcttctccttcctctctctctctcttctcccacacatctctcgctcagatccgagcgaggcgagaaatccatgaaaaatcgagggtaatctccgctcggtggcttcaaaaacttcgaatccttccccaatttcatcggctccgcagtttttttctcgaggtttttcggatctaaagcgcggctttgtcggcgcttgtaagccacgagagagagagattcttgtgccttcgagctcactccatccggccccaagaaagctcccctcctcccacccaccgccaccactgaggaggagagaaccctaactataacccctaatcctgccactaatcccagttcatggcctcctccctcacgccccgtagcccttacccggtaattttctctcttttgtggaaagaaatcgcctattttgggggagggttgattcatgggagcttagttcttgcgatttgtggggtgtggttgttgttgttgttgttgcagaagaaggagaacttgggcaacgcgcggcgggggatgggggtcaagcctggcccgcgccgcaatgtcctctcggcaatcaacaatggcggtggcacgaacagcgacacggcgtcggtggacggcggcgagggcggggctgggccggcggcgcctgtgatcgagttcaccgggagggaggatgtggagcggctgctcgccgagaagatgaaggggaagagcaagaccgactacaaggtgggttcttttgggggatttcttggcgttcgttctgtttgagaatttttggggggcgggtttcctgaatttggttggacctgtgcaggggagaactgagcagatgagtgagtacatcaagaagctgagagcttgcatccgctggtacattgagttggaggacggctacttggtcgagcaggagaagctccgtagtacgatggatgcagagaatgcccagcacgccaagttgggtaatgaattcgaatgcacttctcttttttttgtatttatttgatcacaccaagagaacaagatggtactcttttgggttttgagcattcatgtgtgctgtttggtcatcagagtaccatctcatcgtagtgactgagtttattctggtcatttatgttcttggggtactgtacttccagaggcccagcttagcagtgatctggaagagctgaaagctgcacacctgaacttgacgcggcagtgcgattcgttggaggaaagcttcaacaaggagaaggccgacaggatggttagaactcatctatcgcataataagctgcatagttatgtactgttgctgtgtgcctgtgtgattggtttcagccacggcttacacttgttgacctttaaactggcagcttgctgtggagtcctacgagaaggagaggcagcaaagggaatcggctgaggcgtccctcgacttgctgtcggtggacctggaaagagtcagccatgaagcaaaacggtttagtgagcaagtacgtgttcagaaatgttctattagtcttacatgaatttgagtcatatataatgttcctttctgatggatggaaattgtgaactagctgaaaatggtccaagacacgaacaaaagactgcaggagtacaacaccagcttgcagcaatacaacagtaatcttcaagctgatgcctctaagagtggggacatcatctcaaaactgcaaaaagagaagagtgccatgatggaaacaatggcttctctgaaagatttaaacaattcaatgaagaaccatttggattcttctagggtgagttgtgttttttcgtgaattgataatttttttgggcagtatagttcttgtttcacttaaacatttaattgttttgatttctgttagacttctcaacaagaggccattagaatgaaagaacaacttatgaaagaagtggattgccttagaattgagctacaccaaattagagaagaccgtgatcagtctgtttctcaagtaaataccttgagtgctgagcttgctaattacaaggaactagcaggcaagtctacaaaagactgtgaaagcttgagtgtaaaagtgtcagcctttgaggttagtggtttcagattaaccaaatcaatactttctgtgcgcaactatttggctcannnnnnnnnnnnnnnnnnnnnnnnnnnnnnnnnnnnnnnnnnnn

SEQ ID NO: 18841 - DNA, 2207 bp, Oryza sativa
  unsure (1)..(2207): unsure at all n locations
cacaatacaatattggtaattgtttcagcatactagcacttcttactaaaaacaatttctctattttactgacagaagaaatttttgagtaaatactgaaattttttcatcttgctattgctacttgttactgattagcctttctatttgcaggagcttaaaggaaacatcagagtgttttgtagggtccgaccacttttgcaagacaacgattctagtggtgcagaagaagcccttatttcatatccaacatcagttgaatctgccgggcgtggtattgatttgatgaaccaaggtaaaatcatattcattgttgaagctaaacagaaactatgtttcccccactaagttttcagtggtaaagttaatcggagacttcattttattgttttgtgttgatgtaggtcagagattttccttctcatatgacaaagttttcgatcacggtgcttcacaagaagatgtgtttgtggaaatgtcacaactagttcaaagtgcacttgatgggtacaaggtatgaatatttcactacaacaatgaagtattggtgaataatctgttcatgaggttcctgtctctaataactcaaatatcctaactttattttttttatttcaagaacaaatgaaagttgttttaattgatatggtggcaccccaaattttatctcttcagcaccaccacataagcacaaatacatgctaaaagccgtgaacatcttacattgatgtttctagtatatatcacctgcattctgcatttgtataatcaccattatcttgaaactctgactgatgtttctagtttatttcagttttgaagtacttgtcaatttggtatgcttaagttatttttgcatgatgcaggtttgcatatttgcttatggtcaaacagggtctggtaaaacttatacaatgatgggtccaccagggcgtgatcagaaaggcatcatacctcgttctttggagcaaatttttaagacaagtcagtctcttgaatctcaaggatggaagtacagtatgcaggttagtatccatagtgcaatgcagattctgaagtgtacattctatgtagtgttgctgagagtttttcctatgtgcaggcatcaatgttggaaatatacaatgagacaattcgtgatttgttagcacctggtcggtctaataactttgatctgtctaccagtaaacaatacaccataaagcatgatccacaagggaacacaaccgtcactgaccttactgttgctgatgtttttagtagcgccgacgtaacttctcttctagcgaaagcatcccaaagcaggtaaatacgctttattcatttttaatcattcacttgtgccttgtaactgtttgctctaagggtattgaccattatcagtttaatgttatatttgaaatagcaatgctttggatatgtctagatgattctctcatctatcactcaaatatattagagagagcagaaacataagagggtttaccttttatacaagctagcacttattatctgaattcacatgtgtctgttagccacctagtctacatatcaacagtgagtctaaattttttttcaccacattgaaccaggtctgtgggtaggacccaaatgaatgaacaatcttcccggagccattttgttttcacactgaagatatctggatcaaatgaggtactcgcttcacccatattttagaatattaatcacagtgctgaaactttacaaactggtcacaatattttttttttcattttcatgctaactaaacagaaccactgaaacttgagcaaatgtatgtcactaattttcttttgatcttaatgcagaacactgggcaacaagtccaaggtgtccttaacttgattgatttagctggcagtgaacgccttgctaaaagtggctccacgggtgatcgtttgaaggaaactcaggtnnnnnnnnnnnnnnnnnnnnnnnnnnnnnnnnnnnnnnnntaatcacattgtcttatctgtttgttttctttatgtttcaggcaatcaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18842 - DNA, 1692 bp, Oryza sativa
atcagatatatgccaggcttcatcctaaccattacaagcaaaatgtagtgtgacccagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataattcttattaatagatacaattgatttccaggactctatccatgcgtggcaatcatcttgaagcacatcaacctgagccggacgtcgcgcacaagttcttttgtcagaatcgactgtatcggcgtattta

SEQ ID NO: 18843 - DNA, 1926 bp, Oryza sativa
  unsure (1)..(1926): unsure at all n locations
catgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaannnnnnnnnnnnnnnnnnnnnnnnnnnnnnnnnnnnnnnnnnnnnnnnnnnnnnn

SEQ ID NO: 18844 - DNA, 21872 bp, Oryza sativa
  unsure (1)..(21872): unsure at all n locations
nnnnnnnnnnnnnnnnnnnnnnnnnnnnnnnnnnnccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggaggcggcggtggcggtggaggcgaggtgaagcggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcaccgcgctgctcctcgaccgcttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcgaggctggcgtgcggggtggtggggatcttcggcatggcggcgacgtacaacctgctgttcatctacacggcggagctgttcccgacggcggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatatcaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccacggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcagagcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcccccccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaagacggactggtcgcacgcgccgttcgtggccacgttccgcgacgtccgcgtcgagggttgcgcgtgggcggcgaacgccacggactcggacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgtcggtaaccctttccatataactcgaccagtaaaataaaaggaattgctaactggctacctgctgatctaccctataattcaccaacttgttttactcatctttcactcttacactcttacattcatcactcaacggttgagatcatccctgtgaaatccaacgctccatgtcatctccacctcccacctcgcaccataaccccaacccgactcccgtcttccacgcgattcttcctcccctttccttcccgtcttccacgctacagattgcgcctcctcaattcctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccgcccgcagtcacaacaggaggatcacgaatgcaaagattggacctgaaatcagtgaacaactgcacaagcagccccttggtcatgatatcggtgaactgatgggacgacggtacatggagcacatggacctgtcttagagccaccttctcccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttggacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtaagcgaaggcctgggttcattttaggaaggaaggcccagcagcccagtacatgacaaccatgtgcacag

SEQ ID NO: 18845 - DNA, 719 bp, Oryza sativa
ctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttctttttttcttcacataacatgtctaattccgatcatgtttattgcagcgtcgttacgctcacgtccaggtgagacgaggttacccggacttcgtgttcgagtttgaccgtctcctgccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcactgcccgcagcatgtgatgagacagttcggacttaggcaggtgtttccgggcaacgtgcagccgaccgtcctccttgccgaccactcgtgagttcggattgttcatttctaaatttttatgataattaagcgatcatcgagccatataatgtacctctctttacatgttgactcgacggggacagcttgcaggcgcactttgggcttcacgtgtacagcaataccttgacgactgggtgttagctacagaggaagtgatcaacgagct

SEQ ID NO: 18846 - DNA, 1396 bp, Oryza sativa
tgtattaggcatactctccggcctcaattctcccaacgtcaagtatttgtcatcacagttcatttgatgttgatgttttagctatcccagcgccaaaaatttttcactcgagggagtaatttagttcattgattaataaatttcaagtaaattttacaaaactatataattaaaaatgggtatcataaatcaacaaatttagcgtgaaatttatcacaaagctataaatttaaaacatcatatcacaactacatatttaataataaagttgtcaaacaactgcagattttagagtctatatccatagcactattgagattatcaaagttatagttttgtgataaaaccaatgttaaatctatatgtttctattatgattccttaaatatatagttttgtgataaattttcttatatacactttcttaaatctgtagtttcttaattctgtaaattgtgatagattgttcaaagggactatctaaaattctggcgacagattttttagaaaaaaactttcaaatgtaattacagtgtaagttatatgtaattacagcgtaatttctatgtaattacagtttaagtaatgtgtaatttttgttttaattcaagtttggataactgctcacttggttgagtcgtgatgcgtgcgaccagttggtcctaggatcgaatccccgtcttgcagttttctgtgttttttatctctggcagaccagaaatcgaaagatatccatagaaaaaggttgttcaaatatctatagatttgtaaaatttaatctacgatggtaaaaaatgcttctgatgtggagcttgtcagaacaacgctatggatcaatctacagactacagtacagtactgtctggaccatgggccccacggatcaactccacatagaagtgaaacaacattaacatcatcttgtgctaacatgtgttcattattgatgaacgctgcttataaaaatttacagtgccggttcatcaccacggctgctcacagtagctcagatcaatcaactacatgagaaaacatcaaatttttccacagaatttactgggcgtgtagctactggctaacgactttcactcagctgcacagattgggatcacattggccactgaaacctgaaactctcacgcttcagagaccaaactgtctgcctcggcgtcagacggctgcgactcgtgcttcgcggcggcctggagaacccggtcttggaccgccgtcgtggagggggaagtcgccaagccaatcttgcttggctccagcttcttggccggccacgagaacgcctgcgcgcctactcttaacggggaaagcagcagtctatgcaatcacatggagaggagtaaggggaactttgtaatttgcaatggtttttttttttgtcatg

SEQ ID NO: 18847 - DNA, 1615 bp, Oryza sativa
  unsure (1)..(1615): unsure at all n locations
tgtcgtgattcagtacaacttttaaaagaaccattcttaaaaaaatataatggaaccaataatcaaagagaaacaggacagtgtgccgactgccaacagaggcaaaagaaagtaaaaggagaccaattgatgtttatgtaccaggagagatccaaggacaagtgttggagtgggctttatgtcttcaaggatttcctctgcgtcctgcatacattcaaaacaatattgtgagttttcgacgttaatagtacatagtgataacaaaaagtgctacctctacgtagtattcaacgctgatacatacaaatttttggaaaggaacaaagaaaaattgtgaccaaaaccttatacgcttcttttcattcaaacatgaggtttttgtctgaatttttacctcatttattactgttaatgcggtctcaggtttcaattctttcactcgaaggttctttgcccaagattggaaaccacctttaacaaggtaaggtcgctgccatcaaaacagtcaaatttaggcaggactcggatcagtgaaaatgaaatatttttgggagaaactgcattggaacttacctgcacaccaagcttcttcagtaacctagcaatggcctttgatcggctcccattagcatccataattataacctttgaatcaccctataaaagaagattgaaaacatacttcacttattttgaagaaatcttagactgaagatatcaaatccaagttcaggcaaacatcatactttgaccaacttcaagttgcggatgataactgcgagcaacgcatcatcaacatctcttccacttttaagtagcctctttactgaacctttaatctaaagaaaaatatgtgaacttaatatcagtaagcaaaatcagttttgtactctcacccgtttgaaattgaaatggctgactgctgctagagttgcataagtttacttctcagttttctttttctagaatgaaaacaactcctaacattattccaacaaaaagaactcattgcatacacttcaatcctcacggatatacataaaaaattggaactgagttcaggttaagtagacatataaactgtccagcaatcaatggctggtagcacttcagatctccaagttcaaacaaagacacacctcaggtgaagcagcagttgcatatttagatctagctgcacggcgtagatccggaattccatctttcactctcaagtcctacaaaaaggattccatgataagctgttacagttgcttttgaaatactaatgatgaatcaaacacttgaagttcaggtacatctgcatgtaagcttatattctcatgctctagaggaaacgcatcaaagagttgtagtgctacagtactaaaaatgtttgtactgaatggcttggcaggaacaaactgttctacattggcaaaggcatgtaggtggctaacaaacaatattatcttttctacggtttgcagaatatatcatggaccggatataaaagatgaaaacggacatcaaagaaagaataggccagtgagatttacaatctcttgcctnnnnnnnnnnnnnnnnnnnnnnnnnnnnnnnnnnnnnnnnnnnnnnnnnnnnnnnnnnnnnnnnn

SEQ ID NO: 18848 - DNA, 2355 bp, Oryza sativa
atccccatctgctttgatttcctctgttgttggtcagtataagagtccatcataatatgttccatggaaatgctgataattccatcgaagatttggattcaaacttatctcgaaagtgaaggcgatgattcttggaaatgaggcttataggccttgtttggcacagttcccgtctttcggttcttagattcataatagatttgaagtttgtatgttgaattataatgatttaaaaatttatatttcatctaaaatgggaaaaagatgatttatctagatgttatcaacgcaatcgtggatctaaattcataaatgtgttgaaaataactggcaatttagtttaggggaaaaagagaaaagtttcatattggcccaaaaataatcaggcccagtccagtgcgccatcaaggccttaaaccctagaaagcaagaaagaaaccttccgcctcccacctcgactcgaccagtgactcctccgcctccacacattacagctaccacgccgccgccgccgccgccggcgacgaggaggagatgtggcggcgttcgggagctcgtgctctccttctcctccgctcctccatccacaggcctctcccgccgccgccattttcacttcgagccttaacccgagcgccaccgcctcccccccccctttcccgcttcctcttctcctccccggagcccctcccggatgccggcggcggcgctgctttcgcgtcctctgatcccaccgatgccggggaggatggcctcgcctctgatcccaccgaagccggggaggacaacctggcctcgctctgggaggaggacgccggggacgccgacgacgtcttcgccgccgacgcctcccccgaccccgccgatgctgtggtcgacgaggtgctggccgcgcgcgtcggcgccgtcgtggagtccacccccgaggatcagatcccctccgccctcgccgacatggtcgtggacttcaacgagccactcctcgccgccattctcgtgtccgccgccgagagctgctccggtaaaaagctgctccgcctgttcaaatctgccgggaagaacaaccccgcggccaagagcctcgccaatcttgagatagtcgtcgacaagatcgctgattccgatgagatcgacaagatggatgtatatttgctctggcatttggttaaggaaatgggagctgtgcctggatcagtgaatacacaggtgctgaataaactgcttgcgatgttctgcaagctcgagaagtcaaaggctgcattggaggcgtttgacatgttcagtgagttagtatgcgctccggatggcgacagctattatctggcgattcaagcagctgggaggaagtccatggttgatgctgcatggagagtttgcgatgggatgattagctctggctgcttccccgatggcgagaaggtcggtgacattgtgatgttcttttgcaagaagaagaaggtgaaggaggcacattcagtatacatatctgcaaaggaaaagaaggtgcaggctccgacctcggccttaactttccttgttagcgctttggcgaggaatgacgagaccattaatacagctcttgagctgctggaagagtaccagggggaatctcttaaggatgctggccagtcctatgctgcggttatacatggtttgtgtaatacaaacaacgtggaagatgcaaagaaagtgctgatgaggatggtaaatctaggcccagctcctggtagcgcagtgtttaactttgtcatcacggcattgtctaaaaatggagaaatggaggatgcaaagggtttgatgagagtgatggagaaccaagggatctgccccgacatttatacatacagtgtgatcatgagtggctacgccaaaggaggcatgatggatgaagcccatgcactacttcgtgatgctaagaggattcatccaagactaagcagggttacatatcacacacttattcgtggttactgcaagatggaggagtttgagaaggccttggagtgcctaaaggagatgaaggaagatgggatggagccaaatatggatgagtacaacaaacttatccagtcactttgtctcaaggctttggactggagaactgctgagaatctcctgaaggaaatggaggatggtggattatgccttaaaggcactactcgaagccttatagcagcagtcaaggaattggaaatggatgagctgtcaaaagccagccaagaagcatagtttctttttggtacgcttgcagtgacacagctgccaatcaattttggggcagtgctttcttttgctctctgcttctctggtgagcttgtgagaaacatcagcttttgtacttgtgtctgtttgttg

SEQ ID NO: 18849 - DNA, 669 bp, Oryza sativa
tgtagaactcctgtatgagagatttaatgttcatgatgtgccttactttttgtgcatatactcaatcggccccaggtgccacttttgtggaaatttttttatgagtcgatggttggatgaggaagatatatgggggaaaaaaaaggttaacagacaaactaaaattggtgtgcaacctttagttgaaaatggaaaatacaggctatggcaagagagaattttaacccaataaggccttgattggttaatcctcaagagagagtgattggaggggattgaggaggaataattccacaccacaataggtgtggattaaacaaataaggcctaattgtattttactttctcttcactaaagagaagagaggaacattgagtaaagaagtttgtgcagggaataaagaagtttgttttgctgttgtttcatttcatagaaggaagaagaacagccgtgctacttcctttctctcccaaaatggaaatcatgtatatatgaatcttttactgtatagattgaaggggcgagacgggagggaggcaaaggagataacatatgggatgttttcacagaaaacaaaggtttgtttacctgggttctatgtttttggcgcctatcaatttaattaggtaatgttcaaatgcttgtgcttttcagaacgtatcttatat

SEQ ID NO: 18850 - DNA, 3415 bp, Oryza sativa
  unsure (1)..(3415): unsure at all n locations
tactggatgtgacatatcctagtactacaaatctagacataggtatatctagatttattgtactataatatgtcacgttcagtactagtttggtttttttatggagggagtatgactgtagagtaaatttcacaaaactacatgttttatggtccaagttgcagaaaactacacacgctttgacatttggcatttaagtacatatattttggtagtgtagtttcacaaaaccacactatcaataaatagattcacccgtgagatgacttggttgttccacataggacaatgacatgcatcctattaccagccatctcatgaaattaataggatgccacgtcgacttggttgttccacataggacaatgacatgcatcctattaccagccatctcatgaaattaataggatgccacgtcctcatcctacgtaaaataaccacgtcatctcacaggtgaatccattcattgatattgtggttttgtgaaaaaaaaaactaccaaaaaaatatatgtacttaattactattccctccgtcatacaatataagagattttaagtttttgtttgccacgtttaaccactcgtcttattcaattttttttacaaatataaaaaacgaaaagttgtgctcaaagtactgtagataataaagtaagtcacaaataaaataaataataatttcaaaattttatgaataagacgagtggtcaaacgttgcaagcaaaaaacttaaaatcccttatattatgggacggagggagtaagtgttaaaatatgtgtgtttttctgtaacttcaaccataaaacataaaacatttagttttctgaaatttactaatgatagtatgaatcgagaaaaaaaaagtatgtgaattgggtggcaaatttctccaatttcaccgtcaccgcctcattctttccgatcctccgcgccgcgctgctcggtgctccgccgccgccgccgccgccgccgttcaccgcaacgagcatactaccgcctctcttcctcgtcgtgccctagtgggaactgggaacccccgccgcgcccagctggtaagcgtcgcgctcctaatctgttcatcaaattggtcgagaatttggtcgcaatcacggagtcctcttggagctggagagagatcgtggtgctcgggggagttgtgaggctttcctctcctcgcctgctcgatccgccgncgacaccgccgacgactttcttctcacgccacatacctcccgcgtactcgggcagggggcctttccttgtcgcccccttcctctttgctgctcttccggctcggcttccattttcggctcgcctacttcttcatgaattggtcggcctggaaggggtcgtgaatcgtgagagacgcttaccttgcccggtggccgaaaaggctcaagtggtacctggtgggcttcgggttctatttcccaagcaggaacttttaaattttgcatttcagtttaaggtttccgattaaaattacctatgacgtttcaacagataaataggtgttgggatcaaatctcggctaagttaaatccatgttgaattttacttggcaatctaaggttttagtgttacctatatgcgttacttcaatgaggactggagaatgtgaaacattgttattgcaatttgcaactttcaatttcaggaggtagaaaatctctcttggaagatggttcaactcttttttcaagggaccacagatggtggtagtgttgatacagatgctgtaaaagcaaggcgatctcttcttggcaaggtggagcctataatcaggtcggttataaagtctggaggtgggtatgaggctcggatgtggctctgcagtacggtctcatccattcatttgctcgacccatatggccagcgggacctgtttctcaatctcttggggatgaaaaattccaaacgggatgtcgctgcccgcttgctgcggatgatttttgacaaaaagcccaaaaaagcaggttctattatagcaaagaaatgccagatgctagaggacttcttccaaggtaaggaattacactaagaactcgatgctctgaatttttctactgctgctcacatatatctgttttatattcctttttcttgctgcgactcactgttcagtatccagaacatactctagttgagatatatctgtttagggatttacctagaaatatgacatttgttcctctattacagttgcataaaaatattaagcctgtttggcttgttggcaatacaagatatggaattatgcataattgcgtacactcagtttgaattacttcttcacataatgggtagtaactagtggcccgcccctcagtccctcactcatgcaagtagtttaacacattcttagattaatacaaatgtgccatacactagaagaagatgaaatggtgtttccactacagtaacatcatgctttgttcctgcctttttctatttgtgttttaggtatagaaccattttttggctgtgatctaggtctcaacttggactgactgacatgagttggctctcgcatacttgcatatatgattgtatgatcttatttagtgtaatttgtcagagagattgtagggtgagtgcctttgtgtactgaaaacatgctaaacatccatgtaactttttgtgctgtgcagctgtagtaagccctgaatcaaatatacaaagcatattgagttttctgtgtctctgttgcaacccagaaagactggtttgatactggcaggagcatgagcatctattctttctgacatagtgacattccatttattatgttctacagggaatccaaagcagataatgcagtggtttggtcactttgcggttactggtgaattgacacataagaagggtgctagggcactttctcaatttgcatttgtgaatcgtgatatttgttgggaagagcttgagtggaaaggcaagcatgggcagtctcctgctgttgttgctactaagccccattattttcgtgatctcgatgttctgcggactgtggaaaatttcctggagtatgtcccagacttctggtcttctgaagagcttgctgattccgtcaaagacggtgaaatactgcaaattgacacagaatattttgtagatcaattcgtttacttgatgtatgaggagaattccagagatgcatggcagttagttgatgaatttttgatggacgagcagttttcttctctttctcaacatcttcttattcatttagatgaacaaaggcttcttaatttcttgagagctttggggaagttgatcaagctgaattcacagtgcaaggaaatggtgttcccatgctgttggcttgaggttcttttgtcagcatatnnnnnnnnnnnnnnnnnnnnnnnnnnnnnnnnnnnnnnnnnnnnnnnnnnnnnnnnnnnnnnnn

SEQ ID NO: 18851 - DNA, 1177 bp, Oryza sativa
  unsure (1)..(1177): unsure at all n locations
ttgttggtttgtatttgctgcaattgccggtgtgcaaaagtgtgcattttcacctgtacaaagggaacatgtataactgacgatgacaacacaataaagttcttcactcgaaaatgtctcgcacgatcttaacgaattgtactcaaaattcacgtgatgacttgctccatgtcaacacgtactctgggcacatacatgatagatattcgtagccagaaaagttcagaccgattgccactgtccattataattcagcagattgcagtcgcagatgaccctgaccaatgactatatacatggacgaactattttccaaccttgcatagtacataaagcaattgatttttcagacacaatcacattctccgttgttctggcgtgccgtgcttacaaatgtaataatcgagttatctagatatacatttccttgaacctcaatgccggccccagtatgtcttaagcagctaagagccctgaactaccggcttcatcatggccatgtaattcttgctcgcggtaatcgtatcttaggatgtgtaaagatatccatagacctcactttcgactgttatgatctcccgagtagaattagcatgtactgcaatcatgttcagacgaatcagacaataggattagcatgcgcatcaagagttggaacaatgatttacattccagcaactgaacttacctatggggtcatatgttggcagggtgatgtatcgagggcaatacttcttcttcgatacgttttcattggtagcagtagtagtaaggcaatcaaggggctggaaatataccaccgagtttagcaatattgtacaggttttctttgaaaaagaaagattatagtattttattgtacagcatatgcaacatgtgaccatgtgagacattgccaaataacacgtgcaggactgcgcacattcccaacttttggggaaaatattcacatgggtagctagtttgggaaaaatactcaccagtcaaaatttatgcagcacatgtttagaaatttcaacacaacagataaaacattccttaataggggcatgaagaaacacaagcagaaaacactatatgatgcatataatcaccttgaattccgtacagtttagtggtgtttcaacagtgatcaagtnnnnnnnnnnnnnnnnnnnnnnnnnnnnnnnnnnnnnnn

SEQ ID NO: 18852 - DNA, 581 bp, Oryza sativa
ccccctccgccgccgccgcagcggagcagcaacagcaggcgagcgacatggtaagatcctctgctccatcctctctacctcgttacggcccgtgctcgaatcggtcgctgcgtgctgtgctgtgctgtttcgttctcgattcgccgcgttgcggtttggttcgtgaaggttttatgtggtggtagctccgtgggtgattggtagagcggctgcgaggttttttgcgtttgtggcgatggatatgatgctgggttcttgggatccatttcgatccggtagggatctatggcgtcatatagatttcttgcttaaacgacgatgtgttgtgccatctcggtcggcgtgcttcccatttgatggttgctagcatctcttctctttgcggtaacattctgcagtagttcgtgacatccatattgattgttttgttcagtagatccacttaggtgtattgccacatccctgtagtggaagtatactagatgtcacaaacactatctagttgctacaaccagcacaaatttcacatgcttgtctagttctatcagttatactcctacgcatcagagatttatgtgttt

SEQ ID NO: 18853 - DNA, 526 bp, Oryza sativa
ggggatcccgcccaccgcgctgcgcgagatctccatcctcaggctgctctcccagtcgctctacgtcgtccgcctcctctccgtcgagcaggccaccaagaacggcaagcccgtcctctacctcgtcttcgagttcctcgacaccgacctcaagaagttcgtcgacgcctaccgcaagggccccaaccctcgccccctccccaccaacgtcatcaaggtacacctcttgcctgattatcccgtgtcttctccgcttctgggttggttgcctaggtgaaaatcggttgcagcaaccatgttagtgaaaatgaatgaaacactagatgtatgagttttcaaatgacattattgatttttcagtttttttttcactattcagaggcaaatactgggccatggaagtgtggatcaaattaaatacgaaatggaaaaaaaaattaacaatccttatagttcctatgtctctctttttttatatatataatctctgattgttgggggtaccgagctcgaattcgccctatag

SEQ ID NO: 18854 - DNA, 933 bp, Oryza sativa
  unsure (1)..(933): unsure at all n locations
nnnnnnnnnnnnnnnnnnnnnnnnnnnnnnnnnnnnnnnnnnnnnnnnnnnnnnnnnnnnnnnnttcttccttctgcctttcatgattagcaagaagtgcagttatcataatatgagttacattgcttatctgctaagacaatggtttaataatttgataatcggtagttattgctgtagatgatgattttttttcataaatccatgtttgacatagtctgaacatatagctgtgtgatgaaaaattgccatgctagaatttcataaactactttctgtatagtgtgtgatagtttgcctcagcctgtataccttatggtaatttattcagggagtattatgcattaagccattgactaaaaccgacttcttaataggttgttgggaactcctactgaggagcagtggcctggagtaactgatttgagggactggcatgagtttccacagtggaagccacagattttagaacgtcaagtcccatcattggagcctgaaggagttgaccttttatcggtaagaaaactgatctatactggttttccattttgtcactattcgaaattatttaggctgtaagataatttgaagttctccctaatttaatagcttcaaaggaatcttttatgtatgattttggttggttttaaattgtgcccaacttctcttgatttgctaaattgtgttcaatttttcaacaagatgtgaggtgataatattgtgaataatttcttgcagaaaatgctccagtataacccagcaaatcggatctcagcaaaggctgctatggaacacccctacttcgacagcctcgacaagtcccagttctagtttgtaccatgtgattgacgaagtccatgttctgttgtgtcatttgattataaacgtgttgctgttagcagcaaggaaattcgttttgcctacttagcaccc

SEQ ID NO: 18855 - DNA, 1726 bp, Oryza sativa
tcatcatcagcaccagcggaggagttgagagcattcaatctttcgacgagactggccttcctctgttcgtaggttagcttcttgaggttgtatctgagacaaggatgcaagttagttacaatcatacatggacatcacaaatattctttccagaaatcatcagccagattcatgtacctcttgtgggtcgccggttccttcttggttgatttggccatggtaggatcagcacggatggcagcatggaccttcttgtacagtgcttccatgccatcagcatcaattcccttcttaaggtactcactgaagtgggcttggaatttctcaggttcctcctccgccatagactgcaagaagtacataagtagaaattttaaactgatgagaataaaaatcaagcagactgagctaaacagtaacaaattttccagcctgcttataatgttttagtcaatattacaagcatcaaggcagctacataactcctaatacaacacacagcaatgtcaaaatagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccaaagctccctgcagaagaaaagagaagtatatccacatgagctactaatacagatcaacaatccaaaggttatattgacggttgtgtttctaaaagagctgatgaatttgatgttcaagtgacaaatcaactattattacagcagccaacagttgagatcaaagcacaacacaccttgagggcaccaaagacacggtttccagtggttgtcctaatgaggccaacatccaagagagcacggaaaggcctcctttcatcagctggttcaacatagtagtcctccccagtggcctgaccaaaggaatcatacatatcaagatcaagaccagcatgagcatatagagtaaaaaaattataaggattatatttgtacctcaacattgccctcgtactcctggtccaaaccacggagcgtgagcacacgacgagccagaagcaagccagtgcagtaagctacacaatgcatcaaaacagaggaattaaattgtatgcatacagcaagacaaaccagcattctgcatattcattcagctgaggaaactacctgccgcatagttggtgagaccaacttcaagaccataacgaggcagctcatgggagtaggcagcagccatcacgatatcaccagcaatggtagcatagacaatttgagctgtgatatctttgtttgtctaatgtactattaaggcatacagtatgataataataaatatatagtataataaccagaatttacgaggaaatgcataaatatcatgatacaaagaacaaaaaggatacaaatctcacaacgaagcggtacttcggtgtgttgtacttgttcttatcttggttggtgagcctaatcctggccctgtagtcagtcttgccctctgcaaacaatgacaaatgagattaagtacgtcaaaaccttgacttgacttggaaacgcctcggtctcttgaacttgacttacgcctccgtctcttgaacttgacttggaaacgcttgtggtaggcattggtcttctgggtcttgacaaaccctccctggagagacattatcatattaat

SEQ ID NO: 18856 - DNA, 1201 bp, Oryza sativa
  unsure (1)..(1201): unsure at all n locations
tcaccgaggggtacgccaagctccgnctgtcggcgtaccagtcgctcagcgcctgaagaaagtccgtcgacggcgcggttggtggcctcacggcgtcggtggacgccaccaaaaagcagcccgccggtggggtgacgnacgcctccggcgcgttgcaggacaaggtggccggagctggcaccgtcgccgtcgatgtccttaggaaggctattgttgctgccgaggattcactgggcagcgcagcaacatccattggatattactatggatcaaccaagtcgtcgttgccaccgaatgtgaaagatttgctgaactcctccgaggagaaagctagtctagttctgaaaccgattggaggtgcccttcaacaggtaaatcagtggcaagaattcagctcttgttcttggtatgccagttagcattttactgaaattgctcaatctgttgttgcctgctatgattcaggtatatgtagtcgtcgaaggtattgaaaagaatgttggtttggacccaagtgatcctattgttcaattggcagttctgcttggaggttcaaccacaatcgggtaaatgagattttctctttgccatttatagctgacatgttcataccaaatcttcttcttaatccctgctatgttgcaggttaacttactggctcttcgcatacggtggctattccggagacttgtcacccgaatccacactagagctgttgagaaatgatgacaaagccgtacttattgatgttcggtctgaggcaagagattgtaaatctcactggcctattctttctttgatgtccgttttcatcttttatatccggtccatgatatattctgcaaaccgtagaaaagataatattgtttgttagccacctacatgcctttgccaatgtagaacagtttgttcctgccaagccattcagtacaaacatttttagtactgtagcactacaactctttgatgcgtttcctctagagcatgagaatataagcttacatgcagatgtacctgaacttcaagtgtttgattcatcattagtatttcaaaagcaactgtaacagcttatcatggaatcctttttgtaggacttgagagtgaaagatggaattccggatctacgccgtgcagctagatctaaatatgcaactgctgcttcacctaaggtgtgtctttgtttgaacttggagatctgaag

SEQ ID NO: 18857 - DNA, 1011 bp, Oryza sativa
  unsure (1)..(1011): unsure at all n locations
caagtatgatattttagggaatttgagaaggcatttcttagtggagtgtttgcaggtcgctttaaacaccattttgaataattcataccctgggaagcttactggattactaggagtcatgattgtttttatttgtcattttacctaaatgtgcataattgatctttttgactggatgcccatcatgggtatgtgctattgaacttttataacctagttaggaaaagcagctataattcaaccgtttcaaacttgtattcattttgaatatgcgattaattgatattgataaacaactgcagaatgggaaacgactctgcaatacataggtgttctaagccttggtctggtaagtattttccattttcaaactgtcggtacatatcatatattcttctgttcaattgcctggaaagtaaagcaatacagctttgtgccttttatattactactcactccgatccaaatatcatggcaagcggaaacaacacagtttacatgacattcttctactcttgtagactatctatctgcgattctctacgtacgagggttcagaggatctggagcaagatctaaagtaagtcatcctagtatcatccgttctcgtggtgtgcttcttttctgtagtacaaatttacagctcaggtgctcgaaacctgccatttttccaacacatgacaaaaaaaaaaaaccattgcaaatttacaagttccccttactcctctccttgtgattgcctagactgctgctttccccgttaagagtaggcgcggaggcgttctcgtgggcggccaagaagctggagccaagcaagattggcttggcgacttccccctccacgacggcggtccaagaccgggttctccaggccgccgcgaagcacgagtcgcagccgtctgacgccgaggcagacagtttggtctctgaagcgtgagagtttcaggnnnnnnnnnnnnnnnnnnnnnnnnnnnnnnnnnnnnnnnnnnnnnnnnnnnnnnnnnnnnnnnn

SEQ ID NO: 18858 - DNA, 1346 bp, Oryza sativa
attcttcgtgtgtggtttagataataagtagaattactctcatgattcttttgtactagtgatattttcatgtgtactcgaattcttttgtactaagatgcaaagcaaatatatattgctttaaagcgtttgctatgatgctatgctgctgctcctcaaccattcacattcttgcttggaatccatttgtaagttgtagtaacaaaaaaaacccagatgattcagtagtttgacagacatttaatcaccatcactgccagataaatacatgtcaaacggcagagggcgaacgcaacaaaaagagcatccatcacaagttatagaacacatttctagctctttcgtcagggaaatgttgcaaaatggagttgcaatgcagtaaccttgctgctgcagaccattgttgctcaggtatctgctaatctgggtgtactgaagatgcttccaggatcctactgggacgaggggagcagattgattcgaggaatatcagtgtcaccattgacgttttgagtggttttcgacttcaggcgcagctcaggtgaagccaggatggcctcctcgggaggtagacaccgcttggagaagtatgtcgctatgctcttgggctttttggaactcgctgaaaaaaacaagacttattgttagaagggtttcagaagatgacaatgggggcaagattcctactgacaaatgaatatgaggtacagtaccaggagatgaacttaagcctagcttgctaagaacctctttcttgacctgcagagataagaaaaaataacttaatagagcattccaagtatatttcatctctcataatgcgctgctgtaaataacactagcacaaaagcaaacattgttggtatggcgttcttgaatgtgaaagtatcttacctgccaacgattatcaacaaattcagaaatctccctcactttatttttcagttgtgactttgacacattcgggaatttctgatgcagtgactcaaccagcttattgataccatcacggcatgatcctatcaccttaacctgcattggaattgaacaatatgtataagaaaatggcatatccaatcaacacattaccattgaatactaagtgattacttacaatttctgccaggtctgtatctggtatagctgaagcagcagcaggactactcttcacattcaactgattggtctcctcagcatttgcagatgaactatcaataaccgggaaatctgtagtagcacctccaggacaaatgcgcattgaaagaacttgtaggcagagctggtctatcttagaagttcccttgaggtctccggcagtgaataagccaactttgtcatgagttaag

SEQ ID NO: 18859 - DNA, 777 bp, Oryza sativa
  unsure (1)..(777): unsure at all n locations
ggggtgtgacactgatatatttgctacacgtgttgtgatttttttccatgacatttgaaagtggcagcatcttgcattggcctttttctgtattttactttatttacattggtttgtgcctctcttcagcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagacgactgaacttgcattgacaaagcctgtgcaaattgaatcttctggtgctgtacaggagattgattccttgagtcaacaatgtgcaactgaggaattgccaccccaagctgaaacctcaaacttggannnnnnnnnnnnnnnnnnnnnnnnnnnnnnnnnnnnnnnnnnnnnnnnnnnnnnnnn

SEQ ID NO: 18860 - DNA, 637 bp, Oryza sativa
aatgaaaaaaggcatattgcgttactgggtaaacattattgttgaaagacaaaagtatagagtttttacacaggaatttaaacccaacaaaagttgacaatttcagaaaaatgatgaagaaaaaacatactggattgtttgctgccatgccaccatcaataatgttgaagctttgcgatgcacccgtgtgatccacggtttcaaaatagtgtgcagggagaaaggttggtgctgcagatgtaccaatacatacatcagcaagacaagcattcttcaagggcttacgtctcgcctgcattgtagcatatacattagttcacaccactccaaaaaattgtcatgtgaaatccacacgctaactcagtttagagaagggaccttgaatgtgctgaatattattggcttcacacacttcacatcaaaagtgggaatcacaacatttgtcaatgtttctttcatcctcgtctcgccaagaagatcattgattagtctgtgaaggtattttccatcatactttggcccaatggccatctttatgatgcccaggatgttgaagaaccaaccaaaaaatccagtcctggttgcaaaatccagttgacaaaataccatttatattttcatagctagttaaaaaatc

SEQ ID NO: 18861 - DNA, 630 bp, Oryza sativa
aaggtagcaattgccttccttgtcttccttttcaaggaaaaaagggaaacaacactggcttcattttaattttattgcaaacaatccctgaaacttgttctaaacaaacattagtccttttcctcatagaccactttcatatttctgtacaatgcatttttttcatagagcagtaacttcttgtctgtgatgagttttttcaggaagacattgaactcatggccagtttgggtttccgtgcttatagattttctatatcttggccacgcatatttcctggtatgttgagctaatcacatgagagcttcacatacaaaaattgcacatgccatgcatttccagatatatatgacatcctttttttcatcagtaatgcttcagatcatctttctatgattgagactaattttatcatgcctgcagatggcctggggaaaaatgtcaatgagcaaggagttgccttttataatgaccttataaatttcatgattgagaaaggtggcatatgctttacttaataccttacaaggttgcaatgtttctagttattaaccaatgacatgtctggctgtaggtattgagccatacgcaactctgtatcattgggatcttccacataatcttcagcag

SEQ ID NO: 18862 - DNA, 1732 bp, Oryza sativa
aacatataaaagcatttgcaattaaaatgacatgggaaacataacatgagactaagccaagttaaactcatttcaacaactggtgtccccagaaaatgtgaatgggaataactacagtctacagagatagcattacactacaagaaggaaaactagcaacacaacaaaatatctgagtcaatttggctgcccagaatagttggattggttaagagaacagatacaacacaaacaaaaaaaaattgcaatacaactagatgtactaagagttgaacatgatcccagtacactgtactacaagagtatgagacctcaggaaattatgttccatattcttccttgagcttcaagtctaaattgcaattagcaaatgtttcatgttcgaattccaagtcagaaagaacatgattggcgttgtgttcacctgtaaaaaaaaaccaataggtttgtttcagaagttacccaaaaaaaataaagatttttcatgcaccagcacacgtcgaacatcccaagcaactttctatacagaagtacatttaactagttacaaggtctgctagaagaaaggagagcggcatgcataaagtttctagcaatggcttgttctctttggagaagaaacaaggctctggattgatgaaagccgaatacagtggctcaattcatttgtagaaggttactagaaaatcattcaattttgtaaattgccagccacagatatacatgtgccagtgcatgtaagaggtgcagaagaagagaacctagtcttgagcttaagtatgacattggaggaagaaattctgtatcaagatccagttctgttttatcttcaggatccaccatgcatgcctgaaatacaaaaatagtgcaattatcaactgaaagtacacaaatgcatactatattactatacattatcatgtgctcatggcattaacagaacaagatcagcttgtacttatcaccattcctacacgctaataatccatcttataagattcacaaaatggtaggtgaggatagaaatatcaaggcagcctaaccctaatgtaattcgagagtgccgtgctaagatacccgctaactagagagaaatgcttaaaatcattgttggcaacaattcaaaacttctcaatgatattaattcattgccactaatacttagggtacttatgaaatccctcctctccattctggcacatcgccgtgattacgttttgccactcttgaaccacactatacctttgaatgcgcatcgatgcggtaaagactgtccatggagagttgcatcgtccccattgccttctccaccttcttctgtatgcctaattacatacccccaataatacacataaaaaaaggcagtagtaagtactacatcttatcatacgcgaatactggcacaaaggcatccataaaagtaaaataaaaaaacagaaacatacgctcttccagcttatcactgagcagtttctgcatatcgttcccagtaaaactggcagtttcaaccccatccttcgcccactcgcagcatttcatccaatcctcatcgctcaggtagctaggcttcaccagattcttaccagatcccccaacactggctgctgcagtagctttccctcccgtggagctcgccggccgagctctccgggccttgctgagatcacctagggctctgcgctcctgccgccccaccctcgccgccgccccggccttcttgccatcgatccct

SEQ ID NO: 18863 - DNA, 713 bp, Oryza sativa
ctattatgaatctaagaaccgaaagacgggaactgtgccaaacaaggcctataagcctcatttccaagaatcatcgccttcactttcgagataagtttgaatccaaatcttcgatggaattatcagcatttccatggaacatattatgatggactcttatactgaccaacaacagaggaaatcaaagcagatgaggattttattccaagcgacaccaggttttagttacatactgtaagacacaaaatagacattcagattgagctgctcatttccaggttgtatgattctactgtctattgaatccaacaggctacatgtcaaagaaataaaagatacatggatccttcaaaaaaaagcaacaggtagatttgcaatgtaggagtagtagcaatctccacccacacaacacacatctgaatgtgcatctatgcagtgatctcggatttggcattcttaacattttcttcatctttggttgatgccgctgctgctctgtcctgctctttcttctgcgcccttatcagtacacgtcttgcccggggacgcatctcacgcacttggcgtggtggcatcacaaaaggttcaagagggcgatcatggaatggatgctcatttccagaaaatatcctcagtttgcgatccctgtcctgtgatcagaacagtgcatgcttaataagcaacaacagcattatatgaagctttagcaattt

SEQ ID NO: 18864 - DNA, 2157 bp, Oryza sativa
  unsure (1)..(2157): unsure at all n locations
cagctttcacgtagctttgtgctaagtgcaaacttcaccaccaaaccaagccatctgcaactctgcagcaaggccgccaagatagatcatcgacgttaaccccgatgcgatgtttaagctaataatccaagtcaaaatcataccttgccatgctctccaagctactccaattttctgcgattgatgcggtaatggacagtacaactaccagtacaagatccgggtgacaagccaagaaaacgcgcccgcgcgggaggaggaagatggaggagaagaggcagcggctggtgatctctctctcggcgctctgcctcgccgtcgccgtgatgtccggcgcgctgctgccgccgcgggcgtcggcggcgggaggggtcgggaggaagcggcggtgggccgggttcgactactacgtgctggcgctgcagtggccgggcaccgtctgccgccagaccagccattgctgcagctccaatggctgctgccggtgaccccccatccctccctttcttggctagtttcgccattgtcagcttggattgatttgctcacctggtgcttctcccccttttccgtctctgcagctcacatccgctcaaattcttcacgatccgtaagtgtgtatgagttcttgcggatcagaagctaaatttataatcgattgtatcaattcgtgaattcatattcttaaattgttggaatagatgggctgtggccgcagtacagctatgggggatggccatcctgctgcaggccaaccacattcgacggcaacaaggtggctgccaaccacccatcttatcttcagaatgggatattgggatgtggtcgttttcccccccaatttgatgaagaactgctagcttcttgctgtaagattggcatgtcaatgtgggtgtgtatttatctggttttaccttgtgacacatctcgaggttgaagaccatactcgaggagtactggccgtgcttgtactcgcgctctttctcaacctgctttggtgggaaaaggccattttgggtgcatgaggtaaacattggtctctaaatgagatatgtgatttgatgaggagaaattactgacatgttacccttttttgctcttgactatagttcatgtgctgatgctgtactcgacattcgtgagnggggtatgtgattgctgaacttgttggtctgctgcttaatgttgtcaaaattgttattcctagataagataagtactacaaaattccttttgtttaaaatatcatgttgccaatgcttgagaaaagaatctttatagtttcttacaccatgaataattcctgtcctcgaatcactgaagacagactgactgcattccatgagtttttttgaacatgacaaatttagttagttcctcgtatgtattaaaaagggactgctttatgtcttttttacgtataatttatctggtcacaaacagacagttcagaagctgcatgaaaaggtttgacctctaattggcaggagcatcccaacctaaactttcctaagcgtgccagatgatgcggctccatttttattgtatctaatactccacatttttgggcagaaactcatggaacatgtggttaccctgaaatacaggatgaatacgactacttctctacagcactgtacctttacagcaaatataatgtgacggttagtggatagtatttggtttcatgatatgaattcgtgaaactataaataatcacctcccatcttaattcaatatcccgcgtcaaaaaagaatcttaattcaatattatatacatatgcgcaaggtatttgaggttgtaacatttcctcagcacattgatatagttctcactctggtcttgcagaaagctctgaagaaagcacatatttatcctagaggaggcaggaaatacttagttggtcatatcgtctctgctattgaattttcctttggggcaatgccatctattgtgtgtaaaaacggctcagttcaagaactgaggctctgcttccacaaggattatcaggtaattttgatgtatttgtgagtgaagcacattattatgtcatcatgtccttacatattcagatttgattaaatcggtcaaannnnnnnnnnnnnnnnnnnnnnnnnnnnnnnnnnnnnnnnnnnnnnnnnnnnnnnnnnnnnnnn

SEQ ID NO: 18865 - DNA, 2245 bp, Oryza sativa
ttaattcaatattatatacatatgcgcaaggtatttgaggttgtaacatttcctcagcacattgatatagttctcactctggtcttgcagaaagctctgaagaaagcacatatttatcctagaggaggcaggaaatacttagttggtcatatcgtctctgctattgaattttcctttggggcaatgccatctattgtgtgtaaaaacggctcagttcaagaactgaggctctgcttccacaaggattatcaggtaattttgatgtatttgtgagtgaagcacattattatgtcatcatgtccttacatattcagatttgattaaatcggtcaaagtaggaatttctcctgttatagtgatattagaagggcagggcctaatttttaatcgagtcacagtaggccctagattatgcaataacaaaacatacatattttttcaaaacggctaaacatagagtgttgagatagacaactggaatggatatcccaggctcccagctctcaagtgtccttgaaattattatttttactatgtggctttcgtgataaacatttatcgtcaagtgcagattcttctgagcatttctcaaattcataattgaactaaatagcgtatttttgcagcctcgcgattgcttagttgagggtgagaactctgttagaagaaaccattgccctcgatacgtcactttaccatcatataaaccacacggtgagttatctgtttgtgccaattatcagtcactgaaatgaacagacagtacatgcaatagaaactatgttttctgaacttctgaaatagtactaggttttctgaaatagtactaattgaacaatatagttcatttaatcatcttcttcttgaatttatgtggctttaccttctcttgttttaaagataggttttctgaaataattctctcagttttgacacttattatctggagaaatgcatgccttgtgctaatagaacaatagtataattgtttcagtcatcttctgcaattcatgtgactttaccttctcaatgaaaacataccttgttcatcccatgtgttttccctttttctgacactccggttgcacttgcagcatttggcaattctacagaaggaatcagtaaccaagtcaacgttgagcaccaatcatatcagtagatctcacatctcactgtgagtattctacaatataaacacggctctgatgactcaggaatgagatgtacagcaagaaacccactaggcacacatacagtaacgtctgcatctgtaattctataatgcaattcaattgattataaagcaactgaaaatcccatgctgagttatgcagaacttttactgcatctcagtttctgtaaatctgtaattctgaattgtctgcaaatttgcagcatcccgtcatttccaaattcaagcgcgccgttaacaattgccaatctcatgtttttgtgtcaaaaccattgtgctagatttcataatttgtcagcagctataatattttcgctgaatatcacatcacagcgtttatgttctcagcgaatatttcgctgaagtctgggagcttcgtgctctctgttccgttcactttacgcatctcaacctatcgctgtacaagcgcctgctttctgattgaccttggattatttgcgttctaagatttgtttgatcagatgctgattaatgtcaccttttggccttaatcatataaggaatattccaaagttaccaaatccacatgccatggcatcccgggccaaaatggtaatcagcctccggttgcttcaccttgcagggctctttatcttaaccaatctggaaaaaaattcacatgaattctgagaaaaaatgtgtagaaaacaactcgaatacttcaaagcgaataacaatccatttgaagcccactactttgaaagtttgaaatggatgaattttgcggaaaaatatctctcgataaaaatgctaaccaccaaatcacttgtaactaactgaaaacagaaatggtgcagtaatttctgatttggcggcgggagggccccacctgtcagtgagacgaccatcgcggtaaccgcatccaaataaatccacgtggccgccacgccgagcgaattgaccgtacaaccaagccgcagagaagaggaaggcggaatcagtcgagggcgaggcggcggcggcggcagccatggcgacggcgaggaaggcgccgcgcatggtggcgatctgggcggtggtggtggtggtggt

SEQ ID NO: 18866 - DNA, 1987 bp, Oryza sativa
  unsure (1)..(1987): unsure at all n locations
gggcgaattcgagctcggtacccgtctgctcccaccgtcgccgccgcacgcgcgcgctcgtaggccggttttggtggtcgttacgattttcgcgcgcgcgccgcgaccttcggagattttttttcccctgatgcgggtgcttttgcagctcggagccgctccagacgttcacgatccgtaagtgcgccgcgcggctgctcgatcgatcggtttaatcccaccctcgcgttcgatttggatgccgtttgctgctcgagcgaatcaatttctgattgatcgatgtgtgtgcgtgtgtattttgcgtactggatgaacagatgggctgtggccggactacgacgacgggacctggccggcgtgctgccgccacaccagcttcgacatggacaaggtacttggctgcagagctcctcctctttgtagctcgaatgctcgatgcttacacggttaattgaaagagtgacaatgacaaggtggttgtgctttggtgctaaccttatcgatgcatggattcgtcattcgatttttgtggtgtagatattgcccctgaagccgacgcttgagaagtactggccgtccctctactgctcatcctcttccacttgcttcagtggcaaggggcccttctgggctcatgaggtatataaaagtttcagaagtcaagaactaatggattggattatacaagtatacctcttttggatttgcaactgaccttttgtgctgttttcctgtctgtttgtcatatggtattcgatcattcgcggcatatctttagtggggtaatgttcttcaaatcattccaccttatgttatgagctttcttattgtttaactttctaacaggaagttattgattccacttgaaatatcacgtagttatatttactaggcactgatttgtcattactcaactcagctttctttttttctcagagaaacatggaacatgctcatccccggtagttaaggatgaattagagtatttcaccactgctcttgacctctacttcaaatacaacgtcacggtaagcatttgggcttgggcttactagttgtaggcttgtagcatcgagttgatttactttccagacaaaagtcactgtgtcacaaattacagcaacagtagccttttgtccaaataggtcagggtgttataaggacaaggcccaagttgagccacatgccatggcacaaaatcttgtcctttttcctctgattaaatcgcaccgcattgcaggaaatgttggcaagtggtggtatccatgtttcaaatggtaaacaatatgcgctaactgatgtcattgatgccatcaaatgtgcttttggggcctcaccgcaaattgtttgcaagaagggctcagttgaagaactgaggttatgctttgacaaagatttgaaggttagctctcctttttgttcttcgaacaacttcctacagtttgtatcatgaaaattatgctgcttttagaatgaacgaccaacagcatgcacattttgaaattatgttcctacaggcctgcagtttcatttgctaaaactcaagcatttaccaacctcaaacatgctacatctttctatatgtatgcctaatagtgaaaacaaaaaacttgatcactgttgaaacaccactaaactgtacggaattcaaggtgattatatgcatcatatagtgttttctgcttgtgtttcttcatgcccctattaaggaatgttttatctgttgtgttgaaatttctaaacatgtgctgcataaattttgactggtgagtatttttcccaaactagctacccatgtgaatattttccccaaaagttgggaatgtgcgcagtcctgcacgtgttatttggcaatgtctcacatggtcacatgttgcatatgctgtacaataaaatactataatctttctttttcaaagaaaannnnnnnnnnnnnnnnnnnnnnnnnnnnnnnnnnnnnnnnnnnnnnnnnnnnnnnnnnnnnnnn

SEQ ID NO: 18867 - DNA, 737 bp, Oryza sativa
aagccaataatattcagcacattcaaggtcccttctctaaactgagttagcgtgtggatttcacatgacaattttttggagtggtgtgaactaatgtatatgctacaatgcaggcgagacgtaagcccttgaagaatgcttgtcttgctgatgtatgtattggtacatctgcagcaccaacctttctccctgcacactattttgaaaccgtggatcacacgggtgcatcgcaaagcttcaacattattgatggtggcatggcagcaaacaatccagtatgttttttcttcatcatttttctgaaattgtcaacttttgttgggtttaaattcctgtgtaaaaactctatacttttgtctttcaacaataatgtttacccagtaacgcaatatgccttttttcattatgtgttttgtatagacttcacatcaacctttgttgccaaactggacatggtaatatttaagatgctaacttatcttgatgtctctaatttggcagactttggtgactatgggtgagataacaaagcagatcaagcggaagagcgaggagttcccgaaagccgagccctaggattaccgcaagtatctggtgatatctttgggcacgggtctgcctgagcacgatatcatgtttgatgcaagaaatggtgccaaatggggcatttttcgatggctagttgataaggatacaatgccggtgctcaacatgttctttcatgccagctcagatat

SEQ ID NO: 18868 - DNA, 4901 bp, Oryza sativa
cgggccttgctgagatcacctagggctctgcgctcctgccgccccaccctcgccgccgccccggccttcttgccatcgatcccttcgcatcaaagagcaaagaaatcaaagagcaagaaaaaacgctcgccgcggattttcggagacggtggtgggataatcaccgcgaaagatcggcaggttctcgttttggatggcgattggagcccgcgaagccatcctgtgaaacctaccagcaaaacaaaccgagaagtttcagcatttcttggagcatttttggtgaaacagcctcggtgatggatagtgaccaccgtaaattcgacagaaaccgtcaggattcaagaaatcgcaccgattcggtgcgcgttgcgcgaaatgctagtgcaaagttgggaattttttcgaggcttaccaggaggacaggaggatgaaaccgccggagtggagggagtggggttttgctgcgggagatggaaccgggacatgttcactttgatgcgaaaaaaaaaaatcttactaaaatttagcattatcaaaattttaacaagatttcttatatagttaactaaatatagccacttttttagcaactttactaaaatttgataaggttgaaaatatcattaaagtgaatggccctggaagatatcagaggagtggtgaagcgtattgtgtgtagtagatcaacatgttacgtaagcctagtaggaaagccgtaaaactagattacgtgtttctctctctccaattttttattatcgcagggcctataggaaatgcggcccatgcagcccgtgccaactggagtgggctttgcgtgctttgttgggcccaagagggagtagcccatatgcccactcagcccaacactttagaagccaacgtatatggtgatgtttctttggcaggcagcccaggcttagggtaagcacacaacactgatataaaagcttaggacatcgagaacaaattgggaaatataccctttttatcaccggttttaaaatatacacgttttgaagggactggtagaagtatatcattgtcgcaaagcggagatgtgaactcgcgtatgtggatatacaaacaaggtcacgacttcgcatcccaatatgcgaactcacacgtccgccgcgagttcgcattcttgctttgtaacgatagtatatttttgctaattctttttaaacgtgtatattccttgctttgtaacgatattatatttttgccaattctttgtaaacatatttgtaaaaagaagggtatattttaaaaaaaatccaggacaaggcagctgtgtaccagcaggcagagttggatcatggctcgtgagacatagggttggtttggtttgtggtttaaataggtattactaaattttatcagtgccaaattttggcatgactaattttggtaaggcaaagttgtgtttggattgaagccaaaatagcctaagttcactattgaaaaggcctattttcttaggcatgccaaaatttggcttcaaaccaaatagacactaaacactattaaaattgccaaatattgataagcctaatttaggtctcaaaccaaaccagcccataatgtaaatccgtgtgttagggaatgaattgaacacgtagattagtaggagtacctaagggtgtgtttatttgggaaaaaagaaaatttttgggtgttacatcgaacgtttgaccggatgtcggaaggggttttcggacacgaatgaaaaaactaatttcagaactcgcctggaaaccgcgagacgaatcttttgagactaattaagccgtcattagcacatgtgggttactgtagcacttatggctaatcacggactaattaggcaagattcgtctcgtgatttcctctataactgtgcaattagtttttctttttatctatatttaatgcttcatgtatgtgtctaaagatttgatgtgttgtttttggaaaaaaaaattttggggaactaaacgggccctaaaagtggagtaaaaacaaacctgttaggtgtattggcactcccggttggtgctggttgccggcccctaaaagtggagtaaaaacaaacctgttaggtgtattggcactcccggttggtgctggttgccggcacatggagattgattagcagcgctggcaggttgtgcgcctgcctggtaggagcaggaggagcatccgctttgctgctgaataattcttcttcttcttcttccctacaggtacacaggctgtgctgtcctgatgctcattttctagataaaaatacagcacgtatgctgaagaaacaaccaacagcttgccacgtttccaggacaggtactcctccttccggcatgttttgtagtcctgtcacgtcgctgactttgtatggccacaggtagcaacatttttgttttgttttttttttccttttgagcccgtgtcttctctcttacgcagtgcaggtagacttttgggccaatagtttcttttatattttataataaacttatatacaattaaaacttgtgcacaaaacatatttcctccgtttcacaatgtaagtcattctagcatttctcacattcatattaatgttaatgaatctagacattaacatcaatatgaatatagatatgctagaattacttacattgtgaaaaggagggagtattgcttattatttcataaagcatatgctcacgaaaaacgagcaaattaacgcaactgtatgaacacatggtaaattggtgatctttttttttcttctgtgtttaggaggggtttctctagcacacaaaatgaagcatatattagcgtatgattaattaaatattagtaaaaaactttaaaaaaactaatataatttttaaaacaactttccaataaaaaaattctcaaacaagtaccatttggcagtttaggaaacgtgcgagctgatgagataaaatcccaatttaacttgtcttgttatgacttcgagtttgtaagtcaatttgacctaagtttgatactgatatgagcaaattaagccacgaggtttgagttttttttaatgcctagaacatcctagtttggagtaatcccttcatcaaaattcgttgtgttagcagtggttgggctttttttttttttaccgagggtgtgtactaccggctaaccaacccccaacaatgcagggaattgaaggccctgggagatgggagaaggacgcacaggaggacagacgtgacagcaagcgggccccaccacaccgctcggaaacgcaggacacgttcctttctttgaattggtgacagcctctcgggcgaagtaataactgacagtgaagagcctcggatctcacgcaacaacaactccggacgacgtgagaaccatccatctgcaatccctgcagtccagggacggacggacggagaggacgacgcgattgaccattctacccctcccttacccacgccatcccgctgtgttcgggaggcctaggcgcctagcacgcgaaacgaagtactccaacgtttagtatgattttttaagtaactttcatatagattttttttttaaaaaaaacacaccgtttagtagtttgaaaagcgtgcgcacaaaaaaaacgaggaaggtgagttgggaaagtagaaggagtattaagaacataggggctgtttggattagggactaaaattttagtccctatcagatcggatgtttggacactaattataggtattaaatgtagactaataataaaactcattccataacctggactaattcgcgagacaaatttattgagactaattaatctatgattagcctatatgatactacagtaaacatgtgctaattatggattaattaggcttaaaaaattgtctcgtaaattagctatcatttatgcaattagttttttattagtctacgtttaatacttataattagtgttcaaacatctaatgtgacagagactaaaatttagtccctgatccaaacaccaccttatctccaccctaaattataattatttttttagttggatacgggtattaaagaaaagtaaaattaaataagaaaatatcgtgatcaattgacaaataatgtagataaaaaagattatatttgaagttgttgtagatcctatttgacagtcaatgctacaacaaccatagctacagtatgttgctactataggtgctggctgtggtagcactcaacagagtagctgaatgtgtctatattttaagacggagagagtagtataagtacttgagggagtagtatggtagtagtaacatcgaagtccttttgtaaatacttttactctatacaaagaaattagagtaaatttcacaaaactacacgtgtaagtccaagttgtagaaaaccacacacactttaacacttggcacttaagtaaatatattttagtagtgtagtttcacaaaacacactatcaatgaatggattcaccgcgagatgatgtgactattaccagccatcgcacgaaattaataggatgccatgtctttatcctagatggagcgaccacatcatctcgcgggtgaatccattcatcgatagtgtgtttttgtgaaattaaactaccaagatatatgtacttaagtgttaagtgtcaaaatgtgtgtgattttctgtaacttaaaaaatatagtttcgtgaaatttacctttttttaatgtcctacagccaattttgtctaagaaaaaaaaaggaaaacttcacgagggcacgcgcgtaatttcagggtcgcctcgctgccggcagcggcaggccggccgggcagccagccgcatcgtgtaccgggcctacctgtcagaaaagttcagaggaggaggaaggaccaaacaaggcgcccggctttttttccgaaaagccccctcgtaaatccccttttt

SEQ ID NO: 18869 - DNA, 1514 bp, Oryza sativa
  unsure (1)..(1514): unsure at all n locations
tcccaaaaaggctcttttttgggaggctttgaggaggaggaggaagaagatgggggtgatgtcgcggcgggtgctgcctgcctgcagcagcctctgctacttctgcccctcgctgcgggcgcgctcgcgtcagcccgtcaagaggtacaagaagatcatcgcggagatctaccagcttccaccggtatggcgattactgaatcctgtcttggcatttcagccatttctgatgcttagttgtagtctctgcgatttgggtctgtggtcaaatagttctagtttctgcgaattggagtctgtggtcaaatgtgtggagggagtttgttgattgagggtgtgatgttgttgctgtaggatggtgaaccgaatgataggaggattgggaagctctgtgattatgtctcgagaaatccgacgcggatacccaaggtaacacattttgatctcctctctgtttttactagaattgtcgcgcaatctgttagcttgaatagtttagactgaatttccagtatttctgaaagcagtctttataggtaccgagtagttaccacataatggctgatttacactgcattgctttagtgtgatggtgattccttttgccagagtacaaccgatcaactttcgctagcaccgatcactagctggaatgattttaggctgtttaagtaggacttaccgagatgaatgaatttgtggaactcggaactgattttatgtctgcagatcacagagtaccttgaggagaggtgctataaagatctgagacatgagaatttcaccttggccaaagttgtaccatgtatatacaggaagcttctgtgttcatgcaaggatcatacgtaagtgtaaaggctctattctgccagtcaagcacccatagcaaatgtttgctgctgtactgaccatattattcttgattcagaccattgctggccacaagcacattgagcattattcgtactcttctcgatcagagaatgaatgatgatttgcgggtcctgggttgtctaatgcttgttgactttctcaacggccaggttattgacgactgtaacaaattgcacctacttggtttgctagaaatctgccatctgtttggtttaatttgagttcatgtaggttgatagcacgcatatgtttaatctggaaggcctcataccaaaactttgccaaattagtcaagaactaagggaagatgacaaagggttccgcctccgatgtgctgcacttcaggctcttgcttctatggtaagaaaagtttttacttgattctctgatgaaatggataaggtagtcttatatgttgcgagctagccatttagggctaatttacagtagatttgttggaccagaaataataatgtagaacaaaataaggaactacattcaactattatacaatttgttttgcaaatataacatttttttaatgttggttatattgnnnnnnnnnnnnnnnnnnnnnnnnnnnnnnnnnnnnnnnnnnnnnnnnnnnnnnnnnnnnnnnn

SEQ ID NO: 18870 - DNA, 5134 bp, Oryza sativa
tgatgaagtaagtccttatcactctgtgttgggctagaatgttaagagttaagacttaattctcattcatggttgatagatgcctcctggtgaatatttgttctcttgttggaattgcataagattcatctttggagcatagacaagttgatgccattaatactacagatagacttgttgaataagtggaagatatttgattagtctatgaatagaaaaaaaaagtagcatgatagtttcatttgaagtgcgccagaaacagtaattcagtaagggttctgattagtctctgaattcattcttgaacccaggttgtgtccgtgatcgtaagttgttatgaggttaatcaaactctctcaataaaagaggttgtcaggcttcaagatgatgatgatttggtaatcaatggaagtctgactgggttgccagtatctgggcaaaatagtgccaaagtggcatctgatacaatgtgagaatttctgctaatgtaacggcccatttccacactcgatttgtgcccttgtcatcttaatgacttagtgtgttgacaggtctgcatctgaaaatccagcacattgggcaagggtttgcttacgtaatatggccagtatcgccaaggaggcaacaacagtgtggcgtgttcttgatcctcttttccgcctttttgatagccacaactattggtctcctgaaaatgggattgcattttctattctacaagaaatgcaggcactgatggacaaatcaggtgcaaaatttttcacccatgctatttgtttctctttttgtgccattttttttggttttgttagtgtttaacagcagaaagatttagtgctcttctaaatcttgtttcttaacagggcaaaatggccatttgctgttatctttcaccataaaacacatagatcataagagtgttgccaagaagcctgccaagcaaacaagcattttaaaagttgcttcgcttcttgcaaaacatgcaaggtaccgagctcgatgacaatagcaagtgcaacaagcgacttaataaagcacttgcgcaaatgcatgcattgtgctgttgaatcaccaaatgctcaaaatgatgttgacaagtggaacagtgcactttatgtggccttggaggagtgcctggtgcaattgacagaaaaggttcattatgctgtattattcctttgtcacattactacattttgctttcatcagagagacattaaaggctgttaattcattgaataggttggtgatgttgggcctgttcttgacatggtgggagtaatgcttgagaatctctcttgtactgccaccattgccagaacaacaatttcatcagttttccgcacagtgcaaatagcagcttccatccacaagtcattgtacaaccagaaggcaagttttctagtgtgttcaccattgcaggagaattttgctattgaacaaaagtgttaattggcaattccttgttaatatttcaggcatttcctgaagctttgtttcatcagcttctcttagcaatgatgcacccagacaaaaagacaagggttggttcacatcgtgtcctatccaccattattgcaccttcacttctatgcccatggtcaggcataagttttcctatccctgtgaagggcaatgattcacagagcattactttgttggctctttctgccttttcttctgaggccgtaatggatgaagtccggatcaaaagcaggacccatgaacagttacaaaacaatgtaaaaccagaaactgtagttggctctgagaacggatacacacatacagaaccaaattcaaggaagagccctggtcttggaattccattgaaagatgaagtatgtactccaactagtattcttattgaacttggtattttctggtcttggtgttttcggatgtccagctgacacattttcttccactgaagcagaatcttaagttcatgaagctgaacagtagccaacttgttctcctcctttcatcaatttggagtcaagcacctctagaagataactcaccagcaaattttgaagcaatgtgccatacctacaatattgctttattgtgttcaatgacaaaggtaggtcacttaatctagttcattcttgttatacaataggcaaaaagaattgttcaagtaacttgacttaacattgttctgcatgccttgaaattatcaaagaatagccaaagggaaagataccgtcttttcccttttggcatggagttatttcatattatataatatttttttatactctatttttacacaagatagattctttagaatattttattgatgtaataggcatggattaacactttttttaagatttccctgctagtgtgagtttgactagtgatgtcaacttctcctttggacttgaaattgtgtgctatatttgtgagattgaccattgaattttcgttgcagagctctagtcacgcagcattagttcgatgtttccagttggccttctctctcaggaggatgtcccttaaccaagaaagtaagtttatcctcatttgcctgctctttaaagtttttgcttttgtatatcaaaatgatgatgcaaaaaaaaagtgacaactagctagggattttttccaaataggaatatcattttttctaataccagtatattttagccattgcgtccaacttcaagtttattatatttcctatcaatctagtcatttgatacctgcttgatttattcttacattttctactgtaaataaagatggtttgcagccatcacgtaggaggtgtttgtatacaatggcatcagcaatgctgattttttcagcaaaagttgctgatattcctcagacaattcctcttgtgaaagcagcagttccagagaaaatggttagttgattcctgattttgaatatgcttgctctatatatatctctaatgtgacatttttcaatttactctgaattcgcttattgatgtttttgtaggtcgaccctcatctttgcctgattgatgattgcagactcgttattagttcaccacagtcatctaacagtgggatagtttatggtcgacctgagggatgaaagtgatgcacgcaattttctttcttgtgtaaataaaaatgatacacagttaaaagaaattgcgatatcccacttcaaggagaagtttgaaaatctatcagaggtatacattcagatttacattatgagagcgtgttttcttgatttctctgttcacaatcaagaagttatttgacgattaagtgtcttcactgcaaattgcagaagtttaatggtatagaagagcagcttcttcaggagttttccctggatgattcattccctctcagtgctccactattcatggaaacaccacactcttgttcgatgtacgctgaaaaggatgaccattgttttgatgaggtccgtactgattctctatagttaggtgattttttgttatttatgaattgctgttgtattaacttttttggttgcatctgcgtcccttgtgctttcaggaagtcattccttgtgagatggatgatgacgatgacatcgtttttgaacacagtggatcgcaatctgacaggaaaacctctggatctatggcttcatcagatgttctaaacgtcaatcaactaatagaatcggtatgcgccatttctgtctacaacaatggcacatgaagatcactcgctattttctagatctcttacagtcccctcatccgtttgtaatcaaacgacttttttttttcttcaggttcatgagacagcaaggcaggttgctaatgctccagtttctgccaaccttgtaccctacgatcaaatgaagagccaatgcgaagccctagtcatggagaagcaacagaagatgtctgttctcctgagcttcaaacactcgaggaccgattcccgtggctcgactgcagaaaatggactggaaacaaacgaggcatgttcatcttgacaggaaaaaaaaaatctatccatcactactgaaatctttgaaaatgtcctgaaaaactcatcaacatcttgttgcagtcatctgctcggtctgagcctgagacgcagtcgacgaggaaggagcgaatgcgacgcagcgactcggcatcaagcgaatctgaccggtcgttcaggctgccaccggcaagcccatatgacaagttcatgagagctgctgggcgataggctggtgcaatgcaatgcgatggcgccaaggatctgatactagttttcaagcctgtatacagaaatgtttttacagatacaagtcttctaaagctgtttcttttcattgtcgccttgtattttttattcttctgagtgtaaatttctcgagaaggtgtacaaatttctgttactgttgtagagacccagaataaataaaagtataggcattggtgcaatctgatggatgaagttgtattaaatatttaaatgtccagaaaatatattgttggagacatgtcacgagggcctttgaccgagcctacagaaacaggtctacaattgccagggcgaagcacggcggtaaagcgctgactgtcacaaagatagaggttatgggcgaagtcaccaggtggagccaaagacctttgtcccaagccgaaggactcaaagccttaaagggccaaccactcaatgaaggcccacttagcagctcaagaagagccctaaggctaatttgttcataattaccatcataaatatctcatatcatacgagtaaccatgtaaattttgatgtatttaataaccctagggcacatgaacctataaataggccccatagggcatgtactaggggatccaagaaatttccaatattaatatattgtttttacttttccataaagtgaaaataaactatgagctaggtttggcgaggagaggaataagcaaaagagaggataggaaaacaggaaacgggcctgggcctaaagcaaaatgtaattgggctcaaaaaagggaaaggagggctcacgtatgcggcccatatttttgggccttcgccttctctcgtcgtctctccgtcccgagctaagtccgtaaaaggtcctcgtcgtctccgcggagaggcgatcccctcccatttcaagaaaccttcgcgccctccaagaattccaagaaccc

SEQ ID NO: 18871 - DNA, 384 bp, Oryza sativa
gattccagctctcaaagcatgaatcctggggaacaactgtggcatcattgggttgacgggtactgggaaatggcgcaccgagctagcgatcgtgcggtcattgatcctgccaacttccttgcagacttgatcaagaactgagaggaaatccctgaccaccatgaagatcctgaaagggtgagcttcctctttcgcagagtcaccatggaagtactcggtgatctccttcacaagtgatagcgcaacgctctcctgagcctgaaccctgatgatgtcgtcatcagccctcttcaagaacttctgcattgaatcatggaacctccatgcatcttccctggacttgacttcttcattcaaccgcaacacctcagtgatcttctctat

SEQ ID NO: 18872 - DNA, 1255 bp, Oryza sativa
  unsure (1)..(1255): unsure at all n locations
nnnnnnnnnnnnnnnnnnnnnnnnnnnnnnnnnnnnnnnnnnnnnnnnnnnnnnnnnnnnnnnncgcagagtcaccatggaagtactcggtgatctccttcacaagtgatagcgcaacgctctcctgagcctgaaccctgatgatgtcgtcatcagccctcttcaagaacttctgcattgaatcatggaacctccatgcatcttccctggacttgacttcttcattcaaccgcaacacctcagtgatcttctctattcctccagcaagtttcgagacatagctgcttagcacgtcggagtccatggcagctgccttcttgacattgctgagctcgtttccgaggccagccactacctggaggccaagctttttgcactcgagctcgtcccgtaaagggtttgcctgagttcgtggagttgattggttgctagcagagaggtgggagccctccgttcggataatctcctgcacgacaaaatgcaaaagtgtagtcttgccatcagtgcctttgacatcaaccaatttgagtagagtatcaagcttgaacgcgtgtgcatcgccgcgatttgttccaacattcatcctgttgccagtcttcaggacagcttcaagtagcttcagaaacagcctgctgtttctaagctcgtcacaagcagtctgttaagaaaagtttcatgtacttagttataggtaagatgtcaatataataataagtatgaaaggaaactcggaaacgataattctcacctcaagggtctcaaaggacttcttcaggtaattaacctctgattcaaagttagcaatgtaaagcattgcgtctactcttttgaaagcaaatgggatatcaaggactgccttaaggaatttctcagcaggaccaagcttaataggagatgtctcctctttgaattctctcaatttgatctcctcttccttggtaggagccatctttagcaaggtctccaacaattctgctccaaagttctctgtgttacctgctcagtgaattggtaccacgttagtaaggataatactataggaaggatcaatctcattgacttgactagaaacttggtgcaataatgcaactatcttgcaattatttgcacccaagtcaagactatgtgcagagaagtagtaatactatatcaagcaactacggtagtaatactagtagatcgaaagactggttttcacatcagaacaatggtatctctaaccatcttcaccgcaggtataactctatgcacctaa

SEQ ID NO: 18873 - DNA, 767 bp, Oryza sativa
  unsure (1)..(767): unsure at all n locations
nnnnnnnnnnnnnnnnnnnnnnnnnnnnnnnnnnnnnnnnnnnnnnnnnnnnnnnnnnnnnnnnnaaattattttctgctgtgatattatttactgagtttcttccattctccagtaccatacggcagcagttgatcagcactgaggatataaggcgcattcgtaaaaaggctccatgtacccgttccgaaatatggatgatcgagaaaggttccttagaagatgatatattccatgagcccatcttttcctgtaagctacttaaattggtttttattctctgcttcctctttacacatttactgtatgttcaattcaattaggaaagaactgaaacagaagtgaaattagttttgatatatgaggataattagtggttagttttatgctctgaaattctactgatgcatgtttgtgttcccaactaggcatgtgcaaggagctaaacgatttgcaatatcggacctatgagattgttgctcatcccaccattcataatatggaaatacatgtacggctagacatgtcccaaactatggcagatggcagcaatgatgttggcacctctggcgcaaaggacagtggaaatcaccaagatcatgtagtgctaccagatggagctgagtcagatgcgatgcatcctgaagcaactgatgcagcagatactagaactgattttgattcacacatgccatctgacaaacaggttaacaatgttgaaggagtaacttgacaattaactgataatgagaaagaaactgcagttg

SEQ ID NO: 18874 - DNA, 736 bp, Oryza sativa
ctgcaatcatgttcagacgaatcagacaataggattagcatgcgcatcaagagttggaacaatgatttacattccagcaactgaacttacctatggggtcatatgttggcagggtgatgtatcgagggcaatacttcttcttcgatacgttttcattggtagcagtagtagtaaggcaatcaaggggctggaaatataccaccgagtttagcaatattgtacaggttttctttgaaaaagaaagattatagtattttattgtacagcatatgcaacatgtgaccatgtgagacattgccaaataacacgtgcaggactgcgcacattcccaacttttggggaaaatattcacatgggtagctagtttgggaaaaatactcaccagtcaaaatttatgcagcacatgtttagaaatttcaacacaacagataaaacattccttaataggggcatgaagaaacacaagcagaaaacactatatgatgcatataatcaccttgaattccgtacagtttagtggtgtttcaacagtgatcaagttttttgttttcactattaggcatacatatagaaagatgtagcatgtttgaggttggtaaatgcttgagttttagcaaatgaaactgcaggcctgtaggaacataatttcaaaatgtgcatgctgttggtcgttcattctaaaagcagcataattttcatgatacaaactgtaggaagttggtcgaagaacaaaaag

SEQ ID NO: 18875 - DNA, 2769 bp, Oryza sativa
ctgcgagtgcgagtccacacaacactgtgaactcccccctctagagaaaaaaaaaagatccaaaattttttcgcccttgggttcgaaatcttcgtgccttcctcctcctcgcggcctccaattcgaacgccccagttgctcgcgccgccgcggattccccagatcccacctcctccccagctcgcgcggcccaattcgaaggcggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtactaaggaagggaggtggggggtggaaaatgttctactcgcagttcatcttggccaagaaggggcccctcgggaccatatggatcgcggcgcatttgagcgaaagctgcgtaagaatcaggtcgcggatacggatatcggcgtctccgtaggtgggtgattttgctgtttcacaagcttttttcttttcggatctactaccatttttttttgtttctgttcgagcatgttagggcctcacacgtagactgctaaagcattgtctttgctaatgctcgtttgtgctgtaggagggggaaaacattttttttctcgcttatttatggttatatgtattcttactgctcatatgttgcgattaattagtaaaagatgttagcttttttgggatagtgttagttcctagttgacctagttgttgctggcagagcaaccatatttttacaactatgctaatgagctgtctcttcatttttgcttatacgtgctcgtctgctggattatcactgttgtactacagtaataggaaaagaaaccacctgtatcaatgcagtcgctgattagcttcttacaactgatagattggtaaaaagtttcaaccttgagttgcactggtcatttggttgttagtattaatgcttcatgtggattttgttatgccatcactagagttgtaaaagctatatgcttttagatgtctgacaaattgcggatatagtgtttttgttctttctcggggacaaagaaaacactaactccctcactagttacaagccacttgttcactaatatgacacaatattttattttattatgtgcttttacagtatccatcgtcgtcgctagttgttttatagatttaatcgtaatagttaagtacagcttattagattgagaatgctggtagcttgccttcaagcagaactactactggactggttttatcacggatatagtggtagagatgagatctctttttttcctctgatgttgctctgttgctaatgctattatatgcaagtcaatccagttcaaaatctgggtttacgatgacagaattcaatacttctgtgaaggtctcagacaacataagtgcacagggtctgtagagaaggaagcaaaattgtagcataggatttgattgcatgatagctgataatgcatttgtacacagtgaagcttgtgttaaggattggtatctgtgatgcatgtggtatgtaaggacttggttacggaattctagttgaagtgtagcaaacatgagaaagaacatcttttttttagtgccatgatcatgcaatattgtgaagttggttaaggctccgtgatattagctgtcaagtcgtgtctctacacagtgaagcttgtgttaggaataggaatgtgataatttgtaaatgaagcccagcgaacagaaagttatggaatttagaaaagtgtaaagctagttaaatgttgttttgaccaaaaaaaaaaactacacaagcatcattcggacaaatttcaagtaatattggagtgtatatggggaatgccatgagctatccatagattccattcacaactggattggggtgtatatgggaattttattgaaatatgcaaagaggtgcgcccaactaaacaatactccaattcactttcaccatgtacatcactttcctgccaaatttagaaagatatgaggattccaaatacagattaaaataatgttccaaaggtaccaactgatccgtctcattattttttaaagcataccatatacggtcaatatagaggatgcgaacccgacaataaagatatagagagagaggactcaagaaaacctccagtagctgtgtcctgtatgcatgtgcagcaaaatgagtaaaccagaagcttctttggttattttcccatttatttaaaggtaaaagcaggctagagtggcaatggtttgatggagatcaaggctgataacaacattatttccatctccttataccaaatttaatacgtgtctgtttcattgcatgcatattgaagggtgactagtatacgacttgaaccatgtaatttgtaaaataaaataaatacgtgcatgttaacccacttcttacttagaagatcactcaaacctacataagtgtatgtagcatgtaagagccatcgagcaatgtaaggttccatgccatatatgcatgagttatatattgaagaaggaaaagaaatcatgttttgttcgcatatgagaaaaatgcaagctgtcgttgtcttctcatttcgttcttaccattttgggatatatttgttttctttcgtgcaattactgtgtagttacttttatgttcctagcctttttttttccgtattgcttgcatgggttttagta

SEQ ID NO: 18876 - DNA, 4068 bp, Oryza sativa
  unsure (1)..(4068): unsure at all n locations
nnnnnnnnnnnnnnnnnnnnnnnnnnnnnnnnnnnnnnnnnnnnnnnnnnnnnnnnnnnnnnnnaatttacttttttatgaatgtaaatattccactacatcggaaatctagtggtgcggtgtacgcgtgaatgcctttggccttgtccaggcactacatatccttccagctgtcctacatcatcctgtagctgcagctgcagtcccacattgctcagtagatccacccctggccaccacatgtccttacatctaatatgttaatttcttctaaaaggatagcattgatgatagaaagcgctgtcacgccatcattgggcaagcaaaccagcttatagcagttaattggtgaaaaacattcaactccattcctttctccaaagataaaaatagaagtacttagatgccacatgtgtctgttatgattctaaatagtactccactatttagtagtataaatacaggaaaaggtttccattataagtttattataacatcaacacatggacttaaaatcttagagcagctgaagcatggcattaactctgcccatgatacagggcaaaccaccatgtgcatcactaaaacactcactagtgcaattcacagaattttgtgatggaaatgttatgttttcctaacagtggtcatatatctgccatatgtctttttttttttcattttgagcttagtattaataatcatttttttcctgcagattcaattatattccctgaagttccgattgcacttcgattatcaagccatcttatgcttggtgtggtcaggatctattctcgcaaggtgaactacctattccatgattgcagtgaagcgttgctgaagataaaacaagcctttaggtctactgccgttgatcttccccctgaagaatcaactgctccttatcattctataacacttccagagacattccatctggatgattttgaattaccggaggctgcatttcaggggtaagttcattggttttgttgtgataagtttgttatttaaaatgtgcccttcaactctcttaagattttccaccatgatccagtgacattgatcatcatgtaagcacaaaagaacagatcaccttgcaagacaacccagagaaaactggatactcaacatcccaatttggcttagatggttggtccttctgtattcacgccatctacttttcgtcatctacttttcaaaatttgaagccagccatttaatcatattaagcatatctctatttacagaaagatttggtgatggcaattcttcacatattgggttggatttggaagaggtaatctcagctaatatatcttttctccaaaaattcattgaaatgtttgtggtcttcatcctgcattatcttgtatgtgctgtttggatctttttttatcatctcagtcttctccgcattatcatagatgtacttccagagtaaatatttactgtcatgctccataacatggcagttcttcacatattggtttgtttttaggtcataatgatagggaatgcagattatgcagatgaaaactcattttgagttgtacaagaatgtttagagcatgaacattgaacataacaatgattttaccatgtaccaattccttgcggccattgtctatgccttgtcttctggttgtatatttggcagctttggttcattacctgttagtaatcaatatttcttttgagtatagggtaacacatggctaatagatgactgattaatggaagctctctatttctggttgttgtgttattgtgtcctatcacttgataaactgcaattccaaaacaaaactttgtatatcttcagcagctaaattttatttgtttccccctcacgaattaatgctgaacaaggaccagtcaattcaacttgaggctgatgatgggtaaaatcacctcttccacttttttttataaaaaatagctattcaagtcccttggaaattttatctacacgtctctgctcccatataaagggtctttgatcctatctaaaggagcctttgtgggttttcacagatgaggttaagtttctctaggcaattttatgttttcctataacttctgaccttatattgtacacttggactgagtctgaatcaacccagggtctagttactactttctcctgatttgagtccagatggccatactggggtgtgacactgatatatttgctacacgtgttgtgatttttttccatgacatttgaaagtggcagcatcttgcatttgcctttttctgtatttttactttatttacattggtttgtgcctctcttcagcattattattcaaggtcgatcagcagttcatcctaccgatatggaagttgatgataaccaaaataaagatgaaagcgctgaaggatacaacatggaggatggaccttccagtcacaacaaactaaatccgttaagtgcagatggtctagtaggaaacagtcttcctaattggcatacatacaatgtgcaaacacctgatctgaatgatatgctattgaacaatgatgggaatgcaggaccatcagcttcatactatcaacctagtcccttcccttgtgatgagcctgcatcaccagagtttgtaagtgcccaggccccggctacacctggcctaatggaagagactgttccttccagagtgcatgaaagtcctgttctgagtccacagcgaaaagcttcaccatcaagcaatgatgaaactgcaaagacagctgaaaatgctaatgatcttgtgggtgctgagacgactgaacttgcattgacaaagcctgtgcaaattgaatcttctggtgctgtacaggagattgattccttgagtcaacaatgtgcaactgaggaattgccaccccaagctgaaacctcaaacttggaagctaccatggacaagtcaatgataaatactgatggtgtagctgcatcaggtgaagctacagctgctaaagaaaccactgaagtgtcattggttgaaaattctttagagctatgcgctgatggtcctactgaacctgtgattgagaaccaaacacagtttaatgatggatcagttgatgtgcaaggtaaattgactattcgttgattttgtttttaaagtcattgtatttgataaaaaaaaggtgaaatcatctgctttttgattatttgttttgcagggggcggtcagcatgcacctcatgctatcttagcaactgcagattcccaagtgaatgtagaagcatcaacacaagaaatggcatctaacgatataccaagtgacctaccaaccttggaatttccagaacgtgagaaaatgctgtcagctccagacgttgaattgtaccaggcaaatgacttgggccaggtaactgcagaaaagggaaccactgaatctgatggaagtaacaaagtaggtagtctcactagcagaaaaagacacttggaggacagtttgccagctctcgaaagtgcaactactgaaaaattgtctagcagaccacgtggtaaaagaaccattgatggtattcctgatgatgatgatttactggcgtctatattaggtatggatgaacctcctcaacaataattgtgcctggcttttgctgcattgtctaacactaactgtgtggacttgtatttagttggtagaaggacccctggactgaggcttgattcaacaccaataccacctaagacgtcatctttgaaacgtccaaggttgacgtcaaagagtaccacaccgaagagaaaagtgcaaatggatgatgccatggttatacatgctgagtatgtatacgcctcatagccttcaaacaagtttgttgaatggaactgtgtgactgttgttctttagtgttatgtccttaaatttctgccatcactgtcttctgatgggaaacaaatagtatattttttccgtatattcttgtaaattttgtgcagtatatacattgagttgattggtccatctctggaaatcagattgcggactattttgctgtccaaattattttctgctgtgatattatttannnnnnnnnnnnnnnnnnnnnnnnnnnnnnnnnnnnnnn

SEQ ID NO: 18877 - DNA, 5093 bp, Oryza sativa
  unsure (1)..(5093): unsure at all n locations
nnnnnnnnnnnnnnnnnnnnnnnnnnnnnnnnnnnnnnnnnnnnnnnnnnnnnnnnnnnnataattagtggttagttttatgctctgaaattctactgatgcatgtttgtgttcccaactaggcatgtgcaaggagctaaacgatttgcaatatcggacctatgagattgttgctcatcccaccattcataatatggaaatacatgtacggctagacatgtcccaaactatggcagatggcagcaatgatgttggcacctctggcgcaaaggacagtggaaatcaccaagatcatgtagtgctaccagatggagctgagtcagatgcgatgcatcctgaagcaactgatgcagcagatactagaactgattttgattcacacatgccatctgacaaacaggttaacaatgttgaaggagtaactgaacaattaactgataatgagaaagaaactgcagttgttgagaaagcaaccactaatatgggtgacagtgctcaagttgattcacttgataaggaatatcttcaagatgttccagctgatctgcagaggagcacaaatacaaatacacctctgtttgtgctagatgacatgcctggtccagatgtggttctggatagctctgatccagtttctgcacaagcagtggatgatatgaaaggggagttgagtgacattgtccatgacaatgtcaatgcatttgacaataaggatatgccgacttctgagattaccgtactggaatttactcaaaacgcttctggttttcctcagccaacagaggatgaaaatgttctgtccgcaatgggtgaaaattctggattgcaagaaaatcatgtaggatctgttatggatctggacaatatggggcatgacttttcactaaaggaatgcagtgtaagtccatatagaagtttccacttgtcttcagacacttgtcagatgacttgtgtttctcttaattccacaatgtagcatgctatacagtacttgcactattttattcagtcgttatttgaagtccatggcataattggtatgctgttcacattgcaggattttggcagtgcgattcagggtgttgacacaggtattgccttttgttctgatacataagtgtaaactagtgtagtagtgttctaatataatgtggattatgtgtacaatgctttgtaggtgcagcagaaaactagctaaatacccatgcacagattttctaataaatatatcatcagttcgaaactcaaaaagtgagcatatttatcctgagaatcatatgtaatttgcaagacgcatattacaatgtcaaaataaaaacaatcttattacaagacgcatgctcagatattctaattattcacagaagggtcaggctgactcaagaagtggcggtgggatttcagactcaccataaccaccattcctaggttcttttgtattagtagaaataaacatgacattaaccttcatgactagtgcaatatccgttcttaattgtattttatatgcaaattttgtgatgggaacttccacacgcccgtatgtgacactggtggatcttactgttctagtgttgcatcgcgagaggtttataagttttatgacttgtgtcatatttgtactctacactttcagattttctgatgtatgatgatgaggtggactgtgatgaggctaatgatgatgagcctaatcctgaggaattccagtctcttgataacagtggatggtcttcacgtactaggtacgattggatttcgtgataatattctcagggtttaatgctcaatatttttttgagttctataatgagttgttacaattgctcttcaggggtgttgcaagatatctcaaaactttatttgatgaggaatctggtctgggaagaaagagtgtggccattgatcatctgttaagtggaaagactaggaaagaagcatcaaggatgttttttgagacattggtaagacggttatgcttttctgtttctccactcaagaaatggaatacctaccttcagctccagtgtgattggaggcacctagaattgcatgatcaagaatacgccattcattttatattgcatgtttcgattagccatcttctcattagacaatcttactggcatcaaccaatttctgtagtcattgtcaaactagacctgcaatggtagcttaaattgttttctcgaatcatttctgttgacattatccttggtacttattgtgttctgttccattcacaggttctgacaacaaaggacttcataagtgtggatcaaccaaactcctttgattttgtcagcgttaagccagggccaaagctcctgaagtcagatttctagatcaaaaaccagctagcgtggcgcgatacatacaatcttaccatatctgtcacattaccaacaacatacagatctcgcatcgccgtgaccgtcatttttgttttgttctttttaatttatcctccctctgtagtatccccgcactaatctgtgtttactaggcttcttgggtaggattctgttgtacccccctccgtgttggctattcagtgtatatatgattagctcttgtaaagttgcttgtgtaatgtgatagcatcagctcctaagtccccgtctattgttgctttgaataaaccttcaaacctgtatacttctctgactttgagcaacctgtcgattaatttcaaatttattcagattcgtaggtcaatcgtgagaaaagagataacctttttttgtttgttttgcctgaagtggaggggaaaggttgctcaaaattctgtattggtattatatcattacaaccactctgctggtgatccgagtcaccagcatgaacgtctgagtgaccattgagcaatgtggggcgtgtgattaaagcagctttgatccctttctagcacatacgtaaagtgacacgctgctgtgtgctctcgctattcgcagaaaatgtaaaagcatcagcaaatgcaagacagaattggcagagaataaggtgtttggaaaatggaaattcttggaaggatgacaagtattaatcgacggccaaaaggacaggggaaagccgaccagaaatgaagaacggagcagcgaatgtcggtgccgaaattgtttttatctgcacggttagcacagggttttcgtgtcgcgcgtctcactagctcactgctcatgaaagactgaagtgaagcctagcaagcattgccacctgacgagtgacgaccatactttgatcgatggatggatgtatgggcgccgcaaggcagtttgtcccattgtccggcattgctgccgattcctttgcctcgtgcgcgcggcatcctccaccaacaacgtccgcacgaattccacgcccaaacaccggcaattcccgtgcaaaatcacgcgacacatctccgcgaactcaacgccacgcacgcgcgcggacgcaaagccgcgcgcgcgagccacgccgttgccttgccaccacggcgattttcatggcgtcgtgcgcgcgagatgccgagatccgcctcgcgtgcccagcgccatcctgtcggctacagtacgccgatcagtggagttcccatgggttgatcagacggacggcgagcccgtgcgtgaacagtagggtgacaagccacacccagccagtcagccacacgaagtggcatatatctcgagctatagcctgacctgacctgctgtttagcttgttactacctgtagcgcctcggctctcaccaagcaagtgtcggtgcattgtttttttttcccttcttcctctctcaaaatataagagtttttatccagatgtgacatatcatagcacaacgaatctagacagagattatatcccgatttattgtattaggatatgtcacatctaataaaaaaatcttatatttatagacggaaggagtacctgttattcattaccattagtagtacaactcgattggttattatttcttccatgagaaatgtcctatatatatagctagtttggaaaatgtttgcttaaattggaaatatgagattagcttaattatgtgatcaaaatcgatgccctttgatctagaggtgtatatatatgtacatatgtgtaagcatgattaggcgaagaaagttcaagtgtgaggtgtaacctgttatcttattcggcggatgcatgaggcgcacatggcatgtgacgccgtacgccgatgttggttgatgcacactagcatggatgatgtgtgcattgtcctcattcctcctccattatatggctagctcttcacaatgattaacaaataattaagctataagcacgtccctcgtctctcaattccttccgatctgagcattttgtcaccacttccctgttccgtctaatttaatgacctaatccaagaccgtatctgggttagaaaccaacaatctcaacgtttcctctcaccttaaaagggtactagtacaacgatgtaaaattgtggtactactacctcttttcctgtcgtcaaaagggagatttttacattaattcccttctcctgtcgatcatccaactcatcaactacttttgacctaatattttccctttttttctctctttttttttccaatgtgcttgcattacatgattacatccatgaaggttgggctgtctgtacggcactcattcattcgttcctctcacaaacactgaagcctgaaaacgattgagaagcaacacaagctactcctagctaggaaggcatgcagacctaacataatccagcatcacttagtgggtctaataaaaaagaaacaaatccaacaagcaaacaaccatgcataacaaaatgctcattgccaccacaactgctctaatctcactgtctctctctttctctcctttctgcactctgtttgcttacaacacaagaagaggaggagggtttcggttcagcagtcggcatcaggctccatgcagagacatggatggatccatccactgtgaaaagggtagtatcgctttgtgattaaagagagcaggaacaaaagggcctgcgaaagctggnnnnnnnnnnnnnnnnnnnnnnnnnnnnnnnnnnnnnnnnnnnnnnnnnnnnnnnnnnnnnn

SEQ ID NO: 18878 - DNA, 536 bp, Oryza sativa
gctccgaccgcgtcatggtgtgggatcagctcaaatccagctcgttccagtgagaactccacccaaattcacaaccttattcagttcttgatctgtttttctttttgtctaaatcattttgtggtgaattctttgcagggtgaatgaggagatgatcgagacattgttcatctgcaatccggcgaactcggcgccaccgaaggagccagcaacgaggaggccggtgctgccgacgcccaagacggacaacaaggtgcttgatccaaagaagtcgcagaacatcgccatcttgctgcgagctctgaatgtatccaaggagcaggtctgcgacgcgctctgcgaaggtgaagaacatgatctttctcttaacttactcatcacaattttgccagtttctgatgaactgcatactgcattgagttggggatttttttgagatgtttgcagcagtatctgaattgatgataccttctaactaattggattcatttttctcgtggttcttggttgaacacacatggagcttgtgaatcgag

SEQ ID NO: 18879 - DNA, 704 bp, Oryza sativa
gtgaatgttcaaatttcaatctttcttccttttcccctactaaatacaaaattaaatagaaaaaagttaaaagatgcaacaatgtgacaagtctagagcattaaaggtcagggtgagggagcaggtgacagaatgtgtgaatgtttacttgcattgtcagtttccatttggtgttaacatgacttgcagggcataaaagtgtgtactcatatggggtgtcaactagagccaaaattagaacataaaagtggtgttttaaaggtggcaaaacacgtagatggtcgaagatatgagactttcatatcttactggaccattggaagaagatacatacaacgcatgaacaagcttggataagcttgccagcagtttggcagatgctgaatgcttgagtgtaaaatacgtgcaaacattgcttgtggttcaaagttaacattttacttttttttcatcctgagttatcttttccctcatcacctataaatagctctcctttgttgagaaagaccaccagagagagaaatttgcaagtgatcaacagctgacttgtttgcctctgccatggagaagaattgtgcatgcccaccaccaagcaagggaaacatgatcacaattctgagtattgatggaggtggggtgaagggtatcattcctgctgtcatcctctcattcctggaatctaaacttcaggtcaatcctatatt

SEQ ID NO: 18880 - DNA, 1110 bp, Oryza sativa
ggcactattttgcccagatactggcaacccagtcagacttccattgattaccaaatcatcatcatcttgaagcctgacaacctcttttattgagagagtttgataaacctcataacaacttacgatcacggacacaacctgggttcaagaatgaattcagagactaatcagaacccttactggattactgtttctggcgcacttcaaatgaaactatcatgctactttttttttctattcatagactaatcaaatatcttccacttattcaacaagtctatctgtagtattaatggcatcaacttgtctatgctccaaagatgaatcttatgcaattccaacaagagaacaaatattcaccaggaggcatctatcaaccatgaatgagaattaagtcttaactcttaacattctagcccaacacagagtgataaggacttacttcatcaagttccatggaaatgtgtgagtggtcacccatgtattggacctgattacaaagtggtaaatgagtatattaggattaaaaagttaaatttaatcaatagactgatttaatggcatcagttggcaagaaccagtaatgcaagtataggattatctgttgggaattctcaagcaatatcaatataaccaacattaaaaaaatgttatatttgcaaaacaaattgtataatagttgaatgtagttccttattttgttctacattattatttctggtccaacaaatctactgtaaattagccctaaatggctagctcgcaacatataagactaccttatccatttcatcagagaatcaagtaaaaacttttcttaccatagaagcaagagcctgaagtgcagcacatcggaggcggaaccctttgtcatcttcccttagttcttgactaatttggcaaagttttggtatgaggccttccagattaaacatatgcgtgctatcaacctacatgaactcaaattaaaccaaacagatggcagatttctagcaaaccaagtaggtgcaatttgttacagtcgtcaataacctggccgttgagaaagtcaacaagcattagacaacccaggacccgcaaatcatcattcattctctgatcgagaagagt

SEQ ID NO: 18881 - DNA, 1894 bp, Oryza sativa
  unsure (1)..(1894): unsure at all n locations
nnnnnnnnnnnnnnnnnnnnnnnnnnnnnnnnnnnnnnnnnnnnnnnnnnnnnnnccaccaacgtcatcaaggtacacctcttgcctgattatcccgtgtcttctccgcttctgggttggttgcctaggtgaaaatcggttgcagcaaccatgttagtgaaaatgaatgaaacactagatgtatgagttttcaaatgacattattgatttttcagtttttttttcactattcagaggcaaatactgggccatggaagtgtggatcaaattaaatacgaaatggaaaaaaaaattaacaatccttatagttcctatgtctctctttttttatatatataatctctgattgttggaggtttttcctttgattattgtgagaccttttacaaacaaagatagatgatgcacgaccgactaatcggttagtggtttcatattctgtcaagttgcacattgctctaattgcatagaattcacaattgttgcacgttaattatgcatacaacaacagtgatccaagttagttctctacaaattttatatggcaatgaaaagaaatgacttcttttttttttcaattccctgcagagcttcttgtatcagttatgcaaaggagtcgcacattgccatggccatggtgtccttcaccggttggactctgttctctccctgtgatttatgttgctgggcttatcagccccatacagcattgcagttgttgataacatggtttatacttattcctgctcaattttgtagtgatttaaagccacaaaacctgttggtcgacaaggaaaaggggatattgaaaattgctgatcttgggctaggtagggcgttcactgttcctatgaaaagctacacacatgaggtaatgtttacacatctcatctgggctaatttctgaacatgctctagcaatttccttatatgtctgttttgtgttgcagattgtgactctttggtacagagctcctgaagttttgcttggatcaacacattactcaaccggtgttgacatttggtccgttggttgcatcttcggtatgctccttttgatctttgttacggctttgtgggggcacttcattcttatatttgaaaaaccaaaagcacaacctggatacaacttttaaacaaacgcactagcagattcatggtcacctgtttatatcaccctttaaacaaaggagaggtagatgtgcaccagcagttctaaagtttttcgtgtatgtgttatcaaggattctttagttttgaaatgtgtgtgtatatttgagctccaatttttcatcgctgtcatgatctttgaatttctggctgactaagcagcatatatcatacttttgcttcaagtttttcccttgctttcagtacaaaaaacatacggcctcctcattttgattctcgtactgttctatacagctgaaatggtcagaagacaagctctttttccaggtgactctgagttgcaacagttgcttcacattttcaggtctttcttccttctgcctttcatgattagcaagaagtgcagttatcataatatgagttacattgcttatctgctaagacaatggtttaataatttgataatcggtagttattgctgtagatgatgattttttttcataaatccatgtttgacatagtctgaacatatagctgtgtgatgaaaaattgccatgctagaatttcataaactactttctgtatagtgtgtgatagtttgcctcagcctgtataccttatggtaatttattcagggagtattatgcattaagccattgactaaaaccgacttcttaataggttgttgggaactcctactgaggagcagtggcctggagtaactgatttgagggactggcatgagtttccacagtggaagcca

SEQ ID NO: 18882 - DNA, 826 bp, Oryza sativa
  unsure (1)..(826): unsure at all n locations
ttgtttctatgctgtatggcatatgtattatggacaagaaggttgcaatatatttgcctgtttctttgacgaagtattgccaagcattagtttccacctttacacttgcaatgattttattagtcgttgtttagtagattatcaaattcattcatgtgctctgaggggcgatttgcttatatgttaaaaatcttttttgtgctctaaaaagatgaagccatggtccaatatttgtcaccgtaattagctgggatgctgaaaatgatgaagatgattgattaagtttgaaactcatgaaaataaagattaagttggtgcacataaagcgagaaaactattagtacatgattaattaagttttaattattataaacttaacaaattggtatatttgatattttaaagcaactttcatatagaaattttttcacaaaacgcaccgtttagtagtttgaagagcgtgcttatggaaatcgaggtaaaatcttaatcttgagaaaaaaaacatcaattgactttcaattcaactttagtgagatcaagcatatactattagtttacgttttttgagcgtgtactacttttccgttccaaaatatagatattttttaggttaacacggttattaagaaattagtatgtgataattattaaagaaaatgtgtgattaattgaaaagagaacgtatgtgaaagagaatagatgtgattagttgagaggaagacgtaggaaaaaaaattgcttcattttaagacaagacactgtattataaataaattttttttggataaannnnnnnnnnnnnnnnnnnnnnnnnnnnnnnnnn

SEQ ID NO: 18883 - DNA, 3173 bp, Oryza sativa
  unsure (1)..(3173): unsure at all n locations
nnnnnnnnnnnnnnnnnnnnnnnnnnnnnnnnnnnnnnnnnnnnnnnnnnnnnnntcagatgtgctatttagtttgtcattgatcaaattcagaggtttgcccataccaataaaatctgaatcaatgccaaacactcatgtttacagccctcacgcttataatctccatgcttctttgctgctgctgttgtatcagtctttggttgtccttcagtaggccccagtaagcaattaccagtgtagtaaaactgtaaaagtttgtgtttaacattctagtctctgaatatccctttatctttaaatgatggtgggccgaggtcttctctgttaggtcactgatgatggactgatggttggtgaaggacaaagtgacctgccattattgccccccatggaacctgtatagaagctattggccccttcactttcttttctgttcaggggcctatctgttgtaggatttgcctctttattctgtcaacaagaatctacggatactcatcaagagcatggcccctttgcaaaattgcaatggttctctcgtcactttatatggagcttcatgccgttgcattgctgctttggattttgatgatggtagcgtcaggagcaggaatcaggccgttgcaagggcctagctgttcagagctttcagatgtactctgatgctggcactcttagaattgttggttatactctttctgtttctgtagaggggttgctacagggatggactctacctgttgagccactctggtttttaaccaaataaagtataaatacacaacactggctacgaagtactctctctgttctgaaatttctgatggttagctcatatttgaactaaccaatgtaaaaggcagtatgaattttagttcatttggttgaactagagtaggcctgacaagaatccatgaaggttaagccaccgcagccatccctatttgatatttttctaaacattttttttcttctgctctcatttccttgcctctttcttttgtgcttagatgtcaattgtgtgaaactagtcaatgatctgatccatcagtgacagtgtgacactcggcctgcaataactaattcatttagggcctcttgtcaactggttaggtccagtgatcacctccatttgcaggcccaagatgtcctcttcttttttattactctcttgcatctttgttttggcttcctttgctctggttcatgcacaaacctgaacctttctcagagcatctcagagaaatagctcgatctggtatatattctgatctgaagaagaacgggagcccgttcaggagacacgcctccctttaaagattacgtaaacaaggcatcacaccttgcaactttcttctttgcgaaaagtgagaaccatggtgcatgaaaaagctttgattcgtgggcaattcctcctcacgtgacaggccaaagcattttttttcttctttgcaattttgcattgcatggtagtacaatggaggaacattttcaagtacgtaattattctgattagacgataaagatgccaccttttcttgtgttagcatccctgattttatcaggaatgccatgtggtgcagaagctgccttgctttctacttgtgaaaagcaaagtagtagtagctagatcaagtagaggtagattcaggctgaaggatcaattgcctcttttgaaggagctctgcttggactgaagcagcaaaaaataagttaattagcagcctttgttttctgttcaagtacctgacatctttgtaacctgtcaggctcatatccccgattaagaagtttctgaagaaaaaaaataaacatattactggatgttactactctagttgatttctgatttatggtttgtgcacacatcattcacaaccggtgaagagctcacagcaaaaagccttcagagttcagagtgcttacctttcatggacagtgcaatcacagcacattcataagacatcattgatattgttactaacagtagtttgcacatgcaactcatgagactgatgtagcggaggaatatttaaaaggtttagcgtcattgcaagaattgagtagcacatctccaaatcatactagtactcagtacctgtcattcatcctctttggcttgttcagttgttctctccttccaaaattcagaatcttttctaccccagtagattgccatggcggggtcctctctaccttccaactcccaactgctaccactaatctaagacctagtatcacctccaagattcataaaacagatcggttttcgtgaaaccgctaatggatggtttgtggaaaccaatcttagctggttttcgtatggcattaccaaaagttgttggtttttgctagtttttatcggttttcagtaaatggtgagaagcgtgtttattttcaaaaaggaaatgcaaaccctgatcacctctgactatttcttgcttcctctccttagcatgctcatagttctttaatcatagtctctgacgaacatatgcatctcatttgcagccaaattgatccatgtgtgtgtgtttggaggccaaaacaaagagcttttttcttggctttggggtccaatgatttgagtccattagagaagagaatccacaaggtgtaggagacaaagtgagccatgtggggtttgcaaaatggcaaggaaagagtttggtaggaaagggggcgccatgccacaacgttttgtgggcatggctacaaggcatggttgtcaccctcacatggggatggggacctaacgaaagctgccacccaaaccaccgtctctgagagtctgagggtgtgtttagtttatactaaaattggaagtttggttgaaattagaacgatgtgatggaaaagttagaagtttatgtatgtagaaaagttttgatgtgatggaaaagtttaaggtttgaagaaaaagttgagaactaaacgaggcctgagtctctctctctccccggagtactacttctactatgcatgccatgaagccatgggaattctagctcacatggaaaatgaaatgttcagttagttaagctacaggcattatgtatgtttaaatgctcaaaatgggaagttgattgaaccattacttgctgggtttttttttttacaatttggtcattttttgaaacatatttggtaaatagactttttaaaaaaaa

SEQ ID NO: 18884 - DNA, 825 bp, Oryza sativa
ttttctcacgaaaatggaaaatcgaaaaaaaaaattccaaaacacaaaaacctaaccctaaccctagccggtcgctgccaccatcgtcgccggtggatccgcacctcccgtcgtcgctgccagcggatccgcgcatgtggaggccggatcccgcgcctgccgccggatacgggcgggggagagctgccgctggccttccgctcgagcccgtcaccagatgagcgcgtgggatggcaggggagagccgccgctggcctcccactcaagcccgccgccagatccgcgcgggagggccaagggagccgccgccttcgccgttgaccgcgccacctgccgcccgtcgcatggccgccaaaggcggatctgaccgccaccgagccctccgccgccggccgagccctccgcctgccgtcgtccgggcccactgcctaccgcgagaggagagtgagagaggagagcaacgcatagtgagattgtgcgaagaagaggtgagaaagtgacagagaggagatgagaggatatggatgaaaatatttgaagtgttgagaaggaaagataagggaacctaggctttatgcggatccttaagagacccgtatgcgaaaatcacggccccttaagaggtccgcctacaaaaatagacttatttttttagtgcggaccattaagaggtccgcatgcgaaaatcgatttttgtgtgtggtccttttaagggtctgcacgcgaaaataggaggataatttttataaacacgaccagttacggttcgtctgcaatctaaagaggtccttgtacagaaaaatagttttttactagataaataac

SEQ ID NO: 18885 - DNA, 555 bp, Oryza sativa
  unsure (1)..(555): unsure at all n locations
actataggcgaattcgagctcggtaccctatattttcaaaagcgaacaaacttaaaaactaactcaaatatgaatatgtatttccaaaagcgaacgaatttaaaaaccgactcatatacggatgacgtacctatcatgattacggataatacatacttcctatcctatgacctatgaaatatacggatacaacatacctttgtatgtacgatatacttctatatacaataaggaaattgataagagattatgaaaattatcctccggagcttcgattctcttatccttctggtcacttggaatagctttggaggtagcacaacgcgcgcttatgtctttgacaacatcttttccccagtctaggtgattgacgatattccaagagcggtcgaatattgctctccactggcaaccttcacataggggtgtatacatggatccacactccgtccattctataatatatggtatcctactttttttttatattaaggagaaagnnnnnnnnnnnnnnnnnnnnnnnnnnnnnnnnnnnnnnnnnnnnnnnnnnnnnnn

SEQ ID NO: 18886 - DNA, 481 bp, Oryza sativa
  unsure (1)..(481): unsure at all n locations
ggcgaattcgagctcggtaccctaaaagaactgaaaattaatgaatgttgtgataaacgcacaaacctgtagcgcctttatctccttttcgtacgtgtcgataatctgcgaccgctcctgcgacattttcttttcataatcattgagccgattgtgctgtttaagaaatgcgcgcttcaggacaccgttctgttcgagaaggcctcctaacatcagcttcagtatcttgtgttcctggaagtatcagtcaagttgatcagtcaagcttccataactttcataactggaagatattgataattcaagacgacattattataactggatggagtagtatttgttacctcgcgcatcttccgcatttcaactggactgatacatgctgcagtggatttctcgaataggtcaagtaacctaaannnnnnnnnnnnnnnnnnnnnnnnnnnnnnnnnnnnnnnnnnnnnnnnnnnnnnnnnnnnnn

SEQ ID NO: 18887 - DNA, 490 bp, Oryza sativa
  unsure (1)..(490): unsure at all n locations
aaagctctcttttcttgttgggggggggggagttaaaagtgtgcatgtttccttattcttcaccaccacttacttaagtttttttttgtgaaaaaactaatcaatatgaaatgggaggaataaataatatctatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccataaaaataggaaacaaacttccatctgttataccaagtcctattcggttagcatcaccaggagaaccgacaccattcacagagagagagaaagagacgatgccgccacctcttccgcccccgtcggaccgcagccgcctccatgccgccgaatctggcggaggcgaggtccggcccgccgcccttccacccccgncgggctgcagctgccttcacaccgccg

SEQ ID NO: 18888 - DNA, 716 bp, Oryza sativa
caaatcttaagaatgatagacaagcatgtgtgtatacattcatccttacttcttccgtcttaaaaaaaaataaaaaaagataacctaggtggtggtttgacacgagcaacatagcctagatatgtcattgttcatgttgcacaggagaagcatatgttttgcccagtatggaacgattacaccttccaatttccaagagggcatctttgaataatctggtacagtagcgcacaagacacagagaaaagaactcactaatcaaggctacaaggatttcaccaatatggccatcggagagcatctaaagctaaagctatacacacaccaaaatgatctttgcgaacatcagcgagtctcttcatctcttgctatctttcttttaatttatttacctggcggggtttcgatgcggtccttgatgatcttctcaccggatctgccttctcgcccttgctactggtgctaactttgtttggttcagcagtctcaccatcatcttcactatagtcactacctggtttctccttgccaccaccatttttccttgtctttctggaaagggcacctatggcatctctcttttgctttcccctggcaaccctagaaagttgctctcgcttctttgtattcaaattatcagcatcttctggatctgtgtctatttccttcgcatcatcgttctctggcacttgttcctgggtagcaatgactacttt

SEQ ID NO: 18889 - DNA, 1507 bp, Oryza sativa
ggttcctatcaagaaaccgctgagtaatctggataaattaaaacaaattaaattcgaaatttcattaaattgtttctaaatttctgataaccaacgaaacgctagcaacaaattgttttttttatgaaacactggatagaatacacaaagattccattaattttcataattccttttggcaataatttctaattcaaaaaactagctgggtgcagaatgcagagctgactaagaacaagggattgtttggaagagcttttagcagctatagcttctcacagaggccgtgtttagttctttggccaaatttttttaaagtatacggacacacatttgaagtattaaacatagactaataacaaaacaaattatagatttcgtctgtaaactgtgagacaaatttattaagcctaattaatccatcattagcaaatgtttactgtagcatcacattgtcaaatcatggcgtaattaggctcaaaagatttatctcacaatttacatgcaaactgtgcaattggtttttttcgtccacatttaatgctccatgcatgtgtccaaacatttgatgtgatatttttagccaaaatattttaggatctaaacacacccggaatcttcagctcctcaaacggtccatattgttacccaaatttttctaaaaatccatagttgtagaatccagaaaatgaaaaatctaaaagctgaaaaacccagcgtctctaaattttcagaagttggttaccaagcagaagaatatcaaatctgcggctcccctaaacaaggcccaacaatcagccacctattgagcaaaaacagcaagcaaaatgcaagcatttaaactccattgcttagatacaaaatcctttatgctttgatttgatccaagctaacccaccagccatggcggaggttgtacagctctaccacctcatcttgcttctgccgctcttcatcctccccttcctcctcctcctccgttagttgtgccggaatagtaatattttccaatttccaggaattttaggaaatgaaatttcgagggactttgcttaggaccttggaactctaatgattctacgactttatatgagttcttgtatgaatttttgaatggtttaggaggggactcgaacctcgaaatttgaatcttagaaatttaatttaggatagaatattttggtcaagattttgagttcacaaaggaatgaattaattgagatctttggtactcaaacctagatacactcaaataaccaaacttttgaacatagaattttattaaatagtttttaagggtatacggaaaatggggcgttacaggatttgcagcgaagcttatgtcttcttgattcttaacctaaaataatgtcttcttgatcctaacctaaagtaaagggattggcaacgtacaaaaaaaatatcaaggacctaaaaggaggtacacaacgatttttttttaaaaaggcgaaaattagagaaagaactatctctactattataaaaa

SEQ ID NO: 18890 - DNA, 11141 bp, Oryza sativa
  unsure (1)..(11141): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatattcatttataatatcatgtttgtgcaaagaaaaatacttgtggtgctatttattttgctcatatgtatctagtataaagtatatagtttgtgttttttcaggatagtaacttcagtttagcactatgcgatcactggatgtttaattactggatatttgaattattatgcaagttcatctacattattttgtctatattactgttaaacggtgtgtttcgtacgaaaactttacagcaacttcagtttagcactatttcgatccgcccctgctggtttcatgctgaattatagaaaacatctgcactgcccatctgtcagtaaaataaaataaaggtctcgtttccaccacaaagagtggataaagttttgaatattcgtggcacgcttttcaaactgttaaacgatgtgtttcgtgcgaaaactttctatgcgaaagttgttctaaaataatagattaatctatttttttaagtttataataattaaaactcaattaatcatacgttattatcaccttattttacctgaaacactttatctttatcttaatcttcaggagatacaaacaccaccaaaatatgagtgccacctgttagcaccactctctttctttccccaacttctctctgcctcacagtcaccctgcgacaagcacgagctaaagctccaccatagggactttaggggcgccatcgtttcgctttttttctaataagccaaaacggcttattagaaaataaaaattgaatttgtaggtaaaacttttatatatgtgttctttgtgatttaaaagccaatgctaaaaaaatctacgttgaaaatatctcaaagtcattctcaaaattaagtttgaaaatttaaaatttggttttttttcttattaggccatccgatgggagcctagggaggcagttgtgtagccagaggttgccattgcaatgaattttctcaagctagctaaagaactgttgctactgtgtttgcacatgatgctagtctacgtgggcaagtattttctacacccaggtgccataacatttaagtgtatgcatgtagttcaaatagttatataaaaaattcataaaatttgataagataaactatgacgatataagactctatataaatatgaagtctaaatttgatctacacatgaagaaaaaataataaattttatctgcgttatacaggttctatttactatcagtttctattatttttacactactacaatagatatttttgcgtgtggttgttttgatttttgcgtgcggtagattcgcccgtttggagcgggctgtctgggaaaatcgtgattttctcgtgcgggtgcttatgtcacccgcacggaaaaataaaaatctgaaaaaaaaataaaatttcaaaaaattgaaatcctaaccatagatcggggcaccctgccgccactgccgcgccggctcccaccgccactggatccggcgtggggtagccgccgccaccggatccgggagtggggagggcggcgccgctcccggacgccttgcgcgagcgttgggaggaggggaagagtggtcaagtggaggcagcggcggtgctgctcccggccaccgcctcctcgtcgtcgtcggcggcaacggccgccgcgttgcctcgtcgtcgtcatcgtcgtcggcagcctccgccgcacccctgagcccaccggcaatggatccgcctcccccgagcccaccgacgatggatatgtctccccgaggccgccatcgttggcgcgagctcgccaccatcgtcatcatcgtcaaggtcagtcgtcatcgtcgttgagggggcgcggccgcggctccatcgctctccgcgtcgcctcccacgccatcggcggtggcacccgtcccgtgcgcactcggtgaggagaggaggggaggagaggaaagaggcagagagagacgagagagaggggaggggaggagaggaatataatagggaaaaaggaagagagggtgtcaaaaaaaattgaagtgggtgagagagaaaataggaagggatattttattttcctgtgcggtccacttaaaaagcccgcacgcgaaaatcgatttttctatgtggtccacttaagttgaccgcacgggataatgaggattatcccgtgcggttggattaagatgccagcacgggataattgattttcccgtgtgggcgtccgcccgatgccggtcgctcgattatcccgtgcggttccactcatggcccgcccaaaagggcccggcgtccatgaaaaatcattcgtgtagtagtgttatttctctagttgtatatcaatctaatcttgtacgtttgtgtatcgatttataacatcacaattaatgttactttttcctataactatctaagtcgcgcgtaaatgatgggtttcatgacatccatgtatagaaaatccttatcatgtacgtgcagttgcctggctagttgtatatatcatatatgagctcgtagcttagcgggatgcgagtatggcgtgggatgcgaatgttagcagcatgccttttctatttactttggcggcttagatgcttagtgatcaggctgttattatacacagagatgacattagttttctttgaaagtaattcattaggttgatgcagatctgaccaataatcgaggctatagctatagccttagttaattgatcacttgttcttacaattcgtttaattgtaggaaatcaggaaccgatataggttagtcaaccatctcgttagtgcaatgagggatataaaagtcaccatataccgaattaatgagtatcatccatctatcatagtaaataattagattcctcaaaataacgatccaatgatcaagtagttaaaatatcacctggttactgtggccatcagttatcttagccggttcctatcaagaaaccgctgagtaatctggataaattaaaacaaattaaattcgaaatttcattaaattgtttctaaatttctgataaccaacgaaacgctagcaacaaattgttttttttatgaaacactggatagaatacacaaagattccattaattttcataattccttttggcaataatttctaattcaaaaaactagctgggtgcagaatgcagagctgactaagaacaagggattgtttggaagagcttttagcagctatagcttctcacagaggccgtgtttagttctttggccaaatttttttaaagtatacggacacacatttgaagtattaaacatagactaataacaaaacaaattatagatttcgtctgtaaactgtgagacaaatttattaagcctaattaatccatcattagcaaatgtttactgtagcatcacattgtcaaatcatggcgtaattaggctcaaaagatttatctcacaatttacatgcaaactgtgcaattggtttttttcgtccacatttaatgctccatgcatgtgtccaaacatttgatgtgatatttttagccaaaatattttaggatctaaacacacccggaatcttcagctcctcaaacggtccatattgttacccaaatttttctaaaaatccatagttgtagaatccagaaaatgaaaaatctaaaagctgaaaaacccagcgtctctaaattttcagaagttggttaccaagcagaagaatatcaaatctgcggctcccctaaacaaggcccaacaatcagccacctattgagcaaaaacagcaagcaaaatgcaagcatttaaactccattgcttagatacaaaatcctttatgctttgatttgatccaagctaacccaccagccatggcggaggttgtacagctctaccacctcatcttgcttctgccgctcttcatcctccccttcctcctcctcctccgttagttgtgccggaatagtaatattttccaatttccaggaattttaggaaatgaaatttcgagggactttgcttaggaccttggaactctaatgattctacgactttatatgagttcttgtatgaatttttgaatggtttaggaggggactcgaacctcgaaatttgaatcttagaaatttaatttaggatagaatattttggtcaagattttgagttcacaaaggaatgaattaattgagatctttggtactcaaacctagatacactcaaataaccaaacttttgaacatagaattttattaaatagtttttaagggtatacggaaattggggcgttacaggatttgcagcgaagcttatgtcttcttgattcttaacctaaaataatgtcttcttgatcctaacctaaagtaaagggattggcaacgtacaaaaaaaatatcaaggacctaaaaggaggtacacaacgatttttttttaaaaaaggcgaaaattagagaaagaacttatctctactattataaaaattgaatatctttttgccagtactttagcactgtcaacgagaaatctcataaaccggatgaatagggtattgtggtaagttggtatgagaatttacacgatacgacatcaagaaaacaagaagacaagtattatactggctcaggcccctcataaggtaatagctctagtccagtttatatgagattgatatggaaaactacatattagaatagagaacaatcaatcccaagattggcggcgagacccctcgtcgagatgatttcgacgagatctcccggtgagtaggcttcacgtcctccggattgtaggctatggtggtggtattggcgctatgattcgatgatctggatccctcaggggatgtatcttttataccgtgaatcaccttagtctccaagtagaactcggagactacggaccctgcacgatataatataaacccaatcctcaaggtagggctctactattcacttgtccatgaggataattttcatagtctcttgtcattttccttgttgtatatggaagtatatcgtacatacgaaggtatgtcgtatctgtatatttcatatgtcataggatagtaagtatgccttattcgtaactatgacaggtacgtcatccgtatatgagtcggttttaagttcgttctcttttgaaaatacatatccgtatttgagtcagtttttaaagttcgtttattttttaaaatatagaaggagtcgtataagaaatctatttaaaaaaattacatgctagcttgagacgatcggattcctaattgcagctcatgattttctaaaaaaaatatgtccaatcgaattcctatggcgaatttcaccttaactaaaccgtataataatattattattaaaataatcttcacccgttgcaacgcacaaatatttttttctagttatcaaataaataaaaggagttagactttgaaactagaccggctagcctatcatcttatggagctagctataaaacccctgaccgttccgcggattttctcaaactagaaaaacgttgctacgtactgttgtcgcacctagtgctagtcacgtgtagtacgttgcttagctggatttgtataaatgagggtattggcagttaacacctggcgggggatgcgagaatattagcagcgtacttcttatattaactttgggggcttagatgcttagtgatcacgatgttctatgcacaaagactagctacagtcttagttaattgaggctaagattgttgatgcagattggatggagtattcaaaaaataatccattagttgatgcagatcgatctgaccattaatcgaggctagctacagtcttagttaattgatcacttgttcttataattcgtttaattaccaacaagttggtcaactaatctcgtccagtacaaggtataaaagtcaccctactgaattcatgaaataatctcgggaaagatatatcgttcgattctccaaacattacgatccaatgggcgatcaagtagttagaatcatttaagaaaaaaatagaaaagatggcctcttgggttgccttgcgtggggaggctccctagccctagcccgcctcctcatccgatctgctccgcctccaccatagccatcggcactggtgggcggcggatgtagatcggacatttaatgctccatgcatgtgtttaaatatttgatgtaatatttttggccaaatattttgagatctaaatacacccagaatcttcagttcctcaaacagtccatattattactcaaattttttttttagaattcagaaaatgaagaatccaaaagctgaaaaacccagcatctctaaattttctaagggactagcttaaaaaactgtcgagtgttttttgaggggaaaacttttaaatctaactatagtatataatttcactagaactatactataataataactggtacatatatgtattaaaataatatatacaactttatatctaatttatatagagataacaatatagttatagtgtagttacactatagttacaatataattacaatgtaattatagtgtaactacaatgtaactagcatataactgaaatgcaatttagatgtaacatgaacaaatttaccatatacatgtgatgatgtggctagcttatgaaaagagggtttagatccggtagcaaaatatctcagcacaaatcttaaagcgaaatcgacggcctaaaaatttgtcgacagtcatttagcagtttcgattttctaaagttggttaccaaccagtaaaatatgaaatctgcggctcccctaaacagggcccaacaatcagccagctattgagcagcaacagcaagcaaaatgcaaacatttaaactccattgcttagatacaaaatcgtttgagctttgatttgatccaagctaacccaccagccatggcggaggttgtacagctccaccacctcatcttgcttctgccgctgttcatcctccccttcctcctcctccgttcgtcgcgccgccggcgtggcgcctgcggccggctaccaccgtcgccatgggcactcccggtgatcggccacctccaccacctagccggggcgctcccgcaccgcgccatgcgcgacattgcgcggcgccacggcccactcgtgctgctccggctcggcgagctccccgtcgtcgtcgcctcctccgcggacgccgcgcgcgacgtcatgaagacgcacgacctcgccttcgcgacgcgccccatcacccgcatgatgcgcctcgtcttccccgagggctccgaggggatcatcttctcgccctacggcgagacgtggaggcagctccgcaagatctgcaccgtcgagctgctcagcgccaggcgcgtcaattccttccggtccgtccgcgaggaggaggtcaaccggctgctccgggcggtggcggcggccgcggcgtcggcaacctcgccggcgaagacggtgaacctcagcgagctgatgtcggcctacgccgccgactcgtctgtgcgcgccatgatcgggaggcggtgcaaggaccgggacaagttcttggcgatgctcgagcgagggatcaagctgttcgtgacgccgagcttgccggacctgtacccgtcgtcgcgcctcgccatggtcgtcagcaggatgcctcgccggatgaggcggcaccgcgaggaggtgttcgcgttcttggacgccattatcgcggagcaccaagaaaacagagcctccggggaagatgaggaggacttgctcgacgtgctcctgaggatccagagagaaggttgcatggagtccactgttatccaccgaatccatcaggacaacaattggaggaagtactcccatgaacacacaaataactcaaaaaaaagtacaatcgtaatttcacgcgaatagcaaatatcatcgccatctatagttatactctgtaatctctatctctactattacaaaaaattaaagatatttttgtcggtattttggtccgtcatctgtgtatgagttggttttcaagttcgttcgcttttaaaaatacagatccgtatttgagtcgggttttaagttagttcacttttggaaatacagaaagagtcgtataagaagtctttttaaaaagctcgcatgctaatttgagatgaccagatttctaattgcagcttatgattttctagaaaaatatatatcgaaacgaattctcacagtgaatttcaccttaactaaaccatataataataataagataaaaataatctttatccgttgcaacgtacgagcattttttttctagtaataacctgccactttgtaggacacacaaacgagagattttgcttatttcctaacccccacaaatcctaagagctctagctcaataggcacctaaaaagtaacagcaaaattaacataatcatatataatatattagataataaaaataatttgttatgggcttcaaaaaatatatacaatgagctatttttattaaaagaaatccgttgtaacttagtagtgttatgctagtaagaataacgcgtgaggactgaacctacacgtcaatgacacatatatactataattttgttttttgatacaatgatatttttcagcaccataatttttttacagggttaccaagcaaattagcaaaaagttaccatggcttttccacaaaatgtagttacctgaaaatttggcttcatggtacacaggacttgttcaatgggggcagtgagacgacagcgacgacgctacaatggattatggctaaactcatgagaaacccaagagttatgcaaaaagcacaagatgaggtccaacgagtattcattggtcagcacaaagtcacagaagaaaacctaagcaatttgagttacatgtacttggtcatcaaagaggcgctccggctgcacccgccaagaccaccactgctgccacgagagtgtcgaactacttgccaagtgctagggttcgatgtgcctaaaggaacaatagtgctcgtgaatatgtgggctataaatagggatcctaagtactgggaccaatcagaagagtttatactagagagatttgagcatgttgatatcaatttcaaagggatgaactttgagtatatgccgtttggagcgggacgacggatgtgccctgggatggcatttggtctagtgaatttagagctcgtactagcgagtctcttatatcactttgactggaagttatctgacaaaataagtcggtgacctagacatgacgcaggagaggggggccaccacacggcgactccatgatcttttgcttgtccctgtgattcgagtgccgttaccgttagactcgcgcagctagctaggtgctagataagtagcttgtgattttttatttcttgataaagcgaccaaatatattggttcactaatgtttacctatgttcaaaccttaacaattaaattattacaaaactacttcaactcactgtgcaattaattacatttgtacattccgatatgtattttaatatacagtttctctgtgctattcatcttttgttattgttatatttgcagatttatgtgtcatatttattagacgaaaagaagtagaatacaacacaccacatatgtccggcggcttctctggataggaagaaaaagaagcatgcagctacatgcaacttccctacttcctctggatccactttcatggcaaatcttaaactggtgtgacaaacaaggaccgtacgtagtttcttttcctttctccttaatatataaaaaaagtaggatcccatatattatagaatggacggagcgtgtggatccatatatacacccctatgtgttgccagtggagagcaatattcgactgctcttggaatatcgtcaatcacctagactgtggaaaagacactttcatggcaaatctcaaactggtgtgacaaataaggaccgtacgtagtttcttttcctttctccttaatataaaaaaaaagtaggataccatatattatagaatggacggagtgtggatccatgtatacacccctatgtgaaggttgccagtggagagcaatattcgaccgctcttggaatatcgtcaatcacctagactggggaaaagatgttgtcaaagacataagcgcgcgttgtgctacctccaaagctattccaagtgaccagaaggataagagaatcgaagctccggaggataattttcataatctcttatcaatttccttattgtatatagaagtatatcgtacatacaaaggtatgttgtatccgtatatttcataggtcataggataggaagtatgtattatccgtaatcatgataggtacgtcatccgtatatgagtcggtttttaaattcgttcgcttttggaaatacatattcatatttgagttagtttttaagtttgttcgcttttgaaaatatagaaggagttgtataagaaatctatttaaaaagaattgcatgctaacttgagaagatcggattcctaattatagctcatgattttaaaaaaatatatatatccaatcgaattttagtgaattttaccttaactaaaccatataataataataagattaaaatagtcttcacatgttgcaacgcataggcattttttctagttatcaaataaataaaaggggttagacttcaaaactagacctgctaatctatcaccttgcggagctagctatagaacccctaagcgttcctcggattttcttaaactagaaaaacgttgctaccgtttgtcgcacctagtgctagtcacgtgtagtacgttgcttagatggatttgtataaatgagggtattggcagttaacacctggcgggggatgcgagaatattagcagcttacttcttatattaactttggcggcttagatgcttagtactcgtgatcacgatgttctatgcacaaagactacattagtattcaaaaaataatccattagttgatgcagatctgaccattaatcgaggctaactacagtcttagttaattgatcacttggtcttacaattcgtttaattaccaacaggttggtcaaccaatctcgtccagtaca

SEQ ID NO: 18891 - DNA, 1498 bp, Oryza sativa
acaaaccaagccccgcaaaggtcatcgcattgatttgaacaagatccaataagggagatatgcctacctaataagggccccgatggtgccctccccataaagtggtgttagtctaatcgatgatgataccaggcgagacacttgaatatgttcgttgataattttattcctattttcgggagttcattacaatgatggcttcttccatttacctagtagcgctttgtcccaacgtgctacaaatcatcactgcttggtctgtgttgttggtgatcaggcattggttgctactacgtacgcaggtagcgacttctattttgataaggaagattcgtggttgctaaaatcagttcaacagctacgatcaattgtgagcagatcgtgctcacccagagtcgtcattagtactctgggtgaaaaccctaatatggtttatctagattcgacagcgtcgatgcttgtttattattttctttattgaaggtgttatctcaagctcccaataaaaaaaatctagtcctgtttttttatggctgtgatagacaagcattaggtccttcttgaaatcattgtttcagagtagatgtgtatcactttatattcttgtctagattattgtgttttgtatgagttgatgtaaacaatatgatacgttcatagttgcttagattgttttccttttcttttctagctgtgtgtgcatttcgggttgatgtagagaccgggcgtagttatatttttaatgaaattattcttattatattaaaaaatcgacaatcacctagttactatgactatcacctgtcttgagccagtttgcatcgataaaccacttagtaagcctgccaaattaagaaaaacaaatttaagtgcgaaatttctataatttttttctaagtttatgataaccaacacgaaaacgctagggagcggatttcggtgggcaaacggttttataaaacctggttagaatacacatggatttagggccattaattctcattcaaaaagactcgctcgtgcagaggcgcagagctgacaagaatcagccagctattgagctgcaacagcaaaccaaatgaaagcattaatttaaactccatttctgagatacatgcatgtgaagctttgatttgatccaagctagccctccagccatgaatattctgagatgcatgaattttgaatcttgcttctcctgctgttcatcctccccttcactggtggagaaaccatctttaatcgatccggcaaaatccacaatagtcccggatccaaaaagaaccgggagtaaagattgtttttagtcccggttataaaaattatgatctttagtcccggttggttctttactcccggttcatcccctgtcagatgtatgtcgggggccaaggatctttagtcccgatcggtaactcaccactttaatcacggttggtactaccaaccaggactaaagatcaagatgatctttagtccaggttgatagtaccaaccg

SEQ ID NO: 18892 - DNA, 7563 bp, Oryza sativa
  unsure (1)..(7563): unsure at all n locations
cggcagtggcattctctttttttttaatttgtgatgattcactgagatgtatttgactgagaagttacaaatttgtgattcattgtttggatctgtgatgtatttgagtaatttcttaggatattgtgatgtatttatttgtgtgtataagtaactttgatttgtgatgtagatttgagatgttacttcgatttgtggattgggggtttgatttggaatatgtatcccacgtgatttgggagaaaataaaaaagaaaaaaaaagaaaaaggggatcatctcactgccgtaaccctctctttagtcccggttggtgttactaacagggactaaagatctatttttagtcccgggtatttgaactgggactaaagatagcgatctttagtcccggattggtagtcccagtttgaaaaccgggactacatggggttgcgaaccgtgactaaaaagcatttctccaccagtgcttcctcctactctgaaaattcaaatatatattctcgactattctagaaacaaaagttaataagaggctgtgcctctgtggtggtactatgctgctgtgaaacatgtggaaattagtcaaacaatagtcttattatgtgtgacttctagtattcttatgcgtttggattagggcataaactgcagaggagccacagtgaagttgcattaggcccatctctacaccattagatgaaactccgtgaaagtccaatggtccagatcaggttctacagtaaaatacgctacagtacaccatctgacctgtcatactgagggttactgtttctacggtaattaggtggtaccccgcgctttgctgcggattcatagatgagtatatgttaaatattgtcgaaatgatgaaagttgaaatgttgagaaaatagtgcgaggaagatgatttgacacatacttgttgatctctatgatataatattatatatgacgtgtcatgtttgcatgggaattaaaataagctggaatagtaattgctagtgagtgaagatgtgtcatgcgtgcatggaattttaaatgggctagaatagtactagtgggtgatgatgtggcatgcttgcatgttgagctttagcttctaataattgttagtgggtaccaattatatagaaagtatagatctactgcagactagtatggctaaagactcaagacactgttgtaatagtgtctttctgctgttacaacaaagactagggctgtcaacgagcgagctcggctcctaagcacaagctcgagtcaagcctattgcaccttcgagcttttaggcaagctcggctcgagctcgttcgagctcgagctaagctaccgagctcagtaataagtagtgtaagatatattttagtgataatccattgataagtataattattttctaattaattaataaaagagtaaaaaatgattaaaataaatatattgtgctaacacatgctaatttattgtgtaaatagatactaattaatatatatatatatatatatatatatatatatatatatatatatatatatatatatatatatatatatccattagtttattaaatcaataaggtaaacaaacaatataaactatacgctatgtataagctcggtaaactcagtagaagctcaagctcggctcgataaagctcgcaagtttttgctcaagctcgggtttggctcgtttggagctcgaatcgagcctagaattagccaagctcgagctacttgcaagcttcgaccttttttgacagccctaacagagactattattatacaagttctccctcgtaatttactccattcaaattcatattactaacatatgtctaatttatactctctctccgtcctaaaatataagcatttgtaggatagtattaagtcaaacatttttaacttttaataattaataaaaaagattaatcatgtaaaatcgatgttactagatttatcattaaacgaattatcataatatgtaactctttttatttaaaacatcttatttttatagatattatatattgatcaaaatagtatctctaagactatatcgaagtctaaaatacttatattttagtacagaggagtttcgtatattttcagacggagagtaccagatgcgttcaggaagtcttgacattgcattgcatgtcgatagcatcgcatgtcgatagcagcttataaataggcaaccacggacaagacgagcttgcagctatctactgtagcaaccactgtaacgtgcaacacttcagttcagcagcaaagcaaataaaaacaacacaaagcttctctgttctttctctcctcacgatcgaacaccatggcggcggagctcgttcacctcctccgctatctgttctcggtacccatgctgttcttcatcgtccccctcctcttcctcgtctgttcgccgcggcgccgccgtggccgcggcagctgcaggctcccgccgtcgccgtgggcgctcccggtggtcggtcacctccaccacctggcgggcgcgctccagcaccgcgccatgcgcgacatcgcgcggcgccacggcccgctcgtgctgctccggctcggcaggctccccgtcgtcgtcgcctcctccgcggacgccgcgcgcgaggtcatgaggacgagcgacgtcgccttcgcggcgcgccccgtcaaccggatgatccgggtggtcttcccggagggatccgagggggtcatcttcgcgccctacggcgagacgtggaggcagctccgcaagatctgcaccgccgagcttctcagcgccaggcgcgtccattccttccggtccgtccgcgaggaggaggctggccggatgctccgggcggtggcgtcggcggcggcgcagacgacggtgaacctcagcgagctgatgtcggcctacgccgccgactcgtcggcgcgcgccatgatcgggcggcggctcaaggacagggacacgttcttggcgatggtggagcgcgggatcaagctgttcggcgagcagagcttgccgaacctgtacccgtcatcgcgcctcgccgtgctcctcagcacaatgcctcgccggatgaaacggcaccgcgagagaatgacggcctacctggacgccatcatcgaggagcaccaagagagcagagcgtcccgggaagacgacgaggacttgctcgacgtgcttctcaggatccagagagaaggtgacctggaggtatccagagaaagcatcagatcaacgatcggagtaagtaccctgaatccataaataaagcgtttaagaaaatttcaagtgttgcaaacatatataaatttcaagtgttgcaaatagacacaaataatggaatttcgcgacttcatgtgttttttttaacagtgatgtcaattaattaaactagggtattgctctgcagtttgcacgaatctagataattcacgtagagttagatataatatatagctctgaaattttatttctatatatactagaaaaaatacccgtgcgttgtaacgggtgaagtctattttaatcttattattgttatatggtttagttaagataaaattcgttatgagagtttgcttggatatatatatatatatatatatatatatatatatatatatagaaaatcatgagctgcaggtaggagcaggggaggatccaacatgggtgcagggggacttgagtcccccaacacccaccagacccatggatacccccctgagttcctcctaaaattttttcgtcgtggttgataagataggaggtgctaaaggtctcttaataacattttagcatagtttaatactgagattatgtgtttatatcggtgtacacggtatgttgagtcccccaactttttgttcctggatccacccctggttaggagtccgatcgtctcaggttagcatgtgagtttttttaaacagatttcttatatgattccttctgtattatcaaaagtgaatgatcttaaaaatgactcaaatgcggatatgtattttcaaaagcaaacaaagttaaaaacagactcatacacggatggcgtaccatacaactcttacattctatttctataggcttaaatttcatatacaacccttaacttatatttctatagatgtaattatattttgtatacaactatatcagtcaaactataccattataattaatctgaaaccaacaaaatcgggtagttaagatcattttttttattaatgaggaagtttctagcatttacaacagacgtgatgcctcacttcaaaactgttttaataatataatagattgaaaaaattgttgccattgcattttccatgaatatatgcttacaagtaatgaaattttggctttgtatcgtgtaggacatgttcattgggggcagtgagccaccggccataacactgcaatggattatggctgaactcatcagaaacccagaagtgatgcaaaaggtacaagatgaggttcgacaattgcttgttggacagcacagagtcacagaggaaagcctaagcaaactgggttacatgaacttagtcatcaaggagacgctacggttgcaccctccaggaccacgactactattgcgagtgtgccgaaccacttgccaagtgttaggatttgacgttcctaaaggaacaatggtgctggtaaatatgtgggctataaacagggaccctaaatattggagccaagcagaagagtttattccagagagatttgagaatgctggtattaatttcaaaggaacaaactttgagtatatgccatttggagcagggcgacgcatgtgtcctgggatggcgtttggtctagcaacgttagagctcgcacttgcgagtctcttgtaccattttgactggaagctacccgacggggtagagattgacatgaaggagcaaagtggggtcacaacacggcgagtacacgaccttatgcttgttcctatcatccgagtgccattaccagtgtagacgcacgtagctgctatctacgagttattgaaggggaaaatatatagtgcaaacctaaaaactagcataggatccaaaaatagacgtctaagatttgtctacatcacacggagtaaaattttcactccaaattttaaccatgagtaaaagttttactcatggtgatgtatatggataaatcccaaacatccattttttctattgtacggtaattttcaggtttgcactgtatatagagtttgcgctacatatttggatattccccctagtgaagcaccccaacatctttgggcactactgttcatataataagagtttgaacccaaacaattaattatttttggaaccagttcaattggctgtgcaacttacatgtgtaggccccattatgtatttgaatatatagttctatttgctattcatccttatcatttgtttatatatagttttattatcgtctcttttccatacggttctaatggtttgggactcttttcgagtgcacttatatttttcatacggttgtaatgtttcgaaaaactatctaatacatacaacaaatcaatctacatatgcaattcataattatacttccttctaattaatgtggtagtttctatcgccttgtgtgtaatttgcggagcccaaatagctagctgatacatgcaggggatcatgtagttcggttgagctgctaaccacagatcttagatctgtctaaacgttccgttcgaacttgcgatgaatgaacattaagtacgagcatacaaaacgataaatgcattagctcatgattaattgagctttttatttaaaacctaaaaatagatttatctgatattttaaaaaaaaatttatatagaaagtttttgtatgaaatatattgttttatcagtttaaaaagagtgataaaaaatcaagataaaatttgtatcttaacgcgtaaaaaaaagacataagtccgctaaactttgtcgcgaagtttgaaggaactctgaactctggagtcccctaaactttggttagtgaatggaatggcagaaatggagggattgctagtggatggtagatggagcatcaagaaattacttgaagcgttcaggtttgcatattttaatggtagaatgtaattgatcatgcatacatccacagtcaaatggactgagaacccaaacaacggttttcattattattattattattattattattattattattattattattattattattatcattattattattattattattacaaatggaagtataactttcggtctatgcatcaaccaagaatacacacagccatatttcggtaggatttcaacttggtaaataaagtcaccacatcgatggtagatttgcaaatttcaatcagtcaagagcggatctagcgtgggacggtgggggctcgagactcctactggcaataaaaccatgagagctcccataaaaccctcactaatttttttttatcatagggtctgttcactttgccaccatcactttcagccctaccatttcttttgttactaaaatttggtaaggtaacaaactaaacaaactcttgccatcatcactttactaaaatttggcatttcctaaaacttcttctcatacaaacactagtttagtaagaacacatccatcatatatagtcaaaatttgagaacgccaaagtgtgccaaaaatttaacattgtctagcttattcaaatccctagctcactattttttcttggatctgtcactagtcacatctaaatctgcagcctgcaaaattctgcaataaaaacggtcacgtttttaagtgttctgctatgcagaacaattctccgagaatactgggtgaaagcgtatatgcaccaattacggatgcaagctggaagatactccaaaaacagatctgggcgtcttccatagtttcagaactgaaacatgaattcgatcagacatgtcatgcccagtctctgaattctgatgcctcaaatcactcactacatccccgagactaaaatctgccgcagtgctgccccgttggcccaatcctgtgcaggcccaaaaactttgggctgtaaatcttggtctccatggaccaacgagaccaccgtgcggtgcgcccatgcgaaaattaaggagccatatagaactactacgtcggcagcgataactgcacgtttgtggcagatccagcggcggccctcctccacgcggatctagcggcggctgcgctcccccgcaccgatccgacggcggccgccctcccccacaaggatccggccctccaccgtcctccctggcgcggatccggtgacagagggtgacattggtggtagggtggcgaggcgaagctcgttgactgctatagcgacgacagactacggcttgtgagcacgacgacagcattggtggcggcgacaaagagctagggattgggctagcggcgggctatggtttctgccggtggcaggctagggctcagggatgaatcgaggagctaggggtttcaaatttgatttttnnnnnnnnnnnnnnnnnnnnnnnnnnnnnnnnnnnnnnnnnnnnnnnnnnnnnnnnnnnnnn

SEQ ID NO: 18893 - DNA, 2066 bp, Oryza sativa
  unsure (1)..(2066): unsure at all n locations
nnnnnnnnnnnnnnnnnnnnnnnnnnnnnnnnnnnnnnnnnnnnnnnnnnnnnnnnnnnnnnnnnnggcggcgacaaagagctagggattgggctagcggcgggctatggtttctgccggtggcaggctagggctcagggatgaatcgaggagctaggggtttcaaatttgatttttggaatttttgttttttggctaaaattattttcgcatgaaaatcttatttttgcatgcggttgttttgctcatatataaattttgattttcgcagacaccaaggtgcatcgagccacccagctgactacggaaatcggtttttggccatatgcaaaaatcgtcttttactagtgaattccctattaatttaagcaacttataaataaaaatattaatcaatatatttaaaatatgattagaacttaatatttataatatcaataactatcacccatgaaacgtacatattgacgattttttatatttaggtatcaattttttttggaaattgcggacatgtctagatgtctagatagcttttgctcaaaggggagccatttttgctctctctgaggggcaaggattttctaggctaggtagactaatttgctaaggaaagttagtttttaaagtagtttaccaaatgcccaatctagcctgtaaggagaggaagttactagcctagaatccaaacgtgctcgcatcttgcgattgtattctaagaattagaggttgaaaatatgaagcccttagtttattttattccttttcacttatccttttgttaaacaagaggcaccagcgtgaataaggtccttttttttaggcttctaagctaacttgtgaactgaaaaatttaagcccaggtagctttttcatttggcgtttttaaaaccataagctattcttacacgattaagaaaaactagattgaaaaaactttttatccttatgtgagatgacaatatgatttcaccattaaacttatgatattagatccgccaattcataaatcatgaaagtcaaaagaccgacttaaaagcttaaaccaataaatctaaacctagaaaatgagagtgctaagtctataagcaacgacggccggccaggagtgccttatatatagtttaacagtcgatcgagtagccggctagcccgtcgataaatttgtgatcttttgacaaagtagtgagctttgacggaatttgtttaacattattgtgtatatatgtcgctcttttatgcatgccgtaagtttggaaccttggacttctactagatttcttccgatcgagctcacatcacgtttgtttgcagcttttgcgggctttgactaattaatatgtgcattttgggtcaactgatttggacaagtagtggcatatgcagcttagccaggaccgaacagatcgctatatacattatgttaacatacagttttaccatgctctagtggtatagataatctaatactaatttattacattaattaaattagagatccagctacagtagttagtctgatcttatctgaaaaaaataaatgccagctgctactactacaaatttcttattctacatatatacaatttgtaacatgcaatcttatagaagccacatgcacagatgacatattatcattaaaaaaaatctgcaaagcgatttttgtgctgatgagatgatatggcactatcaccaccgttacaacagattaaatatgatatagtaaatactcccttcgtttgtaaatatttaacatttaggataatatttttattaaattgtacagagtggccaccaatggtttgtcaagtgtttaattgaaaaagggaaaatggtatatatggcatagatttgttttcaagtactttatatattgtatctactagcaaatatgcgcgtgtgttgcatgggatctagtaagaggggttaaatgttccgttccactctattatactccctccgtcacatgatataagggattttgattttttgcttgcactgtttgaccattcgtcttatttaaaaaattttagaattattatttattttatttgtgacttacttta

SEQ ID NO: 18894 - DNA, 33959 bp, Oryza sativa
ttgtaaatatttaacatttaggataatatttttattaaattgtacagagtggccaccaatggtttgtcaagtgtttaattgaaaaagggaaaatggtatatatggcatagatttgttttcaagactttatatattgtatctactagcaaatatgcgcgtgtgttgcatgggatctagtaagaggggttaaatgttccgttccactctattatactccctccgtcacatgatataagggattttgattttttgcttgcactgtttgaccattcgtcttatttaaaaaattttagaattattatttattttatttgtgacttactttattatccaaagtattttaaccacaacttttcattttttatatttgcacaaatttttttaataagacgagtggtcatacaatacaagcaaaaagtcaaaatctcttatattatgggacggagggagtagtatgttttcagtttttcttagtgtgtttcaacttttttttctatggttgttttctctatttttgtgtacgttcaccggtttttcagaaactttttttttagtagacggattgacaaaactctgcttttgcccttcctgcattataggaattacttggagtgaaaagcttggacaccatacgctgatcccttgtggtggcggtacaacacaataattgagaaatccattcaacatataatggtcatgcttgtgcgatcaaagcgtgggctcctgttctactcccatcgtatcctcaactacactgtttcctcatcttcatcaaactgcttccactgttgggccttactaatgcctagcgacaccgaccactttgcctcccattacgagtatctccacactctacatcgctgccttaaatgtcgcgtaggcctacccgacaccaccaacatggcctctgtcggcgtatgggtcaccgtcagcggccacttcaagcttccaggcaccaggcgcttcctcaagaatatattattcaaattatcagatgtattatttcttaaattgggtgtttgttcgttcatgacttcatgtagatcgaatccatgtgtatattaaaaagagtgaacctactttaattaaatattaatttatattttctagttatcatgggtccacatgtcatatggattatgatgcttgttactattatacactttgttatattaatgactcggttatttcctaattcacgagttggcgatcctttgacgtcatttaaattgtaaacttaccgatggagcagaaccaaaataggatatgatttatggttgtgcgcctggcgtgggaaggcaaatgggatgtgctgagtgtggatcctattggattctgacacgtgggatgcttcatcatcgacgtggaagcggtgaattttggtttgggagcaatcagactcgcacgtgttgctagggcgccagtgcagaaacacgaaaatcgttaatgtacgccatacaaccacgaataatagaaacactactagagatggcagtggggtcccgttcaccgtttccctacggtgaattcatctattaggtgacggtgatggttaatatgtatccactatgggggatgaaatggttacaaacttattaccatcgaggatgacgggggcagggacggtgcacgattccctgtccccgcccccgcggtgacccgactttactatatagaggactaattctagactttttatacattttggcccataatactgaagcccatttaataggtatatatataaaacctaaccctaagtcaaccggtcaaactccataatccaaatcctcagatccagtctctcctccagtcctcctgctctcggttgcggcgctgcacctgcgtgcatcgccagttcgccactctgccagccaccaggcacaccgccgtgcactgccactccctagccaccaggagcaccactgctcgaaacgcgcacgccgccgcctcctcttgcgtggcacaggcacgggtgttgtcccgtccctccgtcgactcgctgccgagagcaccgccgagagcgccggtgtcgcgccgcgcagcgcctgcggctgtcgtcgcgccgccgggagccaccaacgccctccatcgccactcgccagcacgccgtccgctgccacgtcgtccgctgtaaccacggggataaattcaccacgtggtgatcgggactggagaaatgtagccccgttatggttgacggggcggggatggtgaaattttatcaccatggggacggggacgtggatgtgacccctgacggtgaattccccgttgccatctctaaacactacaaatattttaaatatgtaaagataaagataaagaaaaattgggatcatgatgaaagaaaatatgaccgatgtggtgagacatgttttcgtctttttttattatagatcactgtccttttttaattagaaatttaaattgtttgtttattttatagaaaccatcaagaaaaaaagagatcggaagggaaagaagcgaagcaagcgcagccgctcagggtggggtggtcttttggtggttagatcttttgtccttctgtgattaggaatttagatggtttatttccactactaaaaaaaacccatatagggaccggtcttataggtgccggttcatttaaaaccgacacctataggccttttccaacctagcttcgcactatgaataaaataaagaatcgacacctttaagcattataagtaccagttctcaagaaaaaccgataacaataatatgagtgccagttctagcacaaaaaccggtacaaatattataggtgccggtttttttaaaagaaccgacacctataatataaatataggtgccggttctacttagaaaaaaccgaccggtcgacgtccttatccactcgcatctcttgatcggtcgctctacctcatccactcgctcctctcactcctcactccatccactcgcatccccctcccctctcgccctctcccgcctcctcctccttctcctggcagcgatgcgctgacagcggcagcgatcgcaaggaggcagcggcagtggccccttctccagcggcggctacccccttctccttgcagcggtaccttctcccggtagcggtggcggctgcaaggagacagcggcggcggccgcaaggaggcagtggtggaggtccccttctcattgcagcggcggtggccccttcttctggtagatatcatgccaacgtcagcgagatgtcagcatgaaacctaggcacagatgccatgcttcttccatgttctcatgttgaaaattcatgccaattatttctatcacactcaatgacgattgcggcggcgaagcctgcaattaacactacatattgccttgtgcaggtgatatcatcaccaattcaccattagctatcttacttgcctcctataaataccctcagccggaagggttattcgtatgcatcaaaaacacacaacgctaactcatcacgagtttgatacacatagtaatcctacgtaatcaagcttagattgtgttaatcaactcaatactgcaaaaaatcgtttttgcaggcggtcaaattagggtaaattaagtgactgtaagctttgttaaacgccatggatttgatgaagagtaatccgcttcaggggagcccatggagcttgttgaacttgctggtattgatcattgtcgccgccatgatctgcggcgagctatgtcgtcgtcgtcgtcgtcgtcgtggcgacgagaatggtggcgccacgaggctgcctccggggccatggcggctgccgttcgtcggcagcctgcaccacctcgcggtgatgaggccgcgcggggtggtggtgcaccgcgcgctggccgagctggcgcggcggcacgacgcccccgtcatgtacctccgcctcggcgagctccccgtcgtggtggcgtcgtcgccggaggccgcgcgcgaggtcctcaagacgcacgacgcggcgttcgccacccgcgccatgagcgtcacggtgagggagtccatcggcgacaaggtcggcatcctcttctccccctacggcaagaagtggcgccagctccgcggcatctgcaccctcgagctgctcagcgtgaagcgggtgcgctcgttccgccccatccgggaggagcaggtcgcccgcctcgtcgacgccatcgccgccgccgcggcgtcgtccacggcggaggcggcggcggtgaacatcagcaggcagatcaccgggccgatgacggacctggcgctgcgcgcaatcatgggggagtgcttccggtggcgggaggagttcctggagacgctggcggaggcgctcaagaagacgaccgggctcggcgtcgccgacatgttcccgtcgtcgcggctcctccgcgccgtcgggagcacggtgcgcgacgtgaagctgctgaacgccaagctgttcgagctggtggagtgcgccatcgagcagcatcgggagcagattagagcggctcacgacaacggcggcgacgacgacgacgcgcatggccatggcgacaaggagtgcttcctgaatactctgatgagaattcagaaggaaggtgatgatcttgatgacactcaccatggcaaccgtcaaagctgtcattcttgtaagtatctacactacactagctactacctccatcaatttttataggacttgctttattttgaaaaaatcatcgatacttttattaatagacgtgaagctatattattttgtatgtagtgcctatatttcaggcgcctaaaatttcttaaaaaattgttactttttcatccctaagataaacaatccaatggttctcatcacttatctatcactacttccatcccataatatagtaaatagtaccatatgataagacatattccggtaccacgaatctgaataactcatgtctaaatttgtagtcctaaaatatctcatgcagtactagctaggttactatggtataggatggagggagtatttattacttataattctcccatggttggttaataaattattctaacaaaaactttacaatattacatcaaaccaacttataactcattaaaatttacaaaattgcatgcaaaaaaattcagaaaaagacgcaaataaagtaaaattaatcatgtgtaactccaaaattgtagttaagatgaacttaaattccatattgaataaggcttagtaatatgaaattttaggttaccgaaaatatacaaatttttaggcatctaaaatctagcaaatctctatttaatttctaagagtcgtttgcaatatgaatctattggtacactaaatatacttgcaatttgacaaaattattgacaacataaagtggcaagtatagatttgtgtcttgaaaagaatttcataatctccaaagatttattagatttcataaaattatccaatatataaaattatggtcaaagtcacactttaaataccgtggaaaaaactccaatgtcaagtatcttttatcagagggagtatatatttatgtatatatggcttcccgccttgtgctttccttcctatcctccatcaacagaatgtataaattttatgtagcactgtaaatatgcatgtttccttttaacatgcactaacatatgcatgacatgcattggccaggacatgtttgcaggtggaagtgaatcaacatcaacaacacttgaatgggccctgtcagagcttgtgaggaaccctcatgtgatgcaaaaggcacaagcagagatacgacatgctttgcaaggcaggactagggtaactgaagatgatttaattaatttaaagtacccaaagaacataatcaaggaaacactacggttacaccctgtagcacctctacttgtcccaaaagagtgtcaggagtcgtgtaaaatcctcggctatgatgttcctaagggaacaatcatgttcgtaaatgcatgggctatcggcagagaccctagatattggaacgatgcagaagtgtttatgccagagcgttttgagaaagttgcagttgatttcagaggcacaaactttgagttcaaaccatttggagcaggacggaggatgtgcccaggaataacatttgcaaatgcaacaatcgaaatggccctcactgctcttctataccacttcgattggcatctccctccaggtgtaacaccggatgggttggacatggaggaggaattcggcatgagcgtttcaaggaaaagggatctttatctacgaccgacactccatatgggacttgaaacaatatgatgaatacacgcgtgttgtcatggaaaatgttgataatagccgaatggtgtatgtacctagtagaaaaaaaatactttctgcaaattatagtacctatacttacaagatgtttgggaggtaggaactcctgagatattcagatattccagagctccgagtgcattagtatagaaattcatgcacgaacacaatatatataaggcgttgctgtcatgtacaagagctgtgttttttaaagataaaagtactgtacgtttccagttgtaatgtaacaaaagtttgcaagatatatgcaccttttgaaaaattgaaacatgagtactgcatctcaacgtacattgcaatataatttgtcttttatacctgaattaatttgtgcctcaagctagtaccgcgtgaagaaaatgccatgtggatcgatgagaacagctgatctcctacattaaggtcaactcttagacttaaaaaaaggtgatttgatagtgaatcaccgaactatactatatattgtgtgaagtaatactcaatccaagaagaacggaaatttgggtaataaagacaaactcgtgtgttaagtgcatgcatacgtaattaagcaccgatgaaatagccgcttaggagtcaaaatgattcttttattttgaagaaaatttgaaacgaaattctaagttgacttaaaaagctgactctgtttttttctgactgctgactctgttaattattttctatcaatcacccattgttttttatctaaaaccaatctctgttttgaagtaaatgcagatgcagaagtagcatagtacaggtttacaggctcatggagtatacaactcagaaaacacaattacaagggtctaagtaatgaaatcatcaaaagctagtgttcttatcttctaaaaaaaactagtgctcttttgaaagtcaaaataaggacaaatttcaacttagttcgtacatccgaagccaagaaatttgattgaatttcgacaaagaaatcaaccgtctcatctagctcgtctccgtgttaggaacaggaacactaacagtagcatgcagccacagatcgctcttcctcctcgccgtgatcccgagcccctccgccatgtccagctcgccggcggcggtgcctccggcgagctcccagtcgaagtggaagaggaggctcgcgagcccgagctccatgatggcgacggcgaatgccacgccggggcacatcctccggccggccccgaacggcacgaactcgaagtccgtccccttgaagtccaccgcgccgccgtcgaacctctccggcctgaactcctcggcgtcggggccccagaccgcggtgtcgcggcagatcgcccacgcgttgacgagcaccatggcacgctccggcacgtcgtagccgagcacgcggaggcgtggctcctggcactcccgcgggaggaggagtggcaccgcgacgtggaggcggagcgtctccttgatgacgaggtggaggtagtggaggtccgggagggcgtcctccgtgacgtgggagtgcccggcgaggacgccgcgcacctccgcctgcgccttgcggagcgccgccgggttccgcatcagctccgccatcgcccattgcagcgtcgtccccgtcgtctcgctccccgcgctgaagagatcctacatggtggacggcgacggcttgtcaatttcgtcgaacaccttggagggagaagaatttggtcgaacacttgtggggagagagggtgggagagcttacgatgattatggcacggatggtgcccatgtcgagagggatctggaggccgccatccttctggatccggaggagcacgtcgaggaggtcctcgtcttcctcgtcgcgccacccggtggcggccctcctctggcggtgctcctcgatgacgccgtccatgagacgggtcatctcgcggctgtgcgcctcggcccgccgcgccgtcccgctgagcgcgcgggcgaggcgcgacgacgggaacacgtcggcgagggtgaacccggcggccaccttgacgccctcctccagcctctccaagaacgcgtcgcggtcactgatccggtcacccaccaccgcccgcaccacggcgtcggtcacgtacctggcgacgagggagctgacgttcaccggctcgggcgtcgtcgtcgacagcgacgcgacgagggcggcggcctcggcctcgcgggcgcggcggaggcagcggacgcggcgggcgccgaggagctccgtgacgcagagcttgcggaggcagcgccagtgctccccctgcggcgcgaacgcgacgccgaggccgtcgcgggtgagcgcgcggagcgtcgctgtctgcggccgcgtggcgaaggcggcgtcgtgggtcctcatcacctccctcgccgcggcgggcgacgacgccacgacgacggggagctcgccgagccggagcagcatgagctcgccgtggcgggtggcaaggtcacgcagcgcgcggtgaggaagcgcgccggcgaggtggtgcaggctgccgatgaccggcagctgccatggccccggaggcgggttctcgccattgttgcgtggcctgagcttgacgaaggcgagagatagtatcagtagagtggccaagaagagatactgctccatgtttctctgtttcagctttgcagtggttgcaaactttgcaatgagaaagcaagctttataattttgcaatgagaaagcaagcttgagaagatgccaaaagaaaaattgaaatcagaatgacgcccaattcaaatgtttttgtatttctaaattcaaatttccagctgattaagggtatcgaccggtaaactcagaactttcagatattttgttcaggaattgagtttttttttcaaacggctaatcagattgacggcgttatattaatagagggaagtttagttatacatccaaacgctaaaagtaaggaaaaaactgtacatgtgtaactgtaacatgcttgcacgtcaatcctccttactcctcgtgacaacaattttcccatgtgttttgcactggccaaaccccagcatcatagctcatcatcttggaaacgaataattatttgatgatttgtagcttccttttctctaaacattctcgcattattcctttctttccccattttccagtcaatgagaaaaaggctgatttaaggcccttttttttccccttcgggtggcttgtctcatgtgtccttcaatccaataaatctctactgctgttccagcttgggatgctctatccaaaaatatgtgaggatgtcaaactagatttgctttgagattgggcattattcgttcaggaatagctagccatgtcacaagctagctggatacacgaccagccatattaaacgagcaggagaatggcgagtgattagtatattactccatatggagacaagtagtcaagccctgcagcaaaggccatgtttacttagggatgcaattattttgaaacctaagccagcttttgctggttttataataagagagggagaaactgtacaaagggatgcaatttcgcttgtgcataaaccttataacatgcagtagatgctttgaacagattattaattgtttacggacgatattgtatttaaacatgcagtacatgctcggaacagattgttaattgtttacggacgatatcgtatttaaagatgagcatgtgaattgcgattggactatagtatatcatgctatagaagattagtattcagatcaagaagcattgtggcagctaaaacaaagggcatacatatattattctgtcattttacacagcattaaacaattctccactacagttgtgccatgcttattccataacaaacaggactctgtgcatggcacgaggttgctagcagaattcagaagataaaaaatgtcctttgttcactcgatttcggttcacatagacgaggtctaagtacagttttcggaagatcaaaatgcgccataatctgattacaataggatctttctcagcttgcagcttcagtatcttgctatcttccaagctcagtatcttcagtgcggtgtagatgacaagttagcagttgtagcagcactatcacctagaagacgtctggattgcaatggccggagataatgccgtgttgcgtcgcttgggcaagatgtaatgacaggacataattcctatgctgcaagataagagatgaacaaccaagattcttgttagaacaagcattagaaataacataaaagaactgaaaattaatgaatgttgtgataaacgcacaaacctgtagcgcctttatctccttttcgtacgtgtcgataatctgcgaccgctcctgcgacattttcttttcataatcattgagccgattgtgctgtttaagaaatgcgcgcttcaggacaccgttctgttcgagaaggcctcctaacatcagcttcagtatcttgtgttcctggaagtatcagtcaagttgatcagtcaagcttccataactttcataactggaagatattgataattcaagacgacattattataactggatggagtagtatttggtacctcgcgcatcttccgcatttcaactggactgatacatgctgcagtggatttctcgaataggtcaagtaacctaaaggctcggttcttggcatcaaccaaatctagagcagaggacatctccttgacaactagctcagcccattcagacccattggatgggatgttcatcgctgacaaatcagattcaactgcaacaaccatcagtaaaagagagtttcagatttccgcaaaattaactaattggtctggaagggtaatcatgaatgaaaggaaaacaaatgttaccatacctttaggagagaccacctcgtttcctgtatcaccggaagccgcctctgtgatctcagtatcagtatgagattgcaaacgatgcttgaatcccctaattgcagcgtccaacacattaccggacgcttcaaaaaagctcttcaggagctacaaattcaaaaagagataaaaaaaatacagtatcagacaaactggcacagagatcaaattagatacaaacacaatgaacaatgatgaatcatattcaacatcaaacacaatgatcaatgctgaatcgtattcaataccaatatgatgtaacatctaaagtctcatcagtaaaatcaggattcttaagtcttaaccctctacttactaattaagtgcctgtgcaagtgcaaacatgaatcccacaaaaataatagatgcgtgctaatttctgcggctgatgattcattcataaatcacaatcctttcatctacatcgtgatcgaatagcgctcctatcctatggtgaagaagcttaaaaaaaacagagcaaccagaaaaaacagaacagaaggtaaacaaagatcgatggatgaatcctgcaatacctgcggatcttcatgggggaagatgagctgcagcacttcgatcgggtcgaactccaaactcaccccgaggtcagccgcggaggcggccgacgacgagcaccggccgcgcttcgccaggtggtgcgacgggagggggaacgggtcgtcgaggatgtctgcgactgagaacccgcgcttccggctgctggcggcagcgaccgtggccgccattggtgcgggcgatcggaggggagagggtgtaccggcggcgaactcctcggatcaaaggcggagagtgattcggatggaccggcgttgcggcctcgcggcccgcgtggcttgcttttataggcgagaaagccaggggaattcgagatcggagagccgagtccgattccgaagcggctcggtaggggcagatccaacttgggacatgggggttcagttgagccccaaacttttcggggggaaaaaacaaactgttacttgtattaaggttaaggctttatttagtacccaaattgttttttcctaaaaacgtcacattaaatctttagacaaatatatagagcattaaatatggataaaataaaaaactaactacacagtttgcatggaaatcacgaggcaaatcttttaagcctaattagtccatgattagccataagtactatagtaacccacataagctaatgacagattaattagacttaataagggtctgctcagattgtagtcaaaataaaccttaccagatggcaatattgtcaaaattttagcaggatttcttatgtattgattaaatttggcaacaaactagacatggatattttttgacaactttattaaaaaatggtatggttgaaaatagcatcaaagtgaacaggccttaaattcgtctcgcggttttcagatgagttataaaattagttttttcattcgtataaaaacatcttccgatattcggtcaaatatccaatgtgacaactaaaaattttattttcgcaaactaaacaaggcctaaggctctgaaattaaaagaagagcctcttccagctctcgaagagaagctagggttaacgaacgaacgcaaacaatatccagacaaaagtagtcacgatgggagagagagagatgaatctgctctgctctgctcgccagatggagatcgccgcccctgtcccttgttctgttcagccggcactcgtcttggcagcgcagggagcggagacaaagagacgggagattttctttcttttacgctgccaaggaagatattctactcggagaatatttaattatttgtcatccttactactggtaattaagaatttgtcattaaacctacgggcctgtttggcacagctccagctccggctccacccctcctgaagttggagctcagccaaacagtttcagctccaccaaaactgggagtggagctgggtggagctctctcacaaaatgaacagacccagacccaactcctggagttaaattgaggagttggagctgtaccaaacaggccctacgtgtcataaactgtgagtgataaatttttaattaccatatcttaaaagtggcaaaaagttaatacgagtactctcacatttatctcaatatttttactactttaaaattagctatttctttataatgactagttgcccacgtatcaaaaattaacaaactcgattagcgatcgtatcgacaacaaactcctcgtaccaccaacaactatcactccacgcatcgccaccaccgctctttctccatgagccaccatcgttgctcatctccgcctttgcatgtgcaatcgcaccctcaagttatcctccatgggtcacccttttttctcgtcccctctcgtcatgcacactatcattatggtcgccattaaggtcggtggtgtcggtcttacagagacacagggagtcaaggaggaggcaggagtcgacccgatgaagagcgaagacactagatttgggctccttcttgctgaatatagcggttccccaattgttggagggaaaaagaaaatggagagagagagagagttagtgtgcggagtggttcctgagtcactgtgatgtgaccatcaagtatatgtaaccaagcataagaaatataaaacattgtcaaagaatgtatcggatgaatagaggatctacaagatattcaagtccaatgagttgtggaatatagttcggtctccggagacaacactaactttaaacagacctagcatcttcatgccaactccgatttgggtgatcttcgacttgatggaaagcttatctcattacctttcaaatgcatccagtctcatatccaaattcattccgagtcaacgggaatcatcaaaacaaggcagtgttgttgctgaaaccgaacttgggctttcagccttgtaatagactaggcccatctcggaagtgtctccgtccacctccacgaattagaacataaccctagatctattttcctctataaatgtctatgcacaccctttagaaaaattgggttttgtttagttgaattttgccaagtgccattcaccttgtctctagtcctcgctcgattagtcggtgactataaatttagagcccccaatagttggtgtgttgatttgccgggtcgattagatctaccacttcaatcgcaactattcctttgtacttaattacctattcgcaatatttagattgcatcttatcttgttcttgtagtgttctctcgtttgcattgtagggatcatcaaccgtgtgccacggttggtacgacatcgtttatggtgtagcgattgcacagcgtcctagacttgttctggttggtagccacatcgcaaacgtcgcactcgatcaaagtgagagttatccccctcatcagaagatcgggccacgagagagagcgtcgtcacaccggacttggatatggatggaatagggtggtccaaattgaaatgtaaagttagctcttttgtaaatgaaaagaatggttaaagatgacatagtatgaaaacttttaagaatacatagtacgaactataatttactttttttctttagcacaattattaaagatgagttgtccattgcccgatactactgtgatatactaagtctttagcataattaaagatgagttgtccgggattacccgagagtcgacttgtgatatactaagtgtggttgggtcggtgtacttagctattactaataatctcatgatatgttgatgcatcaagatatggacttctactaacacgggttaattaattatggttagatagattaagctaaaaaagataaaattaatgccatcaattacgctcaacaataaagcattcgactctggtctccttttctcactacgtgatatacaatgattatatcagtaggcatttccataattctatcatattaaatttttttctacatatacattaatttggactaatatttttctcataattaaatagataataaatcattttttatatttctcctataaaatgtgaatagggcattgtataatgcgaaaattatattatatgcatgtaatttaatgtgtaagatatggactatttaactttttctaaaaattttgcacaatagtagataggtaatgaactgaacaaccataaaaaaatatatagagaatccattgtgtgttactgattttgtccttgttctacaatatgtcactaggtttgccaagttctagtatgccatcgcactatgcttaacttctataacataccatcgtcgtctagcttccgttagaattgtacaattttgacataatgaccgaaatacccctaggacgaaaaattacaaatatcagattgtaacaaagtttgagatgcgcaattctctgccttgtttataatgacatttcggattttttgccaaattttagaatttccgtcccatggatatttcggtcattatgacaaaattataccgaactaacggagtctaaatggacggcgacggtatattatagaggataagcaaagtacaatggcatattgtataacttgacaaactcagtggcatattatagaacagggacaaagtcaacggcacacaatggattctctctaaaaaacaatctagtcaaattgtttgtttatctcattcaaaacaaaacattttttttatcaaacacgttaggagaacttcaaaagaaggtaagaaaaagaggaggttagtcactagctcaaacacacgtggggaaaagttactcacatccatggtatggtatatgctcacattaatcgataatatactaatattattaaaattgttcttcgtcgtaatacggtgtgaaactaaaactttaaccttatattcttatgttgttccatcttcttcttgttttctcattcttattcttttataataatattgccacaaccaacactattatttgcacatgaatattagtagctaactcatgtgtgtgcgctccgtaatatatattattgttgacgcgaaaaacacgcactggcctgagagatctgcttaactctagtgcaggtccaaagcgattaccttcgggttctgagtgtgccagttggtttgatcctgcaaccaacaagaaataaaaagggacaaagttaaatccgtcaacgatagccgatcggctggattgacaatgacatatcgtttggagccaagtcgatgtaacttgcatcagatcggcaagggaagataaagcgtagagattattagatctactcgatcggttgaagatgtcaacgatacacagtctatctaatgaaatacatttaaaccaagtgattggaatagatcggacgatgtgccgagataatataaatcacttaatatctaaatgtgcctcaaagtaaagattgtgtatgctcgcagcatagccgatacagcaaacctagcatgtatcggctagtactccagtacgactctatactaagataacagggtaaatgaaatatataaaacgcagatcaatctagcaagtaagatggactggcagactgataaagagcaagatatgcttcaaataaacgagatcttaatataaagggcagatttagaagatcgagaaccataaaaggcacaagacaactaaaccagataagatcagctgaaaccccgatgctatctctattagaaatcataggaaaagctagataaaacgattcaagacatcacttaacagatcgaacctaaccgatgcagcattatgcgtgaaaagaaacataaaatctaaacaaatcgatgaagactcattcaagatggtagatacgctgtataatctagctcaataccgatatctaaatctatcggttcttttcgatgatagaggctggccgatgaagttagatgacgggatcgatctaggctatacagcatatatgataacttggcgatttacatagacaggattagagtgttatagagatgtaagcactaatcccgataatgcaaaccgccataacaagctttacctcttcgtcggagatcgaacttgatgcagcccaactcgaaagcaaagaactcgtcgaaacaatagaaaaaaggtggcgatgcgccgaagtattattgaactgtcgtcccatgattacaaggtgtcgggtcatatttatacccgaggtacataacatgtccttgctggacacgactcttatctctattacaatttaaaatatgaacaagtcccttaggcggactcttaccaaaaatatctctaaagaaaagcgtcatcggcttgtcttcatcggatttagcgtcagccgatacatacgacaggcgatgccgcctgtagccgattcatacggcagccgatgatgctcatagccgatacgcactctcccttccttaaacagaattcctccaaatctggctttgactctagctttgaacccagcccatggccttaccaaatttggtcgttaacaattatctatgtttttacatgtgtaaacaataattattatctttattaatattattatatttatataagggacctgactagttttttaataagtggaaagatatttttattaaacataatctagaatgctataaagatttataatattgaacaatatataattatataaaaaattttatggatgaattagagattgacacttgttataaatccaattattataatgttatatatatatttactagttacatgtcaatgcattacaatgcgatctagagataaaaataagatttagtttatttctagtctaatttttatgatatattgggttttttatatttctttagagaaaatattgtacaacaattacataatttattgttttataagtagattagtttatcataccccatttataaaatcctacgtccgccactgcggctcggaatccgaagaggcatcgcgaaatcgtgacgtgattgtgtttacatcaagtgtaaaactttggcatgtcacatcgaatatacggagacatatttaaaatattaaacgtagtctaataacaaaataaattacagaatccacctgtaaaccacgagatgaatttattaagcctaattaatccatcatgaatttattaagcctaactaatatgtcattagcaaatgtttactgtagcaccacattgtcagatcatagcgcaattaggcttacaagattcgtctcataatttacacgtaatatgtgtaattagttatttttttcgtttatatttaatactacatgtatatgtccaaacattcgatgtgttggtgtgtaaaatttataagtattatacacattaattataagtattatacacggacaaaaatcccaagcatccaatcttacataaacacttaacataatcagttttccattgttttacttcacaaggaaacataatcgaatccgttgaataacacaatgcaaacacaaggttgacgctacaaaaattataaaggtggaagcggaaacacataaacaagtaccaaatctataaaaaaaactaatctttcaccttaatttgcagcacctcacgatgtggcaaatccggttgtgatctaatcagccgcggaggcggccgacgacgagctccggccgcgcttcgccaggtggcgcaacggtaggggcacgggtcgtcaaggatgtccatgaacccacgcttccggctgctggcggcagcgaccgtggctgccattgataccggcgatcggaggggaaaggtctaccggtctagggtttcggcgagcctcgcggcgaactcctcggatcaaagcagcggaggcagagagtgatttggatggggttgccgcgttgaggcctcacggatggcttggttttataggcgaaaaagccttgggaactcgagaagaagcagaactcgagatcggagagcgtgcgagtccgattccgaagcgcaggccgctagaatccgaagaggcattgccaaatcaacgtggttgtgtttacgacatgggtgtaaagcttcggcgtatcacatcgaatatacggacatatatttaaaatattaaacatagtctaataacaaaacaaatgacataatccgcttataaaccacgagacaaatttattaagcctaatgaatccatcattagcatatgtttattaagcctaattaattcgtcattagtaaatatttactgtagcaccacattatcaaatcatggcgcaattaggcttaaaagattcgtctcgcaatttacatgtaatctgtgtaattagttttttttgtttatatttaatactccatacatgtgtccaaacattcgatgtgatggggtgtaaaattttgccagggaatctaaacaggcctgtagtaatttttctgtcacatccacttttcgtccgtccgatctaggctgtgtaaagttttggcgtgtcacatctgatgtatggacacacatttaaagtattaaatgtagactaataacaaaacaaattacagaatccgcatgtaaaccgcgagacgaatttattaagcctaattaatccgtcattagcaaatgtttactgtagcaccacattgtcagatcatggagcaattaggcgtaaaagattcgtctcgcaatttacatgcaatatgcctaattagttattttttcgtttatatttaatacttcatgcatgtatccaaatattcgatgtgacagggcgaaaatttttaccaggagatccaaacaggaccctggtgatagccttcgttatgtacgaattacaagacacaaaattaaagtatcaatctaaatccattcaaacaatcattaattataattattatacacggacaaaaatcccaagcatccaatcttacataaacacttaccataattagttttccattgttttgttttaaaaaaaaaaacataatcgaatccgttgaataacacaatgcaaacacaaggttgatgctacaaaaattataaaggtgcaagccaaaacacataaataaataccaaatccataaaaaaaactaatctttcaccttaatttgcaacacctcacgatgtggcaaatccggttgtgatcgaatcagcccaaagatcttcataatagccatggagagccaatcgggtaagcactaaaggttccaaaaaaaaaagtcacaaattttcaaaggacgagcatccaatctggctgccgaggcaaagaacaaatttccgttcgtccgtctgtttccatgtcccgagcaagttgtgtgaaccgtgtgcatagttcgttgtgtccaactcggttccatcaatgaaaaaaaattgatgagccaaaaaaaagactcagatcaaaatcaaagatcgatgagatcaataaaatcatcgccaatactaacagaatgttgagattgcggcgatgccgctgttgcttgtcggaggtcgaggccactgctcgtcggggtcgctgctgccgccgggcctaagtccgtggccatcgccgctccgctgctcgttgcacatcgacgtcgaaaacgccaccgctcccgctgctccaatgcctcgtcgacgtcgaagacgccgcacccgctgctcgccgacgacgacgccactcctgctgcttgccaatgacactgccgctcccactggtcgtccatgccgaggccatcacacctgctattcaccaaggacatcgtcgctctcgttttgaggacgatccgatgaggcctgcatgaaggagagatgagagaaggagaaacgatggaagagatgtggatagtaggagatggattcggatcctgtgacgtgcaagagcaacgtcagaggcgtgcagttcctcgcagggttttaaatctcccgctatagctgccgctatctcccgctatagttgtttgaaaagggttctaactattcgctctcatgtacaatttaacagctatagctccatttagcccgctatagctgtttaagaagctaaccgctaaatggcttagcccgctatttaaaacattggttcctgcacatccaccgtccaatctcatctagcggctcacaatcgttcccccaataatcttcttcctcctctgtccactgaagcgtgttacactgcctccgccatggctcttgacctctccatccaacatgccacagacagcagcggcatagagaagggggagaacggcgaggagcgtggttgttgtgtcgctcccatatgcgggtctcatacatggtttatgcagcccagtgcagaaagttctcccagcagaacgagtatgcgtgtcgttgagtttcattgtagtgatgttcaagtactacggtccatctgaaatcaacaacataggaagaaaaatatatgatgatcgactgagaatgaagggagaataatatgttttttaccttcaatttagcaaaaattcgccccccctaccctcccaaccgatttgtgcacagtaaactggtcgagatggaaagcagttggcagtttggggagtatttataggcccaacacacctcaaacgggttaggtacacaaagcccgtgaaaggtgttgttcatacctcaaacgggcttaaattgagttgcccgtcacaagtatcgacctacctgtgactggccagaaaacaaatccgtcacaggtggcggcccatcacctgtgacggcttataattacgcggcccgtcacaggtgaggtgataccagtgatgggttggagggaaaacccgtcactgcctcacctatgacagctttgtcttttggcccatcacagataaggtgatacctgtgacagaccgcagccagatgcctcaccgatgacgacatcccgtatgacccgtcaaaggtgacggtcaacacctaggaattgagtggaatcataatttggagttctttcagatgattgctctagcaagactcaagtttgctcaaaggggcttcctggaggttttctttttggcagcctggcacatttagaagaagaggaatggtttaatctttaagagcattcagccctccttccaagcctagagatctctttttgtgaaagaagttcttttgcatatgtgcagaatgaaggatcccttaaagcaaattgtttttaattggttacaagctttatagttttattcagtttcttcttctgtaactttgtaaatatttttcgagttttataaaattacactgctgggcaaagtcctggcagtaattccggtcaaaaaaaaagtgacggtcatcagtgaccaaatcgtttgctcgtcatagatatcccgtcagaggtgtgaggatctggcgtagtcaggggcggatccagcatgggggcggtggggtctcgagcccccactactggcgtgaagactatgagagcccccacaaagatcacactaaaaatttttaccatatgtagataggagagggactataactctatctagtttacttagaccccactgctatttctttctggatccgccactgaggcgtagtgagtgaaacacctgaagctgggacaagacaatattgctttcttcaaagcatatgcctctaaaaattttagaaaatcaagaataagatcgatcaagcataatggggtagaggtagctgaccataatggaaaattccaacttatgtactcctattacaatcaacttctgggccagccttcttgggaatttgatctacaacaactatatacagacgaagaaagtgattcgaaccttctagctggacaaggactgcagatcactcaagaagagatcctaacctcaattaaaggtatgaattcaactagtgcgccaggaccagatggatttggacctagtttctaccgtgctgcttggagctggatcaaagaggatgtaatgaggttggctaggatctttacaactttggggctaaccttgagaggattatagagccttcattgttctaacacgaaagccgggaaaagaaaacactgtcgattgctacagacctatctccctgcaaaatttctcactaaagtttatctccaaagttcttgcgactaggctccaaaaagctctaatgaagatgattcacttggaccaaactggtttcctccatggaagatgcatctcggaaaatctaatctatacgactgaattgattcaagcttgctataaaaggaagtgcccaactgtaattataaagcttgattttgcaaaggcatttgacttggtcaagtctcttccaaatacttgctgtcacaggattcccagaaatctggattcaatggattcagagtttactctgctcctcaaaatcttgtcttgatcaatggagtgcctgggagatggatctcatgtaaaaaggggctccggtaaggagatcctttgtcgccatacctgttttttggttgccgatgtgctacaaagaatgctcgagcataaccaggcaatcagacacgccgtctaccaggatcgcccttgcgccactatacggtacacggatgatacttaatcatctgtgtaccgagtggaagaggaggatgtacaagcacttgttggatattttgtaatcttgagcattttatatttctgttttgcatgaacgtagtggctggctgaaggttgttttggccggtcggtagaatagctgtttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacaattggtatcagagcggtaccacgacggtcctgagacgatgtctgatgatggcgggcgatacacaccgcccggacgccgtggtggcggtggcggcggcggaagcggcagcgggcgcggaggcgcaagtggcagcggcgcgggggatggcgcagacggcgcgaaccttcctctcgtgccacaggggagagatgctgggcacactgctcgcctcccggtgctgtcgaggaccaattatccggattgggcattgttgatgcgtgtaaacctacaggcgcaggggttgtggacggcgattgaacccggatacgcggagtaccgcgacgatcgggcggctctctcggcaatccttcaggcggtgccgcgcgagatgttgcgcgggctggcgaagcatgacacggcgaaggcggcgtgggacgccatcaagacaatgcgggtcggcgtcgaccgtgtgcgtgaggcgaaggagtagggcttccgtcgccaattcgaggcgatgcgcttcaaggatggagagacaccggaggagttcgcgatgcgactcactgccgtcgtcgcggacattcgcgacatgggtggagtcatggaagacgaacacatcaacaagaaactgctgcgcgttgtgcccaagaagtacaagccggtggcgatttccctcgagcagcttctcgacgtgaaaacgatggcccttgaggagctcgttgggcggctgtcgatggtcaactcatacagtgatgatgaggaggaaggtggcggcgacaagctctacctcacggaggaacagtggcaggcacgcgcaaggaaacaggagcaggaaggctccggcggcagcagcaagagcaggggcagctctggcacccagaacaaccgtcggggcaaggccggtgggtcaccgaaggggaaggagacgatcaacagtgggaacaccagccgtgactactccaaggtaaaatgtttcaattgtgatgagtttgggcattttgcaaggcagtgccgcaagccgcggcgccaacgtcgaggggaagtaaacctgacgcagggggaggaggagccgaccttgctcatggctcacgtcatgggggtgtctctcgccggtgaggagacactcgggcgaacacctggtgtgcatgaggtgcatctcactgagaaaaaggtgattctggatcatgaggttgcagaagaggaggaggccggcttgacgcgcgtgactacgatgctcacatataccatggtgtctgcacgctgcgtgatcctgatggtctactgcttgccaaggtaaagcgctccccaagcttcctgtacattctgaagttgaacatggcgaggcccatctgtttggcggcgaatggcaccgagacggcgtggcgttggcacgcccgtttcggccacctcaatttccaggccctccggagattggcgcaagcggagatggtccgtggactccccgtgattgaccacgtcgatcaactgtgtgatgggtgcctcgccggcaagcagcgacgagtgccgttcccagacaaagccaggttcagggcgcaggatgcgctcgagttggttcatggcgacctgtgcgggccgattgcgccggcaacgccaggcggcaggaaatatttcctgctccttgttgatgacatgagccgtttcatgtggatacggctcctctccggcaagcacgaggcagcggctgcgatcaagcagttcaaggccggcgtcgagatggaaagcggccgaaaactgcgggcgctgcgcaccgaccggggaggagaatttacctctgtcgagttcactgagttctgtgccgatcggggtgtgagtcgccagctcacggctccatactcgccgcaacaaaatggggtcgtcaagaggcgaaacctgactatcgtcgctgctgctcgctctatgctcaaggcggcggggatgccggcacatttctggggagaggcagtcgtggcggctgtgtatctattgaatcggtcgcccacaaagagcctggatggtgtgacgccatatgaagcgtggcacgggcgacgtccctcggtcgaacacctgaaggtgtttggctgtgtcggctacgtcaagacagtgaagccaaatttgaggaaacttgatgatcgtggcacacgaatggtgttcattggttatgagcagggctcaaaagcctatcggatgtatgatccggtgtcacggcgagtttatgtgtcacgcgacgtcgtctttgatgaggcggcaatgtggccatggcgtgatccggaggtcactcaaactggaggcgaggaggatttcactgtggagtttttttccactccgctaggtggaaatcgtgttcctgacgtggttgtggaacatggaggcgcacgggaaactgaaaccgcaccaagtccgctggccacgcccgacgcggcgcccgtgtggtctccagtgacatcaagctcacctgccggtgttgagttctgtacaccaccatctgatgccagtattgaaagcgatggagctcctccccgttttcggacggtgaacaatgtgctggccaccacaactccggtgctcgatttcgactacgacgacgagtgtctcatagcggagcaggagcctttcagtttcaaggaagctgagaaggagcagtgctggatgaaggcgatggaagaggagatgagctccattgaaggtaacaatacttggttcctctgtgacttaccatctgaccatagggcaattggtctcaaatgggtttacaagatcaagagaagtgccgaaggtgagatattgaagtacaaagcaagattggtggcaaaggggtatgttcagcaacaaggcatagattatgaagaagtatttgctccagtagcaaggatggaaactgtgaggttgctggttgctttggcagcacatgagggttggcaaatacatcacatggatgtgaagtcagctttcctcaatggtgaattggaggaagaggtgtatgtagtccaaccacctggttttgttgttgagcacaaggagaacaaagtactgaagttaaaaaaggccctatatggtttaaagcaggcgccaagagcttggtatgcaaagctggattctacacttgcaaatctggattttgtaagaagtgcaacagagaatgcagtgtacactagaggggaaggtaatgccagactcatggtgggggtatatgttgatgatcttatcattacaggagctttggggacagaaatagcaaaattcaaggagcagatgagaagtatgtttagtatgagtgatcttggattactgtcctattacctgggaatggaggttaaacagactgaagaaggcattacaatgtcccaagctgggtatgcaggaagaattttagagaaggctgggatgcaaggttgcaatccttgtcaggttcctatggatgctagactgaagctgaaaaaaggagtagaagattgcattgatgcaacacagtttagaagcattataggaagcctgaggtatttggttaatacaaggcctgatctatcctactctgttggatatgttagtagatacatggagaatccaggtgctgaacattgggctgccatgaaacatattttgcgctatgtggcaggaagtctgaatattggtctcaagttcagaaagggagaagagaaatttcctcggctagttggctatagtgatagtgatatggctggggatgtggatgatagaaagagtacaacaggggtgttgtttaagctgggagaaaacttaatcacatggcagtctcagaagcaaaaaatagttgcattatcatcttgtgaagctgagtatattgctgctacaactgctgcctgtcaggggatttggttagcacgtttgctgggagaactgcaaatgaagaagccctgttgtgccatgttaaaagttgacaacaaatctgcaatcaatctctgcaagaatcctgtacttcatgatagaagcaaacacattgatacaagatatcatttcatccgtgagagggttgaaagaaaggaggtcgaagtggagtacacaagttcagcagaacaacttgcagacatactgacaaagcctcttggcaaggtccgatttctggagctgaggggaaagctgggtttgtctccagtgtgatgcgtcaagattagggggagaaattgttggatattttgtaatcttgagcattttatatttctgttttgcatgaacgtagtggctggctgaaggttgttttggccggtcggtagaatagctatttccttctgcatgttgtcagttttgtttagctgccgaatgacctggtttcagatcgtgggatggcgcggtcagtagccgatccgggttgctcgttccgttcagttgtgcatgtaacaaactccgttttggtggaggagaatatagagtgaaaacagaaaagcagcagaggttgcgctgcacaaaaattctactttgttcttcagttcttgacgtttcccgaacttcttgaggttactatcgttgtccggcaattttcagagtgagcgagtgtgagcgatttcagagtttgctctttccgttttgctgacagcacttaggccttgtttagttcccaaaaattttctaaaaacatcacatcgaatctttgaaaacatgcatggagcattaaatatagataaaataactaattgcacggctatgatggaaatcgtgagacgaatcttttgagtctaattattccatgattagtcataagtgctacagtaacccacgtgtgctaatgacggattaattaggctcaaaagattcgtcccacggtttccaggcgagttatgaaattagtttttttattcgtgcccgaaaacctcttccgacatccggtcaaacatccgatgtgacacccagaaattttcttttcgcaaactaaacaaggccttaaggatacccttctaaagttctctaatgccactgggttaaaagcacagtgattaccctgaatgtcgatcagaacaaggagttgatcttgtcaggactgctacagtgcaaactggaaaaactgtcgatagcctatctcgggcttcctctttatgtccataagctatcttcagctgacctgcaacctctggtttccaagttagatggtttcttatctggatgggaagcctctcttttgtcgcaggcagaacatctagtactgataaacgcgattcttagcagtctcccagtctacgcgatgtctgcattcagattacccccagaaaccatagaggaaattgacaaacgaagatgggcttttctctagactggagacgatgtctgctcgggagcacaatgcctggttgcctaggattcagtatgcaagccaaaggcacagggagggctcgaaatcaaaaacctaaaaattcagaatgaagcgctccttcttaaacgcctattcagtatgtacaactagggatgaaaacggagcggatacggacggataatgctcatactatattcgttttcatatttttttgccggatacggaaacgaatacggactatctcgaatacgaataagaaccgaatatgatcggacacgaatacggaaacaaatttttctcggaacacgaaaaccaattcaacttctaatagaaacaaatatcaacatatataattagctcattttatataaaatgtagtataatttataaatacgatccgaaaggtatccgtatccgatccgaaaggtatccatattcatttttatccggagcggacggaaactatccgctccgttttcatccctatgtacaactcaaagatctcatggacaaaatggatctggaaagaacactcagggcctgtttggggagctttagattctgagaagcagctgtttggtagccaacttctaagaatctggaaaagctctgaaacccagctctccagcttctggcttcttagttcatttttcagaatatgtaactacagattctcagaagctgtggactgtttggggcagcttttgggaaaagctgcagctgggacaagctcccccaaatagggcctgagatactccgcttctaacatcttttcgacttgggcctcactggacctcaatgtagaaactgctgcctgatctacaagccctaactgaagtcgacgttggagatgggttgcgaacttccttcttgcatgatcgatggataaccaacgagactttagcgatttaattcgggcccctttacacccatgcaactagtcgtcaagtttcggtcaaagatgcctttcaacgaggaataacagaagattttgttccaagactatctgaaaacagctagagcggaaatgcagtgtctgcaagttttgctacagatcgaacttctccctgcgagatgagccggacattcgacgaagtggaaaattgggcaagctaacgacgaagaaaatatactatgatgcaaggttatcccctggcatatcgtcaccaaactggggtttaatctagcagtgcagagcgccgttgaaagtaaagatgttcgcttggggatcgcctttccacaaaaggaaacctgctgaagaaaaagatagtgcaaacgtcgattttgcacagggggaagattagagtacaaccgcaaattcaagatgtgcagctcctccaccaactgaaaccagctcacacagtgccagcgcttcactatcaagtaatccctatattctaaattaatctacatatatttcataggtacatcaagaccaagaaaaactaataactctctcatactatatttactctagcaacaaactcaatgcatgcaccatccccactattttctagccaatagcaaatcaagatattgcatatgggttataaatatttgtgtgcatagatgcatacatcaatgtccatttactccaatgcacaaataacgaatagacttaatgaatgaacataaatatgtagatcatttagaaataacctcaaaaaaaactatatgtagatcaatttggaatggagggagtattttatctgctctgtatgtgggcgatctggaatcatcgtcatgatgtcattttcaagaaataaaccccctcgattggatcctgcctgcaacgttgcatccgcgaggcagctctctgggcagagaatcttaagattgaagaccgacatgtagtctccgtttggaaagaaattttctcctccccactacaaactctaaatatgttgtaatgaacttttcatcctctatgcaatgacaaaattcaggtggggaagctctcccccctggtgatttagtctaaacaagtttgatggtaaattcaacggtgtaataacacgacaattttgatctcctatcgcagaggcagtaggcaatttcccaccaacaacacaacacatgacatcttcagagattattattcatttcccaccaacaacacatgacatcttcagagattattattctggacagaccgtcttgcggcaaaagttagaagacgtcaggattgaagtgcccggggatggagttgttctgctgagcctgcttcagatgcatcgtcagcgcatagttgtttatctgcagcattttttaccccagtagattcttcatcagtatgtatgttaggcagaaaaagaaagaaacttgcaaaaggagataggattgtggttgccacctctagggtcctcagttgctcctggtactgcacaacaagttgcttcaaactctgaacctcctggctcctctcgtcgaactccttttggcgctcatgttgaatggcgaccgctcgcttgaggacagcgttctctcgcagcacgacggtcaattgctccttaagcatcatattttcctgtacagaaagaaaaatatgaaagtattcaatgttattgttactcctaaatcatgcattgatgcatgttttctacatgccgaattgctgaccaaacactacgatgttttttacaccctagagaagatagacacacgtgtaccttttgcaagttttgtgctgcatcagctcctgtacgctccacgattgacttctccaaaacttctaaagctcttgaggcgcgagcacgcgcatcgcccatgtcagatgcatttgtcatctctctgacaaatagctcaacccattcagaaccattattacctgtctggcaactatctgcagcagctgggtgttcattagctgtactcacaccaccattattaacaatacctgccaagatatgcaaaatagttgctgttgtcatatatacagtatgctacatttgcacaagggagtgagatgcaaccgattcatgtgttgtgagaggaaacgatagtttagaattggcttgggttttcctttctctttccttgtaatcgttctgtaaatattttattcttttaataatatagtttaacattgctggacaaagcctggcagtattttggtagaaaaaatacaaagaacttgggtagtatatagccagaaaatgcaacgcgagaacttgacagcttggggacacactgagaaggaatacacaactattctaaatatggtgaatacaaaagaatggaagatagaagatatgtggatgcagtcatcagaatttatgtctagttaatcatgcacactccatataacataattgactgaatcgtgtgcagtgtctttaattgaacagcgcattacgttgcagaatataaacataagacagacatcaaagaaactgttgcagaatataaacataagaacagacatcaaagaaaccagcaaggctagagatctctgaataatattgatagacaatttgaaagagtatatcatgacccacatggatcattatgatagattggtactgcggtgtctaaaatttaagtgtgacaaaagcaagaagtactagtgcatgagaattatatgcacagatcctagaaataaaaagcttttggttaaaagctgaaccttcaacagacggataaactgctgtggggagcccattttcagatttgcaaccagtagctgataagatagcctctgtagactccaagcgcagattgtttaaactctttattgctgaatccaaatcatctccagaagcatcaagagctccttcgagcaactaaaatgaattttcagaaaccatgatcagttagttatatggcatagagataatactgtgcacaaatacctggcattactacaaaggataaacattacgcagaactaacaaaggatacacgcatgaatttgcccatgcaacaatcatttgatatagtgtagaagaatataaacacagctgttcagtgctcatcaaccttgcctagtctctgcaggcaggaaaccacaactttctcgaatgagagagtgtagctttgcaaaactccaagaaacattacatgtagagatgtaatctctaaggtgtactcatagtcatcggcatagtggtgcccatcatccagtactggaaatgataagcatgtataaattgtgccatcaattgatttgatgatacctataggtggaactggtatgttttccttatctaaaaggatctgaacactaaatccataggtaaagggtggtaaacaaacacatacaggaaagcagtagattcaatgctatcaaagaaaacaccaatgcaaaaagcatctcccaaagcctccaagttcgctcctttttcctccccagaccgcagggcagcacaagcgtcacaagatcatccaaccaaaacgccacaagagccctaattctgattggcatgcccttcgtccttacacctccacaaaggaagtgaaaatgcccactttctgatgaaaaggatccagcttgcagcaatccatacaccagaacaacaagttcgacccccacaaaacaacccgtgaagaccaaatgggatcacaaatctaagccataaagaacacgcattttttttcctcatcttagcccgcccaaattagtcaccggtgatcacacgcagaccaggaaaatttacccatgaatcatcgtcgccacaccttaacatgcacgcacccacct

SEQ ID NO: 18895 - DNA, 19806 bp, Oryza sativa
ccgcccatccccttccttcccccgccgccgatccgccgccgccgccgcgtcccctcctctcgttgggattgggttgggttggtgggtgggtttgggctcgaggcgaagccggatcccggaggcggaggcggagacggagctcgcgatcgtttaacgacggtaacttggaccgatcgcgctgtcccccattgattacgtcggcttttttcctttttttttttctttcttttctttctttctctctactgatactactgtgatgaggcgtgaacgcgctacgcgcccggtgccgacaggtgggcccagatggagtgctaccttttttgtttttttttttgcgtgggccgggtgggcgctttttcttgccgtcgtggactcgtgccgcggaggggcgattcccatcttccacgcgctccggttcgatgtgggtgccgtgtcaatggtgaaaagaccatgtgacttgaactaaattacattcacaactcgtaataaagttctaaaagtaaaaaaaaaaaaactcgcatctccagcaatgtgaccctataataattacattcacaactcgtgtagttctttaagaaaaaaagtttccccggcaatataactcctatataggctttttatttttacatgggtttgataccgcggtgaaagggatgaggtgtctcggtatcagcatgtcctacagagaaaacgttgtctcgggaagagactaggaggtccaagagacaagcacaataggatagtcttaaaagagaagatgagaataggtaagtggaacctgaagatatgacatcacgagaaaaacggtggtatggtcagcgaagattgctcggtatgacgacgatgtggccgaacgatgtcaaccgcccccaccaccggccagtcaaggctgcatgttgcagtggacaataaaatttgacaccaataaacagatcggatttggacactgagaggtagatctgcaaagagcgattctaacgaatcacacgtcgcgtgatgactacgaagcaatttcgagatggttctatgttaacaggatagcttgagtggcatcgtagggtagggagatggaggtgacctggagatagggaaagatcgggttagggtggcgcaccctcaggggagaggaagaggaaatgttgaaaaaggggaaaatgaggaaagtggctaggaaggttataaatgtaattgagtcgctagcaagtaggacaaaagtctttaaccgtaaatacatagttctagaggtgttttctctatacgtttaattaaagtatatttagtaggtttattgccgaaacctagaatagagataagaccgagcgaatacaacacctatctaaacaatgctaatgtttggataagcagcaacgcttaatagcgaaaaaataatgtgtaaattttatatacatatactttgagcaacttaaaaattcaatttctaacgacgtactggtaaacttaagtgcaaacaatggagatcaaatcgttctgaatgatcttgtagttataggccttagagcatctccaagagcctagccaaatggctctctaagttaaaatttggctaacttacacaaaaaaaatctactccaacagactagccaaatgcctctccaagccatccggctgtctaaattccccaccagactagctaaagttggccagccaaaaccggctagccatatgtgggacccacgcctgtttccccctctctctctctccatgcagcagtgcggcatgcacatgtgacgagggcgtcgtcacctcgtcgtcgccgcggccggccaccgtcgccccgtcgtcgcgcggccggcccccgcctccccgtcgtcgccgcgggcagccccgccgccccgtcgtcgccacggctggccaccgccgccccgtcgtcgcgcggccagcaccgccaccgccaccgccgagctccgccctgagctccgctgctgcccccctctagatccgccgtcgaggtcgtcgcgagccgccgccgccgagctccaccccgagcgacatcgaggtcgtcgtcgcgagccgccggcgtcttgcctactgcctccccgcatcgccacaccatcgcgcgcggccgcccgcctcctcgcgtcgccgcaccaccgccggcgaagagagcggcaccggcgggcggagcccgagcagcggcggcggatggcgacgcagcccgagcggcggtggggatggggatggggcggcggcggcggatgggagagggaagtggggtttggagagaaggggagaaaaatgagggagaaggaggtgtcgaagctgacatgtgggcccaattatcatagactcagaatagagaggatgaatagagaggctgttggagtaaaatacagtttgatttgctaaattaaatggagagttggctaaatagacatttagagagtcaaatttagagagaccgttggagatgctcttattcggaactcggaagacctactacagcgcaaacaaccagcggctgcagctagccaatagtagctacaacctatagatgttgaagctagcaagtgtagggagcaatagtttgtgtgcagccgaacgaattggttgtccaatgcagcaagacggctgtaaaatttgggctaccgaacaaacccatactacggagtacatccgtatttttcttttactagaaaaaaaaataccggtgcgttgcaacaaatcatgagatgcagtcaggagtccaacttttatctcaagttagtatgtgagtttttttaaaagatttttttatacgacttagttttatatttcctaaaacaaacgaacttaaaatccgagtcaaatacttatctatatttctaaaagcgaacgatcacatggatgacgtaccaaagtaccggcaaaaacatttttaatttttataatagtagagattctattatctaaaaaagaacatctggataaaaaatttcaggatacgccttttaatcttgtcaagaacatttaataaagtaaaatagaaagcgacttgaaaactctaacgaaagactgaaagtgacatggaaaatattacacaggtggcggctaccatctgtataaaggtacgcacgtaatgatctaaacatcaggcagggtcaggtgtccatgcctgagtaaattacgctcttattaccagctgtatgcaacatgagaactttgagaagttttcagtctggaagaggtgcaactgcatgagtaagaagtactgatttaacagttgagcactctatgggtgaagaagattaatccagagtttaactatagtgtacaatgctttcctgctgggaactcaccatctgaaacatctgtacaaagatacaaccatgcagctatccatcagctcggcaattacaaattgaagtatggtgcaaaaaagggggacccatgttctctaccactccagttgcaagcctccccaaaaccatatgagccctaccgttctcccgctaggaggccaggctcagaagcctcctaaatatattatccttgatcaatctttgtaaataagagatacaacaccaccacatgcttgatctgcatgtaaggaagattttgatttttttttctccactcctgttactcccacattataacaatactcatcatataactttgagaaggccgcataactagaagagctaattcacaagaatatatactggtttttctatctgtccaataaccaattaagcaccgtcttttttggcacggttccatcactaccttctttctccgtcttcacagcagtatttacagcattacggatgagagaattcaagcgcaacctcagttgtgcattgtcaataagcagatcagataacatttttgttgtctcttcatcagtaacatatgcatcttcactgctcatggtaactgaggatttaccatcagaattatcaccatcatcagaagagccctgttcatcatctcgtgacagaagttgagcctgagagattgagagaggatcattatagaacacagattgtgaatgtaaatgtaactaacagatccgctttcatgggcacaaggaagtgagaacttcatgaaaacagaagcgtaactttgaatattcaaaatcaatttctaaatggacaggtacataacactgaaaacaatgtcttctgtaccaagatgaccattacattggtcattggcaagacttcttttttaggtatagtggcgccagtatgtaatctaaagtaaatgcatctatgactgtaaaataggaaaaaaagtttgtgaaaatatagatcattttactcattttgttaaatatagttttactgactctgaaatgatatcactcttcagctgggaagatgaaaactgttccccagagctaaccaaaactaacacctaaaccttgttccaatagaatcaagaatgcagctttgaaggcccaactaggtggctcaaacttcaaacataagcagaggctgaggaaactacaaatcaatttaggccaggagttgttccaaatctgactccagatcctttgaagaatctagtgtcaggtagtgtctgatgtttccgtcggagtttgagctcaactttctaagtgtgcctttcccgtgagaagctagaaggagtttgaatgacaataactaatcaaaagatatttaaaacattacctcagcaacaagcaaacgtattctattgtctgatgtcgtcacaagatctaaagcatcaggcaaagatgataaatcaatagtcatagtgtcttgctcatctgcaacaaacttggcagtacattcctgtagacgctcacggagcagtctgcattcgtgaagaattttttcacgggagaaccttgcacgtgttgaccgctgtttctccctgttaacaatcctctgtaatatataataaatacaattagtagctagagagaatgccgattgcaagaagtataactaccagaagcttgaatttaagaaaacaaaaaatggtaatagggatagattggatcaaagttgttgataaatcagctgttatgagcgttgatgcttgaagcacggacagtaatgcatattgtagaacagaatatgggaagggtttacataccttccaagaatatctattgcctaaataattattagtttcaaagcatgggattggttattttgtaccctatctatcagttaggacttaggaaggatctgatttagctggaaaattaaagatgttttttaaggtacttttacactgtcaaaatcagagtcataagaaagtaatttcaaacatgaatccaataatatccttttcttatggtaaaacctaaatattattggattaatagttcgtcaaagctcttcaaaattggacagtcaaaatacaccttatattcctgaacggaagagtaatgaccttcttgagggtcaaactactatttacatgaaaaatacccacgggtgtgtatagcagcagtcttgagttatccctataaaaggtaaggtttctgcccaaaccctagctaatcaaagcctctagccgtgccaggacaagcccacacgacctgagaagatcgcactatccttggtcttatgatcaaccatatcattagtgtgcaaagcaaaacaacaaaagaacacctcaccccttcattctctctctcaatttctttagttaagtggtgtacaaacaggtagcattaaattaattcaattgtcctccaagagtgattatatatagataaagaaatcgctgttgaatctagcttgtgtagatagaaatctttattcagccggccttgacaaaaggaatcacataaagaatagatggctgtgctggttatataataaaaaagggaaaaggtccatatgtttgttgatcaaaagaagactgttaagctcatcttgtcagataccaagtaggcaagtacaacaattcatgataatattccaaaaatggacaacatgttgcatgggtggtggagatgcagaaatcagggtaataagttagaagtggaaaagcaaacactcaagatggcttgcatgctttcaaaggcttactcttgtctaatgacttttttttttgtggggacttgtctaatgactttgacaagccactttctcttagctacaaccaaaatctagtttgcaacttgtaaagggttatgctctcctggctttgagcaatgagaggccagacctagcatgcctgcaggtcgaatttatagatactatcatagttctgcgagaaagaaaagctttaaatttacatttatacctctaattcagtcttctcctcatgatactgattcagcactttcttcatctctttttgggagttccgaagagatttcacctctttaacaagaacttttatatctgctttagactttgcctcgaattctccaatatgttgctgcaaactctcaacttcttttcgtttagtttctagctcttccagtaacatttctttttcaccgctagcagttgttttctctgactgcacacgagttttctcattctgcaattaagtagaaagaaatgtaagaaaatacttgtaagatggatagtaagaaaccaagccatgatgacaaagaggagacaaagaggaaaaccaacttgttcaatcttcaggtttgactccatttcagagtacttcctgtagagctcatccttatcccattgaagttgggtaattttctctctttcggtcaaaacagcctgatgtagaatctctttgtcttttttcttcgtagcttccaactcaacctccaaatctttgacctgcacagaatagcagagaagcacaagaacaacgtacatcaataaagtatgaacaaaaaaacacaaatcaatttattttaaactcgtgacatataaaacaaagcatatcatgtgtttaagcataatccataggcatcacaaatgaatgtcaggtagaaaacgtaacctttgtcgcaagatattctttgacagccacttcctgatttagtcgtgctatgagatcctccatatcagtttttgctgtcacctgtcttctgtccatgctgatcaaaagtctagtcaacttcggcctttgatcagcaggaaggatgatttgtgcatccatatcatataaaagctgcatatctaaacctgtaaattgttctgtttggctatgtccatcaattccacttggaagatccacaggaccatcccaaagggaactactaactccaggaaccgataattcactgcccctcaaagaactcaaatcacttcctatactttcagcagagtccttcctggcatggccagggttagaatcgtgatcctcttcggaaaccactcccttataagtatctatggaaccattcctaacaccatgttccaaaaagacatggttctttttcctgtgatttgacatgctactagcccgctcattgggctgatctaagatagactctcccagcataccattaccagttgctcctgtcggaccgttaccatgagcaaaggctgaattcatttgactggactcagagagaacacctgaaccatgttcatcaggacgcggagaagaatctgcactactttttgctgaagaacccacttcagaagggcgctgattccaatcttggtaatctttcattcagaaaaatagcgtaattaaacatttgctaaaaatgttaagaaattttagttaataaatggatcaatgcacaatcaggaaaaagtgtcttcaatagaatatgtcaagcggaacatacatgagcgtgcagcagcttccagctcaagaaaagcagcaacaggtgcacttctcgacaactcaatgtcagaaagtagcttttgcatccactcctccaaagcgttccttctctgcaaacaaaacatttcaagaaccaccggtcaaaaaggctaagcacaactgaatgtagtatttgacatcgaacaaagcaaaaattaatcaatatacataacggctaacctcttctagaagcaccctgcttgaatttattcttgaaaaggcatgcttcggtggagcaggggggattccttttctgggaaattcctgcttaagctgcagtacgggagaatcttagaatgaagaaatgatattggattagaggtcgaatggaaagtaataatctttttttctcagaatcatatccaagatgagacttccaaaatgtccacattcattatagaaaccataaaattgcaaaaggtgaagtcctcattatgaagtcaccagcggaagatgcaaaaatctgtaaaaactaatttggcccaggtaagcataccgtatacactaagtcaagatttataataacagtatgttttaaagtatctgaagtctgactacctgtgtgatgcaatgcaccaaaaatcctaagttgcaacggaagtcactggagaagcaagcaattgtgcattcaatgcactagcaaatgtaagtccaattcaaaggtttgattacattttcaaatttaatgccagataaattaatctggcagaccactcaggatacgataggggattattcttatttaaaaatcactggaggttgttcttgaaaggtatgttccaactgaaaatgttagtgggcttctagctcaggaaagaaggtcggtacaatttaaagacacttggcatgtgaaagaagaaaatagcaaagaggtgtctcaacttacatcagaagataactttagaaagtcactaaaccttcgaagaactccgtggctagagctgatgccttctggagattgtataccaacatgtatcctgtaaaactgtcctttatgggcattaaaatgagatcataaacagaacagtatcaaagttcacaacaaacaggaattgcatgatatatgcaacagaattacataagtgtctcttgcccgtcgatcacgactaaactagtgagccaaaagagaggtaagatgcaccacagttaccaaaacaccaaaaagtatatttctgccagtaggtcaccctgaatcattagcacaatacttcctatggcatgtcatgttggcatacaccattgtggcatgggctgcacgtgagttaatgacttcagccatggctattgtgatttgcacttgtcccccatgagttttggccttacatagttctctctcacccccaactcaaaccccctgtgtactgagacaagtgaggcagttgtgcggagagggagaatcacctctagtgtactgcacgtcagcgattggttatcacaacaaaatttgcaccccatacaggggtatgcctcaacacgccatgttgtcattaagagtcaggacagtgtgctaacaaccaaaagtgaccctttagtgatctaaagaaaagtacagttttgtgagtccagcagcctaataaactagtttgataagtatggtggaatattggaaagtgacacgatttactcaaaatgaaagaacaataaaaaggtaatacattagaaagttggcatccactacccaatatgagatagttttgaaagaagctcagttcttcgttgataagtgctgaacttcttttgtcctttttattggtctaacaaggttttctcacttgtaatccactccaagcacatttatgttgtagcatagcggtaataccagagacacaacatttccaatctgtacgtcaatccaaattgactgacaaaaataacgtgatgataatataagcagtactcacaactatggatttcaagaagttgtcagcagtcgcactagcttcaggtgtctgagcgatccaagaaggaatcatcacacagtaactccatccggtttgagggttatgtggccatatggtgttccttccctcctgcagatcaataagcataagccgtaagaagcatcaagcaatggaacttttcatggtatcctattgatatggcatcatctttccagcgaaacctagattgagaagttatgtggtcttcatggaagtacattttctttaatacaaggaaacatcttcaaggaactttcccagttgtttgaaaattactgaattttgttaacgaggcatgtgatttacttgacggtgaaaaagaattgactaggactagtaggttaatcttcatttgcgttctaggatcatttcatgttaaatgtggtaaagatgttgggaaacacaccaagtgcaaagaatgaggctagcacaaggcaggcaggtcaaacaaaagagctaatcttcacaatgggaacaatgatgaataataaaatcaccatcagcctgctcaaatatgtatacgaaatcaattattgtacttatggccttatgcgtaacagtatgaacatgcctaattgcctaatatagaaatccaaagcccttatgtccgatggactcagacaaaaccagagtctttgaaataagcagcacatatacaaccaaatcaatccgcatatcatgaagctgaactgcactcggtttgtctaaacccatccccgcagaagtagtcctacctgaaacccatactcgactccttgcaaaagaaacaggaattcaaaaccctatccaggggaaagctctaaaacaactctgaatcagtagcaacgcaggcactccaaaccaacaaatcccaatgcagatcccaacccacacatgaattcctagccttacattccactactattacacaccacatagccgcgggcaaatccagctcgcgatatcgttacgatcgagaggacaagcattaaaagaaagaaagaaagaaagaaaatccccgacacctcgcaactaacgccgaatctgacgcacgcagcagcaacgccacaggatcgcaagctcccaactccaactcccgaaccgcacgtccctcacagatcaaagcagggagccaacccaaccgaacccccgatcaatcgagcccggatcgaaattagcgggggggaggggggggggggatcgcgcttacccatctcttcgggggcgggctccagtccatgccgaacggcagcccggaggtgccgtcgtggcggtgcttcggcgggctcggcgccttcttcctcgccgacgaaaacgacgacggcgtcgccatcgccgcccgcttcggcggtggatcgagcgggcggaagggtggggtgaggtgggagggaggaatcgatgcgggggtttggaggcgtcgcgccgacgattccgaggtggacggagtggaggaaggggagggggagtaagagggcggcgaagatgaggcggacgcggacgcggacggggagggaggggctctcctcccgcggtggcgtctaaccgtcaacgcgcggcggtggcagccaagcgagggcgtcggtccggtccggtccgggtctaggcttttccaccgccgtgtggggtggtgaagttggtggtgggccggcggggagttgtgtgggtttttcgcaagcccacacaagtgtaattgttggatgtggccatggctgccgacagataatggtatgcacttcttagtgacgaactggttcagtacatactactaggctgtgtttagttccacactaaaattgaaagttcaaagaaattgaaacgatgtgacggaagagttagaagtttatgtgtgtacgaaagttcaatgtgacggaaaagttagaaggccgagtttagttccaaattttttcttcaaactttcaacttttccatcacatcaattttttctacacatataaacttctaattttttctacacatataaacttccaacttttccgtcacattgttccaatttcaaccaaacttttaattttaacgtgaactaaacacacacgaagtttgaagaaaaaagttagaatctaaacaatatctaagtagaaaaaattatggggttcaatacatctatagttggaggaaacaatgaccaaacacatatttgagattgtattgatgctcgaaacaataacaaaaaaaacatgtatatctctatctcttctctactattataaaaattagagttgtttttgcaaaaattttggtacgttttgagtcggttttaagttcgttgtgtttgagttggattttaagctcgtttgattttgaaaatacaaaaggagtcgtataagaaatctctttaaaaaaactcgcatactaacttgagatgaaatacggatccaagcgagttcccacaaaccatatataatattattattattattattaaaatagcacttacccgttgcaatgcaacgcatgggtattttttgtagtttgagtaaaaaataacgaaggaagcactaacagggtttgcaatactagggtttacagtactgaacgaaaatcgctccatttccatgaaatcattggagaccaatttgtgaaaaacaagcagttttagttagttgtatagaattgaccaaaagtcgtcctcggtttttaccaatttttgtaaagcagccaagaccattgaactctgagcactacaagctatgaactgtagttagtactgtaacttaaaatctgagtcgcaacgactcgcactcagaatagacttcacatcgtcggctccatactcgacaaagcactaacatccatttcagaaaaagtgttgccaagatatagaaacggtgaacgaacaaatgcctgagaagggtgagtatgagtagctcattgcaccacgatacgcgtattcttagctaattaaccagtagccggcttactgatcagtataatcgtcatcatcaaggccaaggactgccaagaagtgcacatctcatgcaacaaatagaagtcctttcattcataggaagcgtagaaaagtaagaaaacaacagtttcttctacgggtgaatgaacatctttgatattacaaggttccctcggaatccacatacaacacggatagtaatgctgagagaccaggaacagcaggcatcagaaatggttccaagaactcttcgcaatgataaatttagtccatcctgcccttgatcacacactcttttacttcggttggtgtcctgaaaacccaaaagaagattatgtaaaagaaacgtattgatgctcaaatgaagtgctgaaacaactaaaatgcggaatgcggtaggactttgagctccaattatatttgattgggaaaaaaatcattactgatgaacttctaccaatttattgcagaacggtagataaaataatggtgcataacgtattttaattcaaaagctgtttaacagaagaaaaatgaagccactcatccaatcttgaattagtgaagtgaacttacacaagcagaacaaagcctccccaaccactgaggcaatcacgatcaactgatgactgcagagcttgtgagatagtctcaaagagttcttcaggttcctttgtcaagaaaaataatatgttgtcatgtaacatctatcattcaaaatagtggtagaaatctaaacagtacaatgcaacagaattataatatattatacagatccaaacagaaatgcgaaattgctatagcccatgatgttatcccataaagaatgttacacgggctaaatgtgatcatacaaacaaacaaatgcataccatgtttggtttgtacatggactcacaagcaccatatagagactccgatgctgtccccgatacaacgaaatccttagctagttccctgcacagaaataaacatcctcaatcagctcacaagaatatgagaaacaagcgttcaaacgcctaatcagacatatcaggcacacggacttagaccaaaaacttaaacaggtggcatgctattggaataatagtatcaaagttgtttcagtacatgatgaagcagatagaaaaaatatatcaaattcagaaaggaacaaaaaaggaatcaagcaaatctctgatagagcaagttaccaatgtcaagcatgcacacatttctctgggacagagacggagccaatcgtgtttgggtgtcatggaattcaggatagaaacaagaatggtgaacccataaatcacgttgttcattcacatggggtcttttgttaatgatgatttagaaatttgggaggtaacctttgttagatatgacaaacatatttataaattaaagatgtagataactccccacctaaccatctaaatgtggaataagactaaggcgggcatattaatcaatgcagtaaattgcagaacatgagcaatggataaccatccagatgtgtatgaatagatccaaaagaaattaatttgaataaaaacaaaaacacaattgaactgatacatactttgcaccaatgcagtccatggtacaaataaatggctcattgtcctctccaagtccagcgataacaggctggcagaagtatggtccaaatctgaattttccatgtatcgaaaaaagttagataaacttacccctaacccaataattgtataatacaaaatgaagaaagctgtttactaatagcacagagaaatcacaagtcttagcatgcaaactttacttactactatgccaatcataaaaaggctattgtattgttaaaatgttgagaggctaatgattatcaatcaggaatttcagctcatatttcccaactgcccagaagttatctgtcaacctgattgatgttgagctaatttctagcttccacatcatcataaaaaaaaatcaagcatttgcctataaatatttatcagggtaaaccaataaccgacataaatctcgattctggtgctgcccttggtgctaggctctggcaacaggctggtgccaagtgcctaaccaagtgggttaagcgcctaagtggcagcctaggtgaacagctataacacagagcacctatttcggcttggtggttgtcaagcggaacactactcatatgagtctgttaagtgcatatgagttactcttttggtgcaaacaggggaaaatctaaaaggttcaaagcatatccatcaatccatgtagagcttactacatcaactaaatcgagagtttactctttatgtgccatttgagcaatcagcaagctagcaaccctgcctacaaacaattatcaaaccaacggcggcagccatggctacaaccacaacattatggctttagcttcttagtatgctcatcgtgcaatatggttatacaagacttaaatgtctaagcataacttgggtggttgtaatgtgttttctgtctgtcacaagtagagcacacatatcctttgaaacataaacctgctgcctttaacaattgtaccttcacatagtcaagttattgtgcaacaagaacaaatctaactacttgacaggcgctttgtaacactataaacagtcagcatatctacaaaattctgcatctttccgcgaaattgaatactccaattggcatttgaatttaactctgcttcatatactactcaattcaactcgcgctgcgctagcaacatcctttagttcattacctcttctcgtagaggagagcggagacgaggctggcgaaggtctggggcttcatgtccctctcctcccgcagttgatacagcttgtgcctgaacaccaggcgctggtacctgcaccaccgaccgaccgaaaccctaattctcccaaaccggatgctaaaccaaaaaagcacaaagaggaggggacaaatctggcgcggcgactcacagcgtctgcgcgtcggtggcgaggccggagaggccgatgtagagcttgtcgtggatcttgaacaccctctggaagtccgtcgcgacggtctgcagctgcaccccgagccgccggtcgctggcgatcgcgaagcagttcttccccaccatcgccaccacggcggaaccattgtactcgaagatctgcgaggcatgggagaattaagatccgtggggcgggcggcccggccggccagggagcggggcggcggggggcactcaccgacatggccggcgcggcggcgagttcgcggcggaggcggaggcggaggcggaggcggatgcggatgcaggcgtcgaggttcgaagtcgaggaggagaatcggaggaggaggagctcacgcagtgggcttttgaggcccaacttgggcttcttgctgagcaagaaggtccggcacagggacgccactggtcgttgaatacaactctaaccacgaaattcaataaaatttgttagaattcgatttttaaatatattttttaaacacttaaccagtttgtacgtggtttcgagacctgtaatggtgtgtttagttcacgccaaaattgaaaatttgattgaaattgaaacgatgtgacagaaaagttgaaagtttgaagaaaaagttgggaactaaaccataaatcagacctaactcctaaggcagcatttatttgagaaggttggagcctcttccatcctgacggtgtgtttggctcccggtcaaggttggatgggatatggcggtccatattttgctggatatggcgatccagttttttttttgagtgaatatggcgatccagttttttgtttgggccttgtttagttccaaactttttcttcaaacttctaactttttcatcacatcaaaactttcctacacacataaatttttaacttttccgtcacattgttccaatttcaaccaaactttcaattttggtgtgaactaaacacacccttggttgtagggatgaaagtggatatggtaatccattttttttgtttggttgggggagtgggatggatgagtggttgcaatcaccctttcattagaggtggtgagtatacccctccacattctcacccaaaaaatatcaagagtaaattgcatccatggtgcatcaacttggcaggtgggtgcaatttggtataataacttaagaaattagcattctagcacaataacttggcaggtaggtgcaatttagtataaaaactttataagtgattgtataaatacaacaacttgcaagataggtacgattttgatacaataaattaaaaagttatgtgacaacttaattatttggagtattttttcaataaattcaatttttaagtacttattttgaaaatatactagcgcatatttgtataagtatatttatatttttatcctaataactaataactgaaggtcaactaaactggatgtagaaatttttatatttcagttgatatttgagaaggtgaagaccacaaaaaaaatcttaaaggtaattggatgtaaattgtactactatgtgtagtataataattcttaaagattaaatttaatattataaggtaatatccatatgattactatgcaataacatactgacatcgtaaaaaaaagctcacctagcatatgtttagccaagttgatacatcaaaatattaaattgttaagttcttgtactagaacacactcacatgtcaagttgttgcattcggacgttcaattctcaagttcttatactatatcgcacccacctgccaagttattgtaccgtaggtgcaatttattcaaatatcaatctactaaaaaaatctagatagaaataaaaaaacagaaataaataaaagggaaaggagaaaaaggaaaaaaaattcttctcgaaatcgccggccgcccctcgccaaaggtcttcgtcggcagcccctcgcctcttctctcgccggcaaccccaccgccgcacttcttatctctcccgccaccgccttgcctcctctctccccggccgccgacgttcaccctctcttgcgggcgcccaccagatccggtcgtcgccggctcgccttctctctcgtcgccggctcgcctcctctctcaatgccgagctcgcctcctcccgctggccgcaggcgccgccgcctcccgccgacgcagctctcggtgcctgcactgtcgtcatcgtcgggtccagatcgtcgtcgtcgtcaccggcatgcatgaggcattaaatgtgtcgatgtttgatgtcgtggttctggtatttgcatggtatggggatcgtcggtgctagggtatatgcgagactgaggtaaaagagatggagacagggatttttatacaggttcgggcccctgaattgtcaggtaataactctacatcctgttggccgaagccggtattgctcttattcatgataatcacaccagtacaatgtttggggtagcctatctaactgttgttgacatggcggtctgacgatctgactcgtagtcaacaacaaggtagcctcccacctcgaatccgtgcccggcgagatcagagatagcgcttttgtctctcctgacagtatccggagacaccgcagggtattagccgtgcttatccctgaagtcgatatccggcggcttgtcttggcgtatgtaggcttctatgttgtggcttctatgtcgattgtgttggatgttgatcccttcatggtggatgtctgtccccctgtcctcctaggggggcttgtatttatacccataggtgtccccttgtccaagtagaactagggaaaccaatatggatacaatccgagtaatccttatcgtttccatggagaactctggttgtctttccttatccataactctctcgaggtcagtttccgtataagacatggtatgtggtggatcctgccgagatttagtcaactactattaggtatgtggtatccataaccctgacagtagcccccgacttcgatgcaaatgaacgaattcatattctcaaccgcgcgcagacattggagtaactgttatcgagctcatgtgacatttctcggtgagtttagagataacgttggacttcctttgtcagccttgtgcgggcaccgaaagggtttgtctaagtcaatctctgatgtcgaccgagaaagtacagagcatacgactaagtttcccgtcttgctgtaatcgagaatttggattgaagtcaagaaattttatctcggcgggtacaccatctcttcattccgtattccttgtcgagatccagcacccgttctcgagcgatcgagaaggcgtagagtctgcgacggaactttgtcaatatttgtcatactcgccttagtcgatcttggtgtagaaccatagagacatgcgatcttcgataatgtcaaatagaattttcctgaaatcaatactcagaaaagaatattagacagaaatagccccgagcgaacgctctaagggtgacatgttataatatgtatggtaaattgaaaatgaattaaatttaccgaccaatattttgagtatgagcgtcttctctcttaccgacttcgatcagtcagtttgtagagtcatacactctccctagcccccagccttgtcgtcgaagaatcgttcttggaggataaggctcttggacccttgacctgctgtcacgcccagaaattcccgaatagaattccaagcagaatgtgcattaaaatccccgtccaggaccagccggggtacacaaacgacaatgttgacattcagatccacgtcttacaaacatcataaaagtcttacaaaaatgcagcggaaaacaaaagaaactggagctaagccttgactaaactacagcggtacagcgggaacaccactccacaggcatcctcgacggcacggacgaagcctactcctcggggaaaccttcatctgacacatacccgtcctctggggttgggaaaagtagagcaagactgattactacccactgtactcagcaagtcataccggaataggggtatgatgcagggaattaacaaagaagagctagagtggttcatttgcataaatactagcatttataaacaggaattgaatgcgaaaacagttgtaataattaagcagtattaaacatccgctgtccaacgctaacccacgttgcgacaggcccaaccatccacctaaactatccaagttcaacagattacactagggtgagactaatcacggtgaatctggttgaccgcccataaccgcgggcacggctattcga

SEQ ID NO: 18896 - DNA, 801 bp, Oryza sativa
  unsure (1)..(801): unsure at all n locations
nnnnnnnnnnnnnnnnnnnnnnnnnnnnnnnnnnnnnnnnnnnnnnnnnnnnnnnnnnnnnnnntgacgtacattaaatatgcgtgtctagttgtatacactctttttaaaggcaatataaatacagacgctataacacgtactccttgaacgcacatactcatatcttatgaacaccttcagaagagactgagccggcatatcttaaaattaacgaggtcattatatgtgtctcgctatttacgtatacgtcgtctatcacttaaaaagaataaccgtaaatatatgagtacccatgtaaaatctagaaactaaattcgagtgggctagttccgttataaggaatctaacagttaagggccaacagttaaaccatgtatacactctttaatacgcagaggccgcctgatagcattgattgtcatcacgccatggacgtcttaacgggattagtttttgatggaggaatggcaatcaacacatgtatacttttgttgccttatctctctctctcttcttaatttgttgcatcttacaacgaacgaataagcaacagttgcttcttgtatgtacaagtttcgacatcataacaatcaataaatccttgtcattaaccggacgacacggtaatatctcacacttgatgaccgactcctgcaagctaaacaaacttaaaaattttaaaaaaaaacctcacaaaaacaaaaccactcaaatcaattaattcgatcgtctaccgctgtatatatatgcttcttgtgtactctgctgtatcgaaatatcatttggttcatcgatcca

SEQ ID NO: 18897 - DNA, 634 bp, Oryza sativa
ttattcaagacaatacgagttcatgataaaacttgaggacaatctcaccattgactttaccaggcttcttgccccatcggtgatggaataaccattccacaggaaagcagtcacaatcagcatcaacttcaacagcatatttcacaacctgaaatatgctttatttcaggcataagttctccgtgattgtacatcagtagaatacactaaaattatttaaaataatgtcaaattacacaacctcttggatgctttggtgtagtgcttcacaactctccctggatagacttgaagcaatctgtaatggatgggttctcgactgaaaaaacaacatgaattcataattaaaatttatgcatttcattcaagctctaataatatttgtattaatacctggtaaagcacctcatctgcaatccaattaccaattcctgatatgaagctctgttcaataaaaaaaaaatcaagtcttctgtttgtataggagatacaaggacctaatcccgtatattgtagaaacaattttgtggagctaaaaactcatattggttttatggtaataaaatcacctgatcgagtagaagagcttttattccaatcttctttctgctcagcgagtccgcaaaactgtcag

SEQ ID NO: 18898 - DNA, 9260 bp, Oryza sativa
gttttgttgagatcaatgcatttttgttgtttgtccttggatgggcaaagattagtactaccatctagttgatgtttatctgccataacagtttctaacttcttttttactgagaaacagcgtgtcttgtgtttatagcattgatttccatgtccatatgttgctggtggttatgtagttattgtggcaactataacgcagatgccaactccgacttcgtataaaatgcctatatttatcctgattaatatcattggtcaatgtgagttgtactcaacgcagctgtagtttggtgtagtagctgcaacaattaagccatgttttcttcaacttcttttcacactatcttccatctttagtttaaagtctgatcgtttcgcatacaactgataaaccgtaaaatgcttatcagtaattaaagaataatttatgagtaaaacttttatatttgtgctaaaataaattataataaaaacccttaaaatcaactataaaattaaattttagccacagttgataagccaaaaggcgaagattgaagatttgatctttatgtgaactaaccaattaattgaagatttgatctttatgtgaactaaccaatttttaatgctcttaattttgttttgattttgctaaaagaagagtttgttattgttgatgctaacttatacttgttgccagaaaactttaggacagttggggcgattggttttgggtattggttatcggtttatggttggccatccgtatcagcttatcagaaaggctagtaatacagtcgacctgttagctataaggttctgtgtagtcttctcttagcttacccatataatagttagctctttacagttaatacagggcaaacttatctctctcacagagtttcttggttcttgtgtcaagtcggctgtaagtttacagcccgctctcctctattatctcctccacctcagcatttagccggcttgtagcctactattatacttgctctcaggggattgggatacgtctgctcatcttgaacaatatctagtcaaagtcacatcttttctgcgtaatgtcgcatcttttttgggtaatggataatttaatttaaatctgccaaaaaggttcctgttcggtcggcgagaggtcagacttcaaaaaattaaaatgggggttgccccaattgcctttttcttttctggtcagactgcagatttctgtccaattaatacatggagaacttatagttccataataactgctatgtttttgctgacaccttcatatcaactagctgacatttacacaacatttagaagaaatactccttccagttaaaaaattccataaaaattttaaatgcttgtgcttttttaaaaaaaattggtatacttagattttccttgaaaaagactattataattgttagaaatataaaaaaatattgcccctaaacataaaatatttattataagagagaataattgttttttaggaagacaaattttgccacaagacactcagaatttgtgtaattgtttggtggacatcgtaaaaaaatgtcaaggttagaggacactccgaaaagctggtaatttgttaggggatactttcaaccgaattgaagagacaaaaatttcaaaaagatgataaagcccttagagccaaaagtttctaacttgacgttggagcaatgatggaatatacttcagctgacgctggagtgatgatggaacatacttcggtttgatggaagatttatggttgcataatttccaaattatcttccaacaccatggaagcttgttgctgcgggggcattctcatctgttttatgaatctctcttcatttggatcaaaaatgttgcgaactaccaaatttaggaatattcttcagccgtggcacatgttttactatatctatcaacaaattatacaaactttagatgtcttatagcaaaatttgcgttcaaggaatattttgaagctataacgcaaatcattcaagtatgcaactaggcaagatgggctagaagaagaagagatgtgcttgcaaaccaaagccagcgaactacaccgactgaaaaatatatttaagaaaataaaacgagagcaattctcttgcgtcagctttggtaacccctcctgttcagtgccacattcatggctaactcaccaatcattccatgcaaacctgcacgtttcctcataaggcgcaaaaaacggtgaagtactacgacgaatcggccaatcagacaagtcatctctctcggactgcagactgaaagtctgaaactcagccattctataccagtacgagtacagtacaagattgggttagctcaggttggttgtgagcttcccaactaatctgaatctgaacctccctgaagttgaattcagaaagctttcattatctctaatgaagcaatcagagcctcaattttcaacggttgcctgcacgccacagagagaaaattaacctgcagcttcttgctggactgcgagagtgcccattgctgaagaatttattgtgacaggtgggaagacggagggatggatggccagctgacacctacaacatagacgggtcaaaacttcagaaatggacccggagcaaacaacagctacctaattctatttcaaagcactttctttatgctgtcaatttgaagaaaaaaaaaaccctctactactccctccgtcccaaagaaaccaacctatagtactaatattgacacattttagtatgtccattggttttatatgagatggaggaaggatataacaacggaagggagcgtaaatatacttttataatgagagtgttatatccttggtctctttacaccgtgaatgtacacaattatatattcatgtaagtgcaaatacgtggtgtggttaaagtgataatgagcttgctatactatttggtgaaagaaaatataccgcctcctatcattaatatttgacgtcatataatatcgacataagtttgtgtgtagcgtcaaatataatgttagggggggggcatatttttgtaatgaaaaggttttatatctttattctctctacatcgtagatgcacatagtcatacatgcatgtaagcgtaaatatgttgtgtggtgaaagtgataatgaacttgctagactttttttgacacctagttatgctccctttttatgcactgccgcaccatctcttttctcctcttctctgttatcatcgtatatactacatattttacattgaacctattgttggctacgccattatggcatccaccactgctgtcaaactgtgtaaaagatgacataccactattaagagtgttaactataaaccaataccctcaggctatataaaaaatgatttcaacaatattgatgctgagcaataatgcagacacatcgaaattcttgagttaggtgtccaaaggcatttaatcaatatttcactggtatttgacatggacttttatagaagaaaaatacatcactgtagtagtagtatctttttccaagccctgttagcaacagtattgatgtggttgtcctcctactctacctgtatttgtcctcttccacctcataccaaataaaaccccccctctccattgttctcgcagcgtataatctcacccaaaatacacgcaatctcacgccatttgcacctacaaatctcatcatctcatcaatatccatttctacaaaaaaaaaatccatttcagtatttcattgctgtagcatcaaatttattggcattatttgctgatattgcatgctgcattgagaagaaaattaaagaaactgacttggatagcactgcactctagctaccattttcttggcttgtttgcgaaagctgctccatctcctgtgtcctaggctctttccctttttaaccccgtgccacagctagccagccaagcactgcacaaacctttcccctgaagaggccaagaagttatgggagaggaggcagccatggccaccatggagagcgcctaccatgatgagcttgctccggcggcggcgccggcgccggcgaagggaggagggagcaagaagaagaggaagcagcagaagagggaggagaagaggaaggagtgcaggctggtgagctaccacgagctgccggactacatgaaggagaacgagttcatcctcgactactaccgctccgagtggcccatcctcaatgccctcctcagcctcttctcctggcacaacgagaccatcaacatctggacgtatggatttcaacctgaatttttctgaatttgattctggttcagctttgtgtgctgtgttcttgctgctcatcgtgtgggcgttcttggtgtttgttcaggcatcttcttgggttcgtgctgttcttcggcctcaccgtcctgcatcttggccagtacttcccccaggttgctgatctcatcggacacctctcctggtgagtttgtgaaagcctcagtggaatttgtttggttaaaatcttggctaatgtgtcctggaattagtagcacgaaatagtttagtttttcagtagctgtgagatgaatattttaacgttttaaggcactgaataggattctacatcctacttgtttcttgttaatcaaattatgctgagtgatagcatgagagtttcgataaatctagctgcttgtgtatcgacaaattaaatctcaccaacaaattcactccaattccatacaacctggaaaatgacaagttgcagtttttatttcagatgtctatgtgctttgcatgcttaatattctgttcactgtctgtccctttttttttttctgagaattgtacttctatttgactgcaggccaatctcaaaggttgctgaaaatgtctccagtaacattggagatgtcctctctgtgagtaaagcttctatttcctgaaatcattcattcctgtgatagaagtagaagttactgataagaaaaaaaaatactggattgcagtaatattattgggctggttagatccacatgcttaggagattcattgtgcagctttgagtggctccacttttcagtactgtcctgtttccttctgtttgttcagatgtgcatgatttggactttttggatggcagctgggccaaagtgttgggtggggcttctgattgctttcacctttacctgatgaaccttgcccaattaggtccccttttactggtgcccattcatgacaaatcctagattaagtgttggccacttcacttcaccacaagatgttaagctttggtgatgtgttcataggacttggttgtgacttggtgattgtgatgatcaagtctacccgctacgacacgactccagtgtcgccgcgggttatcttttcttcttgaaatccttgtgccttggatgtctagattgacaagatacatcatgcaaccaccaaagggaagattttgagacttgaggggaagattttgggaggttaagaggttaggggtcactaaaattggcaaacattggggacacatatacaaggcgatatttgcatgaacgtggtagcagtttatcgcgtgtgatccttccctttgtgttttcataccaaaccttcttccatcctcacatggtaacagttgtcctctctttttgtgattgagactagttggtagacaattttgggcaaccatagtaaaccttcatttttttgcataattaattacttgctagctaaattcattgcttgtcatggcttcccaactgttcttgaccaaagaacagtgtttggtaaccaaatagaaattcttagataaggaagatgaatttgttcggagttcggacaccaatatggttagatgttctattcaagcgttgaaacgaatgtcgtcgcaataattcggtgttcccagtcttctaaattctaatgcatatgctttaatttggagagtatattgctttcagatgtttaatgacatattatacttcgatgtgatatgctacaatgatgatcggtgtccgatcagctgtcctgtcacgtcaatggtttgatcgagtttggcgtgtgtgtccatgcattggccagggcgcggcgtcgttcatgcaggcgagcccggcgtcgagcgccggcgccatggcggcggcgtggccggtgacggcggcggcggcggcgacgacgcggtggccgttcttcgtgttcctcgcgggcgccatgttctgcctgctgagcagcgcggcgtgccacctcctgtcgtgccactcgcaccgcctcaacctgttcctcatccgcctcgactacaccggcatcgccgtcatgatcgtcgtctccttcttcccgcccatctactacatcttccagtgcgagccgcggtggcaggtggtgtacctgtcggcgatcaccgccgccggggtggccaccgtgtacgcgctcatgtcgcccaggctgagcgcggcgaggtaccgcgcccaccgcgcgctgctgttcgtcgccatgggcctctccggcgtcgtccccgccgcccacgccgtcgccgtcaactggcacgagccccgccggaacgtgacgctggcgtacgagggcgccatggcggcgtcctacctcgccggcaccgcgttctacctcacccgcgtcccggagcggtggcgccccggcatgttcgacctgtgcggccacagccaccagatcttccacgcgctcgtcatcgccggcgcgctcgcgcactacgccgccgccatcgtcttcatccaggcacgcgacgagatgggctgcccggcgccatagctaagctagcgatcgaacacacaagaaaacatttctctccatggatcgatgaaccaaatgataattcgatacagcagagtacacaagaagcatatatatacagcggtagacgatcgaattaattgatttgagtggttttgtttttgtgaggtttttttttaaaatttttaagtttgtttagcttgcaggagtcggtcatcaagtgtgagatattaccgtgtcgtccggttaatgacaaggatttattgattgttatgatgtcgaaacttgtacatacaagaagcaactgttgcttattcgttcgttgtaagatgcaacaaattaagaagagagagagagataaggcaacaaaagtatacatgtgttgattgccattcctccatcaaaaactaatcccgttaagacgtccatggcgtgatgacaatcaatgctatcaggcggcctctgcgtattaaagagtgtatacatggtttaactgttggcccttaactgttagattccttataacggaactagcccactcgaatttagtttctagattttacatgggtactcatatatttacgggtattctttttaagtgatagacgacgtatacgtaaatagcgagacacatataatgacctcgttaattttaagatatgccggctcagtctcttctgaaggtgttcataagatatgagtatgtgcgttcaaggagtacgtgttatagcgtctgtatttatattgcctttaaaaagagtgtatacaactagacacgcatatttaatgtacgtcatactcccatcatcaaacatttagggtgttttggaggggttctctccgacacgcaaaatgaagtatacattaacgcattattaattcaatatattagttatttttaaaaaaactaatatgattttttataaacaattttttatagaattttcttaaaaaataaattgttcatagaagtttggaaagtatacgtgcggataaacaaggaaggagaagttgtgaacataggccctgtttaatttctaaaaattgtcgcaaaaacatcacatcgaatctttggacacatgtgtggagcattaaatatagataagaagaaaaactaattgtacagtttgcatgtaaatcgcgagataaatcttttgagcctaattagtccatgattaaccataagtgctacagtaacccacatgtgctaatgacgacatgattaggctcaaaagattcgtctcgttgtttccaggcgagtaatgaaattagttttttcattcgtgtccgaaaaccccttccgacatctggtcaaacgtcctatatgacaaccaaaaatttttatttcaccaattaaacaggcccataagaacccaacataatgcaattagacacacgtatttaatacacgtcgccacacgtgtttgttcagcgttagtagtattattctgatttgaggatatcatttttgaatagtcgaatcgaatagggggcgggccgtgggggttcataaatggccgacctgtgatgtgagtcgtccacaccccacaccccacccaacccgagcctcagccgaccgactcgacgacgtctcgcgctaatcgcaacgccgacgcccatttatgaccagccttcgcttggctgcacgtctccgtcccgtatcatattgccgtctcagcgacccagccgccgcgccccctaccactgccaacccaatccatctctctctctctctactgctctccccgaacgcgctaccgttgttggacccgacgacgacacacgcggtgggtgcgtgcagtgcagccaagaagccaggtggtacgcgagagaaccagacgaggcccgtgaatctccgcgatttccatcgcgcgcaccggcccgcgcgcgggcaaaatcccagcggcggccacgcggaggcgaactacaccgtgcgcgcgcgcggcgcctcttccgcttgggccgcgcgaaatttacgtgcgctcacgtacgcgaacgggacgaaacgaaacgaggcaaaaacaaaaaaaaggccacaacactgcggcgggcgctgcttctgctgccgcttgggttgggccacgcgagcggctcagcctagtacacgcggctcagcaaaggggataagttttttgacctcccttaactcttgctgttgattgaattgcatccctcaaccataatagcagagaacaggtgagagagagggagaggagaaataggtgagaaaaaaagagatgagattaggatgattggcatgtgagctgatatttttatctttttcctggctaatatgtgagtcctatgagcgtcacgtaggatgaaaccgctatcaaaatagctgaggtacttttatttactccggtttttgaaaatggagaggccttatacctggtattatagttaagggtcaaagattcaatatatagcaagagttgagggaggccaaatagacttactgcacaaatcaatggtagtggtggtgaacttgagggggcaggggaggaggtaggtttggtttggggtttgggggaggggg

SEQ ID NO: 18899 - DNA, 1003 bp, Oryza sativa
gatcgattgctttttgctactagtaaattggagtgacaaattgctgtgtgtgttgcaaggatggcaggtgcgatctacattaagggagttcctgtgaccaagtacaagaggcatgtgtaatttgtatgctggggaatttgttatacagtaatggactacatgctgattcagaaaattattgcagatcagttgtcagttctacagacgagtggccctccaagtactccaaattttttgttcaagtaagatctcctagctgtcacagcatcttttttcagtacattgctgctatgtgagatcaaaattaacagtttataagcaaaaggggatatggaattgttgttcatcagtactgtactgtactactttggttgggtcttataaagagagagatggataggtagtaactgtcatcgtttagcttggacacaagatcgatttgttaggctatatagctcagaaaacatgttttggctgagcctctagcggactagctaatccaaaatgcggaagaacaaatcgccacaaacagtagtgcttttgtgatctccagaaagccagaaaggaagacgtgccatgtctcagggttaacatgctatcatataaacacgtcaatattacttctgctatataaggtttattgaatagtaatagaacacgcaatgcatgcctaggcattgttgtttagtcaaaatttgatctcctcttattgtttatgtccttttatgatatcataggttggctcttttaatgttggttgtttctaatgcatttaacttgttccagcttgatgatggcttagagttttccttcactgataagaggcggtttgcaagagttcggttgtttgaagatgtatgtgctttgactagttgaatctaaatcttcagagtcttcctttcatgttattttctaatgatgtccctaatcaaataacgatttgcagcccgaaactgtacccccgatttctgagttaggaccagatgctctctttgagccgatg

SEQ ID NO: 18900 - DNA, 4373 bp, Oryza sativa
ccttgtagccttgattagtgagttcttttctctgtgtcttgtgcgctactgtaccagattattcaaagatgccctcttggaaattggaaggtgtaatcgttccatactgggcaaaacatatgcttctcctgtgcaacatgaacaatgacatatctaggctatgttgctcgtgtcaaaccaccacctaggttatctttttttatttttttttaagacggaagaagtaaggatgaatgtatacacacatgcttgtctatcattcttaagatttgagtctcttggggacagagagtaatccatagatttaactcaattagtcacttgtgtcatgtctgcactcataactgtgcagttccatccttgcctttctgcaagcagcacactagtgagtactagtgatcatgtgagaagaaccaagtaccattttatatggaaatttagttgcaaaatatttcaagccacttgtatttacacagttggctatctttatatattggccagtacactcacgagcagccttttcaaagtctgttcagtataaaatccaaggtaagatcacatatggccattgcccatttgccgtgtttcatgcacagcccagagctactacaaacagaagacaacaaatgacacggggttacatgtccatcacatcaactcagttactgctcagtattcgctcacgggcggcatactgccaacggagtctgcacatgctttgccctcacttttgcaccaatcatgcctctcggttaccctccagagaatgcagaatatcgatcgagcattccggctcctatgcagtcgtcaaagtattctctacagtatagttttctctcgctatccgaccgtacttgactatactagatctccttgctagtaatatgtcacagctcacaatgtcatgcatgtgagattttttcgatccaagggctagctagctctcctagctactccttccgttccaaagaaaaaaaaaaccccaattttaaatttaaaactggacacaacctaatcttgagtttaaacctgaacccaactcattgtgttcaggtttaaactcatgattgttttttttacggagggagtagctccgacaactattctatgagtgatactcgtccgtttcattttaaacacaaccgtaagttttcgagttcaattttgatcgtccatcttatttaaaattttttttataattagtattttttgttgttattagatgataaaacatgaatagtactctataagtgacttatgttttttttaatttttttaaagattttagattttctcaaataagaccgacgattaaagttagatacggaaatctatagttacgtttaaaatgggacggagggagtacgtgtgttctctcccaatatcagtgccaaaatcaaccacaaataaatctgtctgaagaaaacaggttaattaaattaatctcagacatattatgcttagatccgacacattattacatcagattgcatgcactgtccgcacatggaagtatgtaggattacacgcttaagtcaggctgcaggcattattaattaatttcttgataggatacgatcttgacggaaacaatttctgaacagttgctgtcttattgatcacaccacacaatcaagaagaggaagcatgcaattaagctgaaacattgaaacaaattaaaaaaaaaacacagcaatacgaacatcaatctatcgttagcagattgatccgttcctctagctagctagcagacgacatcctctcatgtttccacacactaacaaattaaaaccaacaataaattaatacacctcgtactcatcattaacacatcaataagccgagatcgagtagccaacctgcatattccatcaaaaaaacacactatatcagtatcaaatcaaagacaacatatatacctcctctctcaaaaaaaaaaacttttacacacgaatctagacataccctttgccatttcaagattcacgtataaaagttatctgttttttttcgagagagagtaattatttctgacgttttttattaaataatggatagaaatcctgcctctaaatccacaagtagatacacatagcaaaattatttctgacgcttatttgcgatgggagaagagagtaacacacttacaaacaagagcttgagcttgggcgccatccatggcgaggcaggggaatggcggctgaactagatggagcaggtgtagccggggggagggttcttgccgcaagtgaggaggagctggagcgcgaggggcaggtagatgttgatgttgaggagcttgagcctgatggtggtgcagaggcacacggcggcctccagctccacgagcccctccagcagcgggcagcacttgttcaccaccgggtcgccgatccccacgtgcaccagcccccccagcaggtccacgcacgccccgatcttcagcgagtccaccgggcacctctgcgtcgccggcggcggcggcgggcacggcgtcgtcgtcggcggcgtcgggtacgtcaccggcggcgtcgggtatgtcaccggcggcgtcgggtaggtgaccggagggccgacgacgaccggaggggtggtgaccggaggtgtggggtaggtgaccggcgggccgacgacgaccgggggggtggtgaccggaggtgtggggtaggtgaccggcggcggacgggtgacggggcccttcggcgggtgggtgacggggaccttgggaggggcgacgaacggcggcgggcgggtgaccggagacgggtaggtggggcccttgggggggcgaggggtagggttcttggggcccttggggtggccgggagagggagaagggtgcgagggcttggggtgcttgggcttgtcgcagtcgcattccgggtcgtactccgcgaggatggaagccacggtggtggagaggaggaggagcagcgtcaggaggaatggccgcagcttggtgctgcccgccatggctgctgctagctctgagcttgctagcaggttgtggtaaaaagggggggggggggggggggagaagaagaggagctagaagtgtttgtgcgatcgatctagggtttatggcggtgtggttatatagagtggcgagctcgccgttgtggcccgtgaactctagggtttgcagctgctagagtgctagtagctcggaaattatgcatgtgtgtgtggcaacgtgagtgaccgtcactcacagtgcaggatcttcatttgagccttggagtactgtacgtctgtaccacgaagtctagctagggtcataagtctaaaattattctttttataatgtaagtggctctaggaatggcattgttttttttatttcagaccttgctactatctattctagctctcatatttatttcaatttgtgtggaagtacacaatttaacaatgaataccagaatctagaaaaaaaataaaatcccctctttcccctcttccgtcactctctcgattctctcctcgactcctcccacggcagtgaccgcatctcagctcttatctcgtcctcccatggcccacgactgttcggtggctctcctactctaatcggcgcgtcgacgagctcggtgatgtgggaagggtggactactatgagctcagcggcagagagtgggaggtatagtcgctttttcctttcctaaaattgctgttgatgtccctcccccatctccaacaacgagctccctagtgccatcgccttgaaccgggtgaacatcgaggagattgacacgacgacgaaaagaagcgacgaggaggtcaaggcagctccgacggagcggctacggacaggtcgaggcggtcgtcgtcgagctgcttcttcataggtcgatcacgacgataacatcggttggttcgaggggcaacaacgagcttgacagtacggaatggggacaacaatgaggtcctaaacgctagatccgccgcctcctcttcgtccaccatttccatcttcccttctcctcacccgcgcacgtctctcactaggctatcgtcgctgcctcgtcgagctcgctagatcaggcattgggcttgcctcgatcagtgacaaccacgagtggagcaactcgggacgaccgccaccacctcgaatcagctcatcgtcgctggctccaacgggttatgagggcatcgcatggggcaacacttctcccaacgtacaacgctcgctgttcctctccccctccctgaaaaatccctcatgaatattaataaggaactcgtgtctcatttgggatttccattcttcacttggtaatgggagaagcagatgtgatgtgaaatcttttatgtggcaagttgatgttgaatgacgtgaaatcttttatgtggcaagttgatgttgaatgaca

SEQ ID NO: 18901 - DNA, 1618 bp, Oryza sativa
tgcttcttcataggtcgatcacgacgataacatcggttggttcgaggggcaacaacgagcttgacagtacggaatggggacaacaatgaggtcctaaacgctagatccgccgcctcctcttcgtccaccatttccatcttcccttctcctcacccgcgcacgtctctcactaggctatcgtcgctgcctcgtcgagctcgctagatcaggcattgggcttgcctcgatcagtgacaaccacgagtggagcaactcgggacgaccgccaccacctcgaatcagctcatcgtcgctggctccaacgggttatgagggcatcgcatggggcaacacttctcccaacgtacaacgctcgctgttcctctccccctccctgaaaaatccctcatgaatattaataaggaactcgtgtctcatttgggatttccattcttcacttggtaatgggagaagcagatgtgatgtgaaatcttttatgtggcaagttgatgttgaatgacgtgaaatcttttatgtggcaagttgatgttgaatgacatctatatgcattgtaaaagcccttactaccattccttttgttccaaagtaaatgaattttaatttagaatttaaaatttatacaaatattgattttaatgcacgaaaatctatatatttttcagttgtttacggattgatatctaataatcaaaatttcaccattgagacaacgggaaaggaatctctctcttaatcttaatgtttttagtaaacaacctaaaaatgattgtattgtaaaaacagattgagtacgtagttactggttttgtatgatttgcctaaagaacatcatgatcacactcaattgggacgtagcaactcgatcaacatgctaattgggtttttgggtggaatcctatatacttatatagttatccccactaagtatagttaatgctatttctctcttctcttattaagccatatcacctcaattatttctagcctttggatgatagatctatggtccaaattgtctcttttttcttctctcttacaaacatgcaatctcaattatttttaggctcaaaattatataaaattgtttagttttgataatcaaattacatcttatttgtacatattatgcaacctaattttccgcagcaacgcgacgggttatttatctagtaaaaaactatttttctgtacaaggacctctttagattgcagacgaaccgtaactggtcgtgtttataaaaattatcctcctattttcgcgtgcagacccttaaaaggaccacacacaaaaatcgattttcgcatgcggacctcttaatggtccgcactaaaaaaataagtctatttttgtaggcggacctcttaagggggcgtgattttcgcatacgggtctcttaaggatccgcataaagcctaggttcccttatctttccttctcaacacttcaaatattttcatccatatcctctcatctcctctctgtcactttctcacctcttcttcgcacaatctcactatgcgttgctctcctctctcactctcctctcgcggtaggcagtgggcccggacgacggcaggcggagggctccgccggcggcggagggctcggtggcggtca

SEQ ID NO: 18902 - DNA, 10398 bp, Oryza sativa
  unsure (1)..(10398): unsure at all n locations
nnnnnnnnnnnnnnnnnnnnnnnnnnnnnnnnnnnnnnnnnnnnnnnnnnnnnnnnnnncatattttaagaatttttcataaccatttaacggacgaggagacatagggcttgttcatattgatgtcattttcaaccataccattttttttataaagttgccaaaataatatacgtttagtttgttgccaaaaatttggtaaatatggaagaaatcctagcaaaattttggtattggctacaatctgaacatgcccatattcttaagaaatcaaaacatttcttttcctatatggatgtaacaccatacactatcactcaactcaatatattctttttcaataatcaactttcagtcctcaaagaaataacaatcaaaattctcaacgtgagatgcgtgtggagagatctgtccaagtctaccatccagtctctcgcccgccaccgcgcgacaccatcttaccatcatatccaaacaacgtgctacccttgtcgatcgatcagtgatcgatgttgagaccgacagatattatcgcaggtacatgcacgacatcgagcacgtacgcacccgcgctcgcaccgcatcggacgtacgtcggcgcacgcgtccgtgatggcgtgtgggggcatgtacgtacgttcagggtaagttttatagtggaggtggatgtcagatctaatttggaccatgtcatcgtcttcttattaattaaaaggcaacgcatacaacatatcacatctaatacacaaaccaaaatattagtttactctcacatcatttttcacttttcttggagattgtgtagagcttgccccttgtataagagcaagtttaatagtatagcatactactagcttcaattcatccgtagccaatctaatagctaattcatacaatagttgcttattatacttttaatatatggtcccacatgtcatatacatattgtgtcttggagtccgtgctgcagctggctacagatctgtagcccgttgttcttctctatcatcttttatcttattaaaatatgtttatagctagctaatagtatactattgtacctgctatgagggatggcttattctctctcttcttcacctcattatctaccggcagcagagccgcgccgcggcggcctatcctcctgccaatttttgcttctccaaaaaaaaaaaaaaaaagcctctctgcaaaccgcgcggtattgtcgccttgttcaggctaccccatgctagcttagctctactaactgcacatatcgccaatctatgggcgcagttttccgtgaaggcgccgtgggcgtgctctcgcgctgattgggtacatgtggttctctcaaggtaactcttttttttagagggaactcttgttcagttttaacttcagtttacaacattttttaaacagtatttcaccactttgtttggagaccacatagttcatcacgtggattatttacctgtggtacagtctggctgcccgctgtgtgtacatgcatgtgaaatttaacatcccccaatttatttcttgaggttaattactccttttattctttttgcgagcattttttttaaataaaaacgaagccagacttgctgctgttatattaaataggaattgagtatatttacatattcactaacggcgcaaagaagaaaggaataaaaacaacaaaaatacatttatatctttgcataggcactagatatgaactaaggtataatattcttgcgatatctttggcgccatacatatatatatatacctcacacctagattaattttatctatgattttaaccattagctgttgcattggagtttctttatttctgaaagcacttttgtttctttcacaccaaatcttccacacaatgcaatcagcataggtagtgacttcattgtcttagtcttgtgtttgcgaggaattaatcttatgaatcactctagctactcctagcttgctagtcttgcatttaatttaccatctctaattgagggattggataagcatccaagatatgtcttagtagctagaaattaaactagctaaaaaaatattgtatatatttatggtccctaaattaatccatatcctgctactgagctgtaatgtatttggatgtttgcttagaagtctatgcttgcatgagttgctctaaaaaaaaaatatcagctctcttcctgataatagattttgggcatgtgctgcagtccatgtgctctcctctgtcttggctaggccgcagaaatcgttcagagatggagtaggtgtgaggtgttcttttgtcatgacccagctgcctggcatttgcccatcacagtaatttgtgcggtacacgatgctatatagctctagttgacaaggacaaactttattcattgcataggcaggcgtgtcatgtcaccttgtgccacttgctcgccaacgacatacgctctcaaatctttgtgtatatatatattctgtttgtttttgtacacgtattttgtcttcactaattaatctatgtttggtgaggcacaagaacacatgtttgattaattacagtgtaataagtcatatggacacaggagccgagaggcccgagagtagactatgtcaaaacgattgagcagaattacaaccacaactttaattctacatgggaacaaagatggtgcacgtatgatttggttaacatatatggtcgattttgctgcaaagcttgaggataaaatactagctaacaagtcttttctttaaaagaaaactgaaaggggatgtgctctatgtaaagactaagatatcaacactgtaagcagtaaaggttgcacaatcctcgcaatgtctaacaaaatttctgtttgtgtagaatccacagtgtatagacaaagctagcgcgagacaactgatctatttctgaattcattctcagtatctgttagtttaattacaaaccagtttacatactattgcgtttaacaatttttttcttcgatggagaatgggaaaaaaaatgtgccaaatatggtctttatcaatgcggaccatgcatgattcatccgaattttcccagcgtagaggacttatctggctagggagggtacttctgttcactatataaactgggctggaatgttgctacaccatctttcataccaaacctagccattgggcccgagagcacttttcaaatagaaaacacaaaaagccactgtgcacgcggggatctcccgttccacctcatttagtcccacctcggaaaactagctccacacatcgcagcataaatagccggattgcgccccttgctgtcgccgagctcagcagcgcgagcttgtaacccgagcgggggcattaaggtggtgtggacgttgcggtacggctgcgggcctgggtcggcattgctacagatggctcgcccgttccaagttgagtagtgggccggcggggcttgtgcgaaagctctggggccccacggttcctagagtggcaggcatggcgtgaggctggtttcacagagcagcgaatactgcccgcttccaacggtggcaaggataacgggccgccgcactgctggcccgcttgggtctcgcatcctactccaacggaccaccacttttttatttttcttagaaaaataaaaacttcgttctgtttttccagctagctagtccgtgcacaaaatctttttttttttggttaaaaaagaaaaacttctttctgtttttgcggatagcaggagaagtgtccagttcgtgacttgaggtctctttggacttggaagtacaagattctcatagaaaaaagaaaatagaggattgcaattccttggaattttttttatacatgccatttgaaaaagggatttgagctcaccaaattcctatacatatgctaatagtattacaagtagaaagcaaatgaattttgtatgaaatgttgtttggaacacatggttgtcctgaacacaaaatttagattctatcctacgccagctagtgaaaaaataatgttgaatgttcagaaatccttccgaatttatatgtttttatggaaatcaaccaaattcctatgtatgattctcatattcttgtgggattcggtagcatatgacattctaaggattcctttggaacaaagaaaaaaaatagaggaaatctaaagtgttaaaatcttatggaaaataatcatacttgatcctctgtaacaaaggataagcatacgcaaaatcctttgaaactcccattgaatgactcatttcattcatgggaaatttggaggaaagcttgtaagaagtatagcttcatgttttcccttgtgtcttagattcctctaagtttcaacagagcaagatattctgttagtagttttttttttccaaatcctgtgtttgaaaggagctaatcctacgttgttttctattcccttgaaagaaagggaaaacagaggaatttcaaagaatttgaattcaatgaaaaaatttcctatgataccctttggaatagaggattagatctttaaaatttctttgaaattcgtatggaattgctgcttgtaaattttagaggatttatatcctatggaatagcatgtttcatgtgaattttagaggatttatagtatgggctccaaaacctcctggaatttttcctttgtccacctcttccaaatcctgtgtttgtcatgtgctccatccaaacagcttcctctgtagttttcctatgttcctcgttccttgggatttaataacagttgttacatggctaaaaggattgtgattgtgatgttttagtgcacttgttttttctgtcccaacaatccaacatgcatgcctgatgcctggttagcatgcatcatcaaagccccatgcagtccagatttaaaacgaggtgatcaccaactgcgttggagacttggagtctttaaagtgaagagaaaaagcacaaaggccatcacaggacactggttagcagataccagcagccatcaggcaaggcaaagttcctcacaaataatggggcggctaccgaatttgttcatggcattaaagcaaggaaaacatcccgtgaaaagatggacaacttcaacatttctgttcaaacgggcaggcttaggatacagcgacacagagacgttctcaagctcacatattatggatttgtatcacacagcaaggttttaatgaagtccacagatcccatatgggatatcaacacacgcattttagcataacagtatttacgaatctaacaaatatgagtagcctttgacgtgacaatggctcatagcagcttgagaatcatatctgcaaaatgagatacggtggaagttagttaacggggaaaaaggtttaatgaatcaatgcatataggcataggccatttcccatatatggaaagtgcagtgaatatgtaatatgcatgcattaaagaatgcatttagtgaactcaaatttgtggcgtgcatttacgctttaagttagcaagcatgtgaaaatgcgatacagtaaagtttgaagacatttgtatacccttctatgattttgcatgaaaatacaaattggccttgaaagactgcatcgcatagagaaaaggtatgcgtgcaagtcactctatacacactgtctcgataaatgcaacaaagttcactatgtcctgataaatgcaacaaagttttagtaacgttcgtccaagtgttagggcttgtagccattgttaacctccttgtcaaaattttggtaagatggtttgatgccaaattttttttggcaaagatactttaaccttttgtctagccttcccaaagtattggcattgtgaatttttgcaacagaccaaatgagcctataaaagctttgccattaccaatattttggtgtggttgggttgagccttatatggtgtttggaagtaaaatcaccagaaaatgcagtcactccaagatgtagcactaagggggtggtgtttcacataaagggaaggtcgacacaactacaaagggcaccacagcaggatgttatgaaagccagccctttcaacacaaacaagggtaacaatagtaatcaaattacaaataaatggagatgagatttcatcactgaggaactcaacataaaaaatacatcatgaaaaatgttactttatatattcggtgaagagcttgtgctacttacattaacaaatgaacattctgtgagtaggattaaataaacaaactgatagtaggattaaataaacattttgtactaccaatattctgtgagtggcttcctggcatgtaaggtgcagaaaactgcttgcgtactgatttaactgtcaaatatacaattgagaaggcaacataaaaacaccaaaaaccttttaatctaatagctagcccagagagtttaaacataattttacatccaaaacatgctgaacattcaagagtaaaaagacaacttttatgtttcagcaggtaaaacaatacaatttacacaaaatgaataggtgttatcatgatatcatctgagcacaccaatgatcactggtctcacttcatacatgctgttaagggtgctcctaagttaaagcagaataatattatccttgttatttgctatcctcctcactttttaggtagtacaagaagagtaaatcattatcaaaatatcaattccgtagtaagtcataatataggactaccgcatgttagctgttaaaaatcctgaaagtcattttatgtcctatcacaattcacaacactacatacctcccaagtaatcagccaacagaagagatgatttgccgcatgtatgatgctatttgatattggaatacacagaaatttccattggtgaaattaaggctgtttggctgcctgggctgcatctgcgccacagacaacagcaacagtgctgcaagcagcaaggaaacagcgggcagcagcagccgcagccacagcccaggtagccgaatggcctgattgttaggtcagtgataacagcatgactcattgttttattggcatccatgttatgcaatgacgatgtcttcagcacagggagcatgacatgaatatgcaacacctcagtaaccctcgccatttgacaggtaagatgtgaggtatggttagtcttatgtttccacaaatcttaaaccatagcagcatagccattatttttcggtgcgcagctgcattcagaaaggccaaagtaggagtataactcaaggaaacagcgtggtcttgtagatactagatacacaccacataaccaccttcacattctccatcaaattgataaaaactaaaacaatatttcacaagtgcaacagaaggtaagtattcatgtatgatgctaggggtggctatgtttatcacctgaagtgaaatccctcagccgcgggccttaagctcagccaggcggcgggagaggtcgtcttcatcaacagccttctccttctccttggcagctggtatggcgtgagcggcggcctgcggcaacccaacggagacctcaaggccgtagtcgtcggcgacttgctgcatgaggctgttgacctcggtctcgggcgtggagagcgaggtggagcccgccatggcgccctccatgaactcggcctggaccttcatgttgacgaactggcgctcgaagttgtccatggtctcggacatcttctgcaggttccccgtggcgagcgcggagtcgagcgacttgacgatgtggccatggacttgccgatgacctgcatcttcgcctgggtgtcgaggcgcgcgacgacggcgtctaagcgggaggcgaagcggaggtagttcatgtgctcggtgcgcttgcggatggcgttctcggcgtagatccgcgcgccgtccatgttccccttctcgatcgccttcttcaccttgagcttctgctccttctcctccttctcgcacttgcgcgcctgccgctgcagcgacttggaggtgaacttgaggtcgaagatctgggtcatcagcttctccgggttccccatcgccgccgccgacgagctagccccgatcgtggatttggctagggtttgacgaggaggaagaggaaaggcagatcggattgggggatttgggaacgcgtcgtatttgcgaggagacgagacgcgaattggggatttttattattggggagatgggattcggttccgtttgatttgattcgaggaggagacgaccagtcgaccacgcggtttggtttagtgtacgccttaacggcgaagtaatcccccccgtttgtgtgtcgctgcgtgtggggtcggcgtgtccaactccaaccagtgtcgttggcgtcaccgacgccgtttggataaagcgttttattgtatctctaattttggaataattaattactagaaaatagatgcggccttgccgcacaatgcaccagccaatatgaaatattccatccgttatatattgatcatcaattgactaaaatcaaaaatttcaagttgattattatgtaatgttggtgtagttactacatctaagcatgaaaattgggtttgcatgcatgcatataggtatttgaggtagtaaagctctcttttcttgttgggggggggggagttaaaagtgtgcatgttttcttattcttcaccaccacttacttaagtttttttttgtgaaaaaacttatcaatatgaaatgggaggaataaataatatctatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccataaaaataggaaacaaacttccatctgttataccaagtcctattcggttagcatcaccaggagaaccgacaccattcacagagagagagaaagagacgatgccggcacctttcccgcccccgtcggaccgcagccgcctccatgccgccgaatctggcggaggcgaggtccggcccgccggcccttccacccccgccgggctgcagctgcctccacaccgccggatctggcggaggcgaggcccgaccggcgttccatgacgtccgccaccaccaccactgccgcacctccccaccatgcacagagagagagaaagagacgacgccgccgcctctcctgccctcgccggaccacagccgcttccatgccgccagatctggcggaggcgaggtccggcctgccgcccctcccactcccgccgggccgcagccgcctccacaccgccgttgttcggggagagggcgccgcgccgttggttgtgggggagggcgccgccgccgccgctcgcgggaagagaggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaaggattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaannnnnnnnnnnnnnnnnnnnnnnnnnnnnnnnnnnnnnnnnnnnnnnnnnnnnnnnn

SEQ ID NO: 18903 - DNA, 6072 bp, Oryza sativa
  unsure (1)..(6072): unsure at all n locations
nnnnnnnnnnnnnnnnnnnnnnnnnnnnnnnnnnnnnnnnnnnnnnnnnnnnnnnnncatgttgacgaactggcgctcgaagttgtccatggtctcggacatcttctgcaggttccccgtggcgagcgcggagtcgagcgacttgacgatgttggccatggacttgccgatgacctgcatcttcgcctgggtgtcgaggcgcgcgacgacggcgtcgaggcgggaggcgaggcggaggtagttcatgtgctcggtgcgcttgcggatggcgttctcggcgtagatccgcgcgccgtccatgttccccttctcgatcgccttcttcaccttgagcttctgctccttctcctccttctcgcacttgcgcgcctgccgctgcagcgacttggaggtgaacttgaggtcgaagatctgggtcatcagcttctccgggttccccatcgccgccgccgacgagctagccccgatcgtggatttggctagggtttgacgaggaggaagaggaaaggcagatcggattgggggatttgggaacgcgtcgtatttgcgaggagacgagacgcgaattggggatttttattattggggagatgggattcggttccgtttgatttgattcgaggaggagacgaccagtcgaccacgcggtttggtttagtgtacgccttaacggcgaagtaatccccgccgtttgtgtgtcgctgcgtgtggggtcggcgtgtccaactccaaccagtgtcgttggcgtcaccgacgccgtttggataaagcgttttattgtatctctaattttggaataattaattactagaaaatagatgcggccttgccgcacaatgcaccagccaatatgaaatattccatccgttatatattgatcatcaattgactaaaatcaaaaatttcaagttgattattatgtaatgttggtgtagttactacatctaagcatgaaaattgggtttgcatgcatgcatataggtatttgaggtagtaaagctctcttttcttgttgggggggggggagttaaaagtgtgcatgtttccttattcttcaccaccacttacttaagtttttttttgtgaaaaaactaatcaatatgaaatgggaggaataaataatatctatctactactacttaaaaaataagaggtgcttccatcgtccgtcaaaaaaaccgggtgaaaaaaaaccggaacgaatccgattcatcaacgcggtaaaagaaaaatcgggaaaaaaaaagaatatgtccgattccataaaaataggaaacaaacttccatctgttataccaagtcctattcggttagcatcaccaggagaaccgacaccattcacagagagagagaaagagacgatgccgccacctctcccgcccccgtcggaccgcagccgcctccatgccgccgaatctggcggaggcgaggtccggcccgccgccccttccacccccgccgggctgcagctgcctccacaccgccggatctggcggaggcgaggcccgaccggcgttccatgacgtccgccaccaccaccactgccgcacctccccaccatgcacagagagagagaaagagacgacgccgccgcctttcctgccctcgccggaccacagccgcttccatgccgccagatctggcggaggcgaggtccggtctgccgcccctcccactcccgccgggccgcagccgcctccacaccgccgttgttcggggagagggcgccgcgccgttggttgtgggggagggcgccgccgccgccgctcgcgggaagagaggcgccgtcgccgccgctcgggggcgcggaggggagggcggcgatgtgagatgggagggagggaaatgggctagggtttcggcggctgaggagaaggaggggttttgtttccccgatatcgacgctcggccgtccgatcaaaaccctaaagatcggacgatcggtgtcgtccaggccgaaatcagcccaagagggatcgagagtgaggccacttttctggcccaagcccaggttgtggcctggggaggggaagtgcacttgcgcgtgcacaaaaggccgtggaccgaccggcaagggccggaaataagtctattttaggtccctcaggcccaaaaaaagagaataagttcatttttagtgctcattttttcagaagcattacaattataagttattgaatgtgtttatttcgaagcaaacctaaaaggaaggattttctttctttttccaagtaaataattgttaaatgacgtttgtattaataaaattaacaattaagctctgaaaaattcaaatataatttcaaagagcgtaactaatcatggagaatttaaaaaaaattaaatttaaccatgtcattttatttctcacacttgctttacttgtaaatttatttaattatacacatacctacttaaaaataccaaatatttcaacgaatttgtattttaattaattgcatatttttctaatctgtacgcttcacattgtaacacacaggcacttttgctagaccaaacaacacttttggtcaatatacacactccgtaatcacccggtgcaacgcacgggcacttttgctagtggtcttataagtacatctattttctctatctatttaatgcttgaaattatggaaatttacccttttattcatatattaattgaaagcagcaagacattgagatgatggacataagttggaagacgaatatgtgcgtacaaattctaaattccaaccaaccaatgtaatgaaactacttattttccctccacatgttccacatgtgtataagaatcgaggaaatccttttttcaaaaaaaataattttatcttcttattccttaaatataacgttctaagtgcataacattaaaaagttcaagttacacagtaaaggaaactaatgaattgattatttgtttgaaaatttggtactcaaggagcataacgtttgcatcaagcgggagcaaaagatgtcggtagcattcttttcccaaaattttaccttaattttcgttagtacacttttcaaacatcggtgtgtttcatgtaataaaaaatctatgtggaagttgctttaaaatatcaaatatatcaatttttcaagtttgtaataattaaaacttaattaattatatgctaatagttatctcgttttgcatgtccgcatttaatctaaatcttcgtcagattcgaacacagtaatctcatttgctagttcattctatcctgaataaaagattgcaaagaggcctggcttttttttattattgtccttcccagtccgcagtccccactcttgagtctcgactcctccgctgctctccactcatcaatctgctcctcgctcgacctcggtgtctccgtcttcaccgcggtgccgccgtgtcgctactacaacggccttcagtctatagccttctttgcatgaagctcgaaggcgcctgtgtttgtaagattgaagttgcgccggcaacatcagtaaagagaagtctgtgatgcgctccctgtcccccacctcctgcaatccctcctgcttctcgggccagcggccggatccgcagcccacgataccttcgccctccgcatccggaagacaactcccatattcccaagccgatgtgattatcggcgcaaaaatctagtagtgagctttggtgctggacaaagcaccagtgagtgtgagttgtgcgatacagctagcgttgcttgcgtccattcacttactctctgcctcttttgctcatttgcatcaccatccagtatcccttagtataggctcggtgattttggtactcgcctgcaggcatgcatgcatgcatcctacttgggtattttcctctctacaagttcaacgaaagatctaaagagaaccaatgatcctagggaagacactgcttgattttctttgctgaaaatatctcaacacgtgccttaatttagcaccaattgcaggtaattttaaccagttctttggtgttctaaatggaaggagtataaataaaggacacgagagggtggttcgccgcggcgtcatcggccgtgacgcgcaggtggcggaggatccggcaggccaccactcactcgcacacgccggctcctctcctcctccgctagttagcgcccctcccttctcctgatccgggccgatggccagtgccgtccctcttctttctccccgggttcaatggatctggcaagtctgtattggcacgggcgttctcgagggtgactcctgtcggtgagatagaagcgttgagaaagggcggcagcatgcggcgggaagcacagggaaaggcgaggtggccaggcgaatgtgaagaagacgagcccaacgccgttgagggagaacatgaagcgggtggtcggccgcaacgcgcgggtggcggaggagccagtggattagggtcgagcaattctgcaaataaaaaatacagtaactccgtagttttacgatgaggtccaccgcaacgaactttagccgtcgatacttaatcaaagggtgcaaaaggagtgccaaggagacacgtggccaggtgttactggtttcgggccctacaatcggtatataagatttgtcactcttaggagtgatgataaatgatttgccactggacccatatgtcatagatacgtgagggctcacatgttatagacagcgagtggcagataattaattgccacatcttaaaagtgacgaaaagttaaatatccctctaatttcacaatcatataaacttttttccaaaaaaaaaatattacagttccttacaagtggttgttggtttggacacttttccaagcttctaccgctatataaacggtgtgttttcttaaaataaatatataaaatttgttttaagggtgtgtttagttatttgggtgtaaagtttttaagtatacggacacatgtttgaagtattaaacgtagactaataataaaacaaattatagattccgcctgtaaactgcgaggcgaatttattaaacctaattaatccgtcattagcaaatgtttacagtagcatcacattgtcagatcatggcgtaattaggctcaaaagattcgtctcgcaatttacatgcaaactgcgcaattagtttttccccacattttgtcagggttatggataccacatacctaatacatacctaatagtagttgactaaatctcggcaggatccaccacataccatgtcttatacggaaactgacctcgaaggagttccagataaggaaagacaaccagagttctacatggaaacgacaagtactactcgaattatatccatattggtttccctagttctacttggacaaggggacacctatgggtataaatacaagcccccctaggaggacagggggacagacatccaccatgaagggatcaacacccaacacaatcgacatagaagccacaacatagaagcctacatatgccaagacacgccgccggatatcgacttcagggataagcacggtctgacgctgtctgttatacaatatcaatttttatacaatatcaattatgcgagtgtttccgatgttaaatcgactacggtctgacgctgtctgttatcttctgtataaatcatgcttgtttacggtttacataatgcctgatatttacatctgctcattatatcctgataattctagaagatccatgcagtttttcgaatacatactcgatattctctgctatatatcctgccttctagaaaatatttttcaggaataattgagcactcgagtaggtcgtggtcgagtacaccgcattatcgagaacgatctcgacaaatgcagaatcgtcgcgcccaacctaccaacgaagaccgacaacctatctcatagcaccggccatcgctggattactcgagaaaaggttgttaacggataattcctcgcgaacgccgtcggcttgatcacccgacatgattgcgaacggacatccggatatgctacaagttgtgtgtgagagtcatgctggccacatgatatgcacatnnnnnnnnnnnnnnnnnnnnnnnnnnnnnnnnnnnnnnnnnnnnnnnnnnnnnnnnn

SEQ ID NO: 18904 - DNA, 1092 bp, Oryza sativa
tcacccgacatgattgcgaacggacatccggatatgctacaagttgtgtgtgagagtcatgctggccacatgatatgcacatgtaataaccaactttagcgcccctataggtgattaagagactcctactcctggttctcgaaccagtaagacgcagtgatctctctcgcctcactttaagtggtcgagttacgactactgcctggtcctcgaccaacgatgtagcgtttctcccactacttccacgttaagtggtcgagttacgactactgcctggtcctcgaccagcgatgtagcgtttctcccactacttccaccttaagtggttgagttacgactactgcctggtcctcgaccagcgatgtagcgtgtctcccactacttccaccttaagtggtcgagttacgactactgcctggtcctcgaccagcgatgtagcgtctctcccactacttccactttaagtggtcgagttacgactactgcctggtcctcgaccagcgatgtagcgtctctcccactacttccactttaagtggtcgagttacgactactgcctggtcctcgaccagcggtgtagcgaatctcctattacctctatttcaacaaagttgatagcaggtatacaatatcgccaagtgttttacccagagatcccttaccacgacgacacctagcgttgaaacctatcctattgtccttttacgccgtcttgacaaggcctccgaggaacctaagggaacttcggctggggacacccagagccgataaggccttgggggatcctctagagacaaaagaccatgtaagacctggtcgtgtaagagttctcgccgtgcgtattaaccaagccgtgtgatcggaaattgagttttccaacttcacagctgggggctaggatcagtgcttgttcaaccaaggcaggtgtcacaccccgaagttttcctcccaagtcaaaatggtaatttgcaaatgaccctaagaaaatgcaggtgaaatcaggagaaaaccctaaagaaagtaatgcaaataataatcagacttgacatgcggaatttttcttgagttctacatgtcaaaattcattaacag

SEQ ID NO: 18905 - DNA, 706 bp, Oryza sativa
acccaccaattaaaaacaatttgctttaagggatccttcattctgcacatatgcaaaagaacttctttcacaaaaagagatctctaggcttggaaggagggctgaatgctcttaaagattaaaccattcctcttcttctaaatgtgccaggctgccaaaaaagaaaacctccaggaagcccctttgagcaaacttgagtcttgctagagcaatcatctgaaagaactccaaattatgattccactcaattcctaggtgttgaccgtcacctttgacgggtcatacgggatgtcgtcatcggtgaggcatctggctgcggtctgtcacaggtatcaccttatctgtgatgggccaaaagacaaagctgtcataggtgaggcagtgacgggttttccctccaacccatcactggtatcacctcacctgtgacgggccgcgtaattataagccgtcacaggtgatgggccgccacctgtgacggatttgttttctggccagtcacaggtaggtcgatacttgtgacgggcaactcaatttaagcccgtttgaggtatgaacaacacctttcacgggctttgtgtacctaacccgtttcaggtgtgttgggcctataaatactccccaaactgccaactgctttccatctcgaccagtttactgtgcacaaatcggttgggagggtagggggggcgaatttttgctaaat

SEQ ID NO: 18906 - DNA, 1403 bp, Oryza sativa
  unsure (1)..(1403): unsure at all n locations
agataatggtatgcacttcttagtgacaaactggttcagtacaaactactaggctgtgtttagttccacactaaatttgaaagttcaaagaaattgaaacgatgtgacgaaagagtagaagtttatgtgtgtacgaaagttcaatgtgacggaaaagttagagccgaagtttagttccaaattttttcttcaaactttcaacttttccatcacatcaattttttctacacatataaacttctaattttttctacacatataaacttccaacttttccgtcacattgttccaatttcaaccaaacttttaattttaacgtgaactaaacacacacgaagtttgaagaaaaaagttagaatctaaacaatatctaagtagaaaaaattatggggttcaatacatctatagttggaggaaacaatgaccaaacacatatttgagattgtattgatgctcgaaacaataacaaaaaaaacatgtatatctctatctcttctctactattataaaaattagagttgtttttgcaaaaattttggtacgttttgagtcggttttaagttcgttgtgtttgagttggattttaagctcgtttgattttgaaaatacaaaaggagtcgtataagaaatctctttaaaaaaactcgcatactaacttgagatgaaatacggatccaagcgaatttccacaaaccatatataaaattattattattattattaaaatagcacttacccgttgcaatgcaacgcatgggtattttttgtagtttgagtaaaaaataacgaaggaggactaacagggtttgcaatactagggtttacagtactgaacgaaaatcgctccatttccatgaaatcattggggaccaatttgtgaaaaacaagcagttttagttagttgtatagaattgaccaaaagtcgtcctcggtttttaccaatttttgtaaagcagccaagaccattgaactctgagcactacaagctatgaactgtagttagtactgtaacttaaaatctgagtcgcaacgactcgcactcagaatagacttcacatcgtcggctccatactcgacaaagcactaacatccatttcagaaaaagtgttgccaagatatagaaacggtgaacgaacaaatgcctgagaagggtgagtatgagtagctcattgcaccacgatacgcgtattcttagctaattaaccagtagccggcttactgatcagtataatcgtcatcatcaaggccaaggactgccaagaagtgcacatctcatgcaacaaatagaagtcctttcattcataggaagcgtagaaaagtaagaaaacaacagtttcttctacgggtgaatgaacatctttgatannnnnnnnnnnnnnnnnnnnnnnnnnnnnnnnnnnnnn

SEQ ID NO: 18907 - DNA, 600 bp, Oryza sativa
caggaaaaagtgtcttcaatagaatatgtcaagcggaacatacatgagcgtgcagcagcttccagctcaagaaaagcagcaacaggtgcacttctcgacaactcaatgtcagaaagtagcttttgcatccactcctccaaagcgttccttctctgcaaacaaaacatttcaagaaccaccggtcaaaaaggctaagcacaactgaatgtagtatttgacatcgaacaaagcaaaaattaatcaatatacataacggctaacctcttctagaagcaccctgcttgaatttattcttgaaaaggcatgcttcggtggagcaggggggattccttttctgggaaattcctgcttaagctgcagtacgggagaatcttagaatgaagaaatgatattggattagaggtcgaatggaaagtaataatctttttttctcagaatcatatccaagatgagacttccaaaatgtccacattcattatagaaaccataaaatttccaaaggtgaagttctcattatgaagtcaccagccgaagatgccaaaatctgtaaaactaatttggcccaggtagcataccgtatacactaagtcaagtttataa

SEQ ID NO: 18908 - DNA, 917 bp, Oryza sativa
ccatcccatagtaatattgcaaaaccaatgcggtatttgaaagaaaacattaggacatttgcaatataggatcaatatgatcaagtgacaagcatgacttgccttgctctgctgctggaggaacctcggcgactatctcgaagtacaccggagcgtcagaggaatcggaatctagcgacatacaaagcaaacattgcaaacaggctataagactactgaaacagggaacaaaaccatttttaatggattctacacatttttcttgatttactgagacttgaatgggattaaacggagctcggatgaattagttatgaattttagaagattcactgtgtttattactataaaagaaaaaccttaaacaatttattgcgcaatattaaccagggctgacgtcagcacgggggagtgcggcgccgacaagcggggcccaccggtcagcggcacggggaggagagagggcgccgacacgcgggacctacaggtcagcgacccggggaaaaggatggggcggcggcgccacgtggcggccggaccgacggccccgatctacccaagggtaaatcggacggcggcgggagctcgcggccgggatgcgcgggcacggcgcaagccgaaccggcgaccatggcaccggcggcgcggcgctcacgcggcggcggcgcgcatgcggcagcggcgcaaggcgacggccgacggcgaccgaccggcggcggagagcggcggctagaggaggagcggcggctacgcagctaggcggtggcgcggcggctaaacggtgcgggagagagaaaacgaggaggagagcctcaccgacaacggtcgacgacggcgggcgacggaggacgatggcgacggcggaacgagcttccgagcctcctaacgaacaaaaggagaggggttagagagagaga

SEQ ID NO: 18909 - DNA, 410 bp, Oryza sativa
  unsure (1)..(410): unsure at all n locations
cggttttcgaatcccggccatctcgggcgcgggcgcgagcggaaagagagggaaaagggcgcgaagagcgcggcgcacgcgcgggcgtggtcgacgtggcccgaaaaagccgaaggcgtgggcgcggcaacggttgcgggcgcggcggcgcgccggaatcggcggaagaagggagacgggtccgacaggtgggccccacctgtcggcgaccccgagagaggaggcagcggggcggcctgggctgccggactgggcctcggcctgcggccggcccagcaaggaggagggaaggaaaaagggaaatgggccgacggcccatttgacaaaaaggaggaaaaagaaaggaaaaaagaaaaagaaaaggaaaaaggattttnnnnnnnnnnnnnnnnnnnnnnnnnnnnnnnnnn

SEQ ID NO: 18910 - DNA, 1208 bp, Oryza sativa
  unsure (1)..(1208): unsure at all n locations
ccaatatggccatcggagagcatctaaagctaaagctatacacacaccaaaatgatctttgcgaacatcagcgagtctcttcatctcttgctatctttcttttaatttatttacctggcggggtttcgatgcggtccttgatgatcttctcaccggatctgccttctcgcccttgctactggtgctaactttgtttggttcagcagtctcaccatcatcttcactatagtcactacctggtttctccttgccaccaccatttttccttgtctttctggaaagggcacctatggcatctctcttttgctttcccctggcaaccctagaagttgctcctcgcttctttgtattcaaattatcagcatcttctggatctgtgtctatttccttcgcatcatcgttctctgccacttgttctgggttagcaatgactactttgctagattgcattccagtcagcttctgcagttgtggcacgtatgctgtagtctaaatagtgagagtacaaatcagagggtagatgcatgaatgttcgtagcactagaaagtgtagtagtactgaagcagataagagcttaccctgccaccagctgttatgaactcaattttctgtcctgcaagacatttaaagtagtgggtaataattaacatgttcgattatacaccatcatatatcagcaaaactacaagcgaacgctttgctcaattttattcaagacaataacgagttcatgataaaacttgaggacaatctcaccattgactttaccaggcttcttgccccatcggtgatgggggatccattagagtcgacatgcaggcatgcaatcagcatcaacttcaacagcatatttcacaacctgaaatatgctttatttcaggcataagttctccgtgattgtacatcagtagaatacactaaaattatttaaaataatgtcaaattacacaacctcttggatgctttggtgtagtgcttcacaactctccctggatagacttgaagcaatctgtaatggatgggttctcgactgaaaaaacaacatgaattcataattaaaatttatgcatttcattcaagctctaataatatttgtattaatacctggtaaagcacctcatctgcaatccaattaccaattcctgatatgaannnnnnnnnnnnnnnnnnnnnnnnnnnnnnnnnnnnnnnnnnnnnnnnnnnnnnn

SEQ ID NO: 18911 - DNA, 758 bp, Oryza sativa
  unsure (1)..(758): unsure at all n locations
nnnnnnnnnnnnnnnnnnnnnnnnnnnnnnnnnnnnnnnnnnnnnnnnnnnnnnnnnnnnnnnaaaaattgatgagccaaaaaaaagactcagatcaaaatcaaagatcgatgagatcaataaaatcatcgccaatactaacagaatgttgagattgcggcgatgccgctgttgcttgtcggaggtcgaggccactgctcgtcggggtcgctgctgccgccgggcctaagtccgtggccatcgccgctccgctgctcgttgcacatcgacgtcgaaaacgccaccgctcccgctgctccaatgcctcgtcgacgtcgaagacgccgcacccgctgctcgccgacgacgacgccactcctgctgcttgccaatgacactgccgctcccactggtcgtccatgccgaggccatcacacctgctattcaccaaggacatcgtcgctctcgttttgaggacgatccgatgaggcctgcatgaaggagagatgagagaaggagaaacgatggaagagatgtggatagtaggagatggattcggatcctgtgacgtgcaagagcaacgtcagaggcgtgcagttcctcgcagggttttaaatctcccgctatagctgccgctatctcccgctatagttgtttgaaaagggttctaactattcgctctcatgtacaatttaacagctatagcttcatttagcccgctatagcttgttaagaagctaaccgctaaatggcttagcccgctatttaaaacattggtt

SEQ ID NO: 18912 - DNA, 1165 bp, Oryza sativa
tcccgcgcggatctggcggcgggcttgagtgggaggccagcggcggctctcccctgccatcccacgcgctcatctggtgacgggctcgagcggaaggccagcggcagctctcccccgcccgtatccggcggcaggcgcgggatccggcctccacatgcgcggatccgctggcagcgacgacgggaggtgcggatccaccggcgacgatggtggcagcgaccggctagggttagggttaggtttttgtgttttggaattttttttttcgattttccattttcgtgagaaaaacttaagcgcccgcactcgaaaattcgattttcgtgtgcggatgcacgtaaaattgcgattttcgtagaccctttagtatgtgcagcagtgcgggtagccagccatgtcgcacgcgaaaaccccttatgggtcatctgaaaaaaaatcatttcttactagtggaagccagaagacaaatacgtatataggacgatactattactagtacgtctaggtgatctgcatgtatcgcgtgatgaactgacgatggtgatggtgatgcatgcaccatcgatcgtcggtgttgtttcttcggccgttcttgtgcgcatgcttcactgcatccggcgcacgacgatgcagggcgaaagtacagtacgtgtactatcatggagtactatacctcgcaagaaccgatcgacaatgggtcgcccgctgcgtcagtcggcgtgcgccgcagcgcccacagactagctagcagtcacgagccggcgatcgatcgatcgagcatcgcaacggagtgcaatgcattatgcatgcatgtggcagatgtactgttcgaccataccgacaggtctctgtactcaacagccagcaagtctgccaagtcccaacgtactatacgtactgttcgaccaccaaaaatggttgtaattttctttaaaaaaatgtcattgtagagtataatggcatcgtctatcactccaccaaaaaagaacatccttcgcctctagctcgcctacctccgccataaaccttcgcctcatatatgaatgtcgtcatattttaagaatttttcataaccatttaacggacgaggagacatagggcttgttcatattgatgtcattttcaaccataccattttttttataaagttgccaaaataatatac

SEQ ID NO: 18913 - DNA, 657 bp, Oryza sativa
  unsure (1)..(657): unsure at all n locations
acgacgacgacgatctggacccgacgatgacgacagtgcaggcaccgaaatctgcgtcggcggaagtcgccggcgcttcggcccagcgggaggaggcgagctcggcattgagagaggaggcgagccggcgacgagagagtaggcgagccggcgacgaccggatctggtgggcgccggcgagagagggtgagcggcggcggccggggagagaggaggcaaggcggtggcgggagagataggaagtgcggcggtggggttgccggcgagagaggaggcgaggggctgccgacgaagacctttggcgaggggcggccggcgatttcgagaagaattttttttcctttttctcctttcccttttatttatttctgtttttttatttctatctagatttttttagtagattgatatttgaataaattgcacctacggtacaataacttggcaggtgggtgcgatatagtataagaacttgagaattgaacgtccgaatgcaacaacttgacatgtgagtgtgttctagtacaagaacttaacaatttaatattttgatgtatcaacttggctaaacatatgctaggtgagcttttttttannnnnnnnnnnnnnnnnnnnnnnnnnnnnnnnnnnnnnnnnnnnnnnnnnnnnnnnnnnnnn

SEQ ID NO: 18914 - DNA, 782 bp, Oryza sativa
attataattctgttgcattgtactgtttagatttctaccactattttgaatgatagatgttacatgacaacatattatttttcttgacaaaggaacctgaagaactctttgagactatctcacaagctctgcagtcatcagttgatcgtgattgcctcagtggttggggaggctttgttctgcttgtgtaagttcacttcactaattcaagattggatgagtggcttcatttttcttctgttaaacagcttttgaattaaaatacgttatgcaccattattttatctaccgttctgcaataaattggtagaagttcatcagtaatgatttttttcccaatcaaatataattggagctcaaagtcctaccgcattccgcattttagttgtttcagcacttcatttgagcatcaatacgtttcttttacataatcttcttttgggttttcaggacaccaaccgaagtaaaagagtgtgtgatcaagggcaggatggactaaatttatcattgcgaagagttcttggaaccatttctgatgcctgctgttcctggtctctcagcattactatccgtgttgtatgtggattccgagggaaccttgtaatatcaaagatgttcattcacccgtagaagaaactgttgttttcttacttttctacgcttcctatgaatgaaaggacttctatttgttgcatgagatgtgcacttcttggcagtccttggccttgatgatgacgattatactgatcagtaagccggctactggttaattagctaagaat

SEQ ID NO: 18915 - DNA, 686 bp, Oryza sativa
  unsure (1)..(686): unsure at all n locations
ccatggagagccaatcgggtaagcactaaaggttccaaaaaaaaaagtcacaaattttcaaaggacgagcatccaatctggctgccgaggcaaagaacaaatttccgttcgtccgtctgtttccatgtcccgagcaagttgtgtgaaccgtgtgcatagttcgttgtgtccaactcggttccatcaatgaaaaaaaattgatgagccaaaaaaaagactcagatcaaaatcaaagatcgatgagatcaataaaatcatcgccaatactaacagaatgttgagattgcggcgatgccgctgttgcttgtcggaggtcgaggccactgctcgtcggggtcgctgctgccgccgggcctaagtccgtggccatcgacgcttcgctggtcgttgcacatcgacgtcgaaaacgccaccgctaccgctgctccaatgcctcgtcgacgtcgaagacgccgcacccgctgttcgccgacgacgacgccactcctgctgcttgccaatgacactgacgctcccactggtcgtccatgccgaggccatcacacctgctatttcaccaaggacatacgtcgctctcgttttgaggacgatccgatgaggcctgcattgaaggagagatgagagaaggagaaacgatggaagagatgtggatagtaggagatggattcngatcctgtgacgtgcaa

SEQ ID NO: 18916 - DNA, 756 bp, Oryza sativa
gtgcattgcatcacacaggtagtcagacttcagatactttaaaacatactgttattataaatcttgacttagtgtatacggtatgcttacctgggccaaattagtttttacagatttttgcatcttccgctggtgacttcataatgaggacttcaccttttgcaattttatggtttctataatgaatgtggacattttggaagtctcatcttggatatgattctgagaaaaaaagattattactttccattcgacctctaatccaatatcatttcttcattctaagattctcccgtactgcagcttaagcaggaatttcccagaaaaggaatcccccctgctccaccgaagcatgccttttcaagaataaattcaagcagggtgcttctagaagaggttagccggtatgtatattgattaatttttgctttgttcgatgtcaaatactacattcagttgtgcttagcctttttgaccggtggttcttgaaatgttttgtttgcagagaaaggaacgctttggaggagtggatgcaaaagctactttctgacattgagttgtcgagaagtgcacctgttgctgcttttcttgagctggaagctgctgcacgctcatgtatgttccgcttgacatattctattgaagacactttttcctgatgtgcattgatccatatattaactaaaaattcttaacatttttagcaaatgttaattacgctattttctgaatgaaagataccaagattggaatcag

SEQ ID NO: 18917 - DNA, 354 bp, Oryza sativa
cctcatcttagcccgcccaaattagtcaccggtgatcacacgcagaccaggaaaatttacccatgaatcatcgtcgccacacctcaacatgcacgcacccacctcacctcacctcccccaaacacgggatcccaataacaaactgctcagtttccgcctcaaaaaatgataccagtatccatctaccacatcctccttcaaaattcgacaagaggagaaaagaaaaggacggacctggggatccatgcccgggaacaaggaggagaggtggtggaggtgggcctcccggcggcggtgaggggagcggcaggacctcttggccggatggtggtgggagtgaggagagggagggga

SEQ ID NO: 18918 - DNA, 701 bp, Oryza sativa
  unsure (1)..(701): unsure at all n locations
ttatatatgtttgcaacacttgaaattttcttaaacgctttatttatggattcagggtacttactccgatcgttgatctgatgctttctctggatacctccaggtcaccttctctctggatcctgagaagcacgtcgagcaagtcctcgtcgtcttccgggacgctctgctctcttggtgctcctcgatgatggcgtccaggtaggccgtcattctctcgcggtgccgtttcatccggcgaggcattgtgctgaggagcacggcgaggcgcgatgacgggtacaggttcggcaagctctgctcgccgaacagcttgatcccgcgctccaccatcgccaagaacgtgtccctgtccttgagccgccgcccgatcatggcgcgcgccgacgagtcggcggcgtaggccgacatcagctcgctgaggttcaccgtcgtctgcgccggcgncgacgccaccgcccggagcattcggccagccttcttctcgcggacggaccggaaggaatggacgcgcctggcgctgagaagctcggcggtgcagatcttgcggagctggctccacgtctcgccgtagggcgcgaagatgaccccctcggatccctccgggaagaccacccggatcattccgttgacggggcgcgccgcgaaagcgacgttgctcgtcctcatgaccttgcgcgccgcgttcgcggaggaggcga

SEQ ID NO: 18919 - DNA, 4124 bp, Oryza sativa
cttttgagaaggttcaagatggagaattgcaagccaatttcaacacctattggttctacagctgtgttggatcctgatgaagatggtgaagctgttgatcaaaaagagtatagaagtatgattggatctttgttgtttctaactgcttctaggccagacatacaatttgttgtgtgtttgtgtgcacgctttcaagcttctaggccagacatacatcgtcaagtggtcaagcgaataatgaggtatttgaatcatacacttgagtttggaatttggtattctacttcatcttctatatgcttaagtagatattcagatgctgattttggaggttgtagaattgataggaaaagtactagtggaatatgtcattttcttggtacatcattgattgcatggtcttctaggaaacaatctagtgttgctcaatcaactactgaatctgaatatgttgctgctgctagttgttgttcacagattctttggcttttatctactttgaaagattatggtcttacttttgagaaagtacctctcttttgtgataatactagtgctatcaatattgctaagaatcctgttcaacactcacgtacaaagcacattgatattcgttttcactttttgagggatcatgttgagaagagagatgttgaattgcagtttttggataccaagttgcaaattgctgatattttccataaacctttggatcataatcgctttgcttttcttcgttgtgaattgggaataattcatccttttggcatggtttgagggggagtttgtatctcatggttttatcaagcaataatatgacaatgagaaaaaattgagaaaagagaactttgtttatacatatggtattttcttgcgcatgctagcaatactttgaaggtttatttgtctctagcatagcttgtatgtattctagtcttttcatgagatttagattttgcttttaagggagatgatgcatgacacttaaattctatacttgaattaagaaaatatgcaatgttgatgctagcatgtggtttgatttataaatgctctatatatatatgctttattgaattgttattcctcaaatagctttaattgctcattgtgaaaaagagaataaaaaatatgaaaaaaatgaataccgaatccttggaaacagtcttgacgacaaggacgtattcgatgtgagcaaaataatgggtgccgaatccctagaaacagtcttgacgacagggacgtacccggaataaaagagaaaaatatgagaaaaaaggctcaagaaaagaaaaagttaaaaaattctcttggttattttgtgctaaaggttatttgagaaagagtgataaatgtaataggtatatgtgtttagtgtttattcttcaacctatgtgcttgttcagatgttgcattataaatcgtatgaaatcatgaatttcgattgttgattcaagcttaattgtaaaatctttggtttatggttatactttaatacatgcttgttatcttatagataggtttatcttctttttattgcaacaaatgacttgatatattatatgtatgctaagctcttgaacattaatgaacataattcctatgttggatgaaatcattgtcaaaagggggagaagtattgtgaaaatttttggatttttgggagaagcaaggtgaattttcggagttgttgagaagagcatgtttttgttcaattgggaatttctttcttttaaaaagggggagaagttttcttttggatttttgagcacgatgtgtacgtttgtacgacgtgtgctttttaccacttttgtttttatttttccaaacaccaaaacatttttgataggtatgccaatgtgttcatcaaaggggagattgtaaaaccaaatgtgtttttgattattattctatgatgaacaattggcattggagattattggttttgttatttagaatttattcacgaagtggttttggagatgattggattcataggtgatcgcaggtttatcattttatgtgaccggtcagaccgggctgtgtatgccggtcagaccggcggtgatcgagcggtcggaccggccagcccacggtctgattggccgacgctgtgtcggtttcggtttcgagttgtttgtttggatatccgtgattgtttcatgattatggcttctagatggatactatacgtatgcaatactgttgtttgctactaatgagtcaagttggagatagcttggtctcggaatatggtttctttgtttatttcatgtgtaggtgactcgatgtctcgggagagtatttgcggtgatggaccgggagtcggcttggggataagacgacgtccgtggtggtcagagatcatgtgggatactaaggctagagttgatgcacgtggttgatggagattccatatggcataggatggaggtattgtgtgcgtatgggatgtggagtcaaatttggaaggagtccaaatttggtacgattggttatgtaaagtttctttcttgtactagagggtttcctaaggtgtttaggactcttagtatgagtttggttcgtggctttaggctgcctacctcgggtataaatagagggggagcgtgaggcttcccgatatcgcttttcagagcaattgagttgagttttgagttagggtttcgagtttagtcgaaatttttgtaaggagtgctgttggtgcactttgtaaacacagagagaatcaataaagtcgtcatccactttaagaattcttcgatttgtgtttcactgggtttcggcggtctaaccggcggcacaccagtggtcagaccggcggcatcgcggtggtcagaccggcgggtgacctgcggtcagaccggtggcggcatcaggcgcggcagggattccagggctgtccaaccggaagatctacaccggtcagaccggcgactacgcttcggtcagatcggctaatctactccggtcagaccgatctcatcgaaattgagggtaacttttatttctgctagaagttttcagtttttgggtataccaaccattcacccctcctttggttggcttagttcttgtgattcgatcctacacagagtcctactcggacaccacaagatttacttagatagtatctgcacttgtttatgtggttctgcttagacaaggggtcatctaagagtataaatagaacacccctaggaatagagggtacaaatcttgaccaaggcgatcacaaaaccaacatgagccacaaaagccaacaagacaatacaagtcgactccaatctggccaagttcctgttcaagaaagccgacaatagctaaccgttgatcacctgctcgagctttacgccactattctgacatagactagattatggtctcctatacgtcattgcacttgtaagatattgacatataatggtaataccggcttcgatcaataagagtaggctattacctatcagcagggtgtcttagcctatataaaaaccttgtctccgttgcttttaccgtagtctcgcatataccttagtatcagtacactattcaagaaatttatacaaatatcagttattttgttatgacatgttttattattaaaaataaactttaagtatgtcttatactttagcatatttacattatttttctaataagatgaatggtcaaacattatttaaaaatcggtgacatgatctattaaaaaatagaggttgtatcttacaattaaatacataaagagattttctcccattcttgaagaggtatatgcctcttcatacttaagatatacctttacttttaccctacataaaaggaggtaccaaaattatttttacatgttggatgattggaaatgagtatacacctccggactaacaatatgagttatatatacctctctatacctcacaacaatcataataatgttgcaggtgcataatcataaacttgttttctaatcagtttaatcggtttaatttttacctctcaaattatgaataggtatatacctctttaaagatggaataaaacctcatacataaaacaaaatctcagaggcttataatttgatgagagaaatatatactccctccgtttcaaaatgtttgacaccg

SEQ ID NO: 18920 - DNA, 7109 bp, Oryza sativa
tcaacggcgtcaaacatttcgaaacggagggagtatatgacaagcgaaccatagcttgtcctatcaagttatccaatcaaataagaaattacatcaccacttttatataaaccaaacaaaaaattgaataatcccatccaacaaaagcatctatctcccatcgtatcttggcctccaatcaaatgaaaacaatcttgcccctccaaaggctccaaccaaatgagaaaagttattgactggaccatgaccagggttcatcgctttatgacataacaacatgtaaacactgaaaactaaagacaagtgtacttatttttcatctgatcattctgttttttaagatggtctcaggggcggatctatagtattagcatcggtgtcaggcaacaacgatgactttcgacaaaacttacggttaaactgcttatccatgtattattacattatagtctaggtataaatagcatgctatgacaccgatatacacattataacaccaacgaatcaattttctagattcgccactggatgatctcattatcttgtttgtacgccactcaagacagagatcggcaagtctgttattttggcgagcatgtcagttgaaactaggtccttataaattgccaccgctttacatcgaattgttagtgtcaaacaataatcttaaggcaattttaattttgaaacaatattgtttgaaaattctattgccaacgcacacccccacccacccccacacacaccatgtcgatgattgataatggcactgtcacccctctgcaacacgaatgtccagatgcaaggaggttgaagctgactttggtgcatatcgagtttttttttttgaaaacaaggaaattattataagaaacatagaacatgggttattttacaattgataggagagagtagacttctggcatgacagagtctagtagggtaagcaatatgagaaatatttggacagttaataacaggatttgaaaacagactggttctagcttctttagctaacttgtcagccaccttgttgattttccatggaatccatgccacctggaacaaattttcagctatgtctctttgaatttggctccataaaggtctgaggctccaatggcctggttcattgttgaagtctcttttcttgatcgtgtccgctattactgaattatcagttaaaaaactagtgcctgcaaagttgaagaatttggcaatctccatagctagttgcagtgccaccagttctgcctgcaaagaatattgagctacctcgcttttggctttaataaaagagatttgctgaagtatgtcaaacggtactaaatcattttcgatcgttggatctagctaggcagggtattagaccagagcaaatctcttaataaaaagagcattgtgtgtcatcggcatgtggaagaaaataccaatccctatgaaagtgttctcccaagctgcatctatataacatctattgccctccgaaatggtttccattcttcttttgttttcctcctcctgagattccacctgcaaattatgatttgtagagtatatgtatttatcatagcttctgccgcaaaacacaaaacacacttgggtcggctcctttaagatgccctgaaatttcagatcatttctggccttccaaagctaccacaagataatgaaaagatttatggatatcaattttattagtactattttttttagataaaggattataaattaacccggcctctacaccttttaggaggtgaccatttgaggaaatgtaagcaatgatgtgagccagagaaacattatcagggaaaatgtcagtagaaagatttgcttcagaaattctccacgttattctgctaaaggaacaacgaaagaaaagatggaaatatgtttcaggttgattgcacctacagcaattagctgaaatatcagaaattctgtgatttaacttttgcgctgaatgcagaactttctccgagcagtctccaagcaaaaactttaaccgtgggaggagtaagcttgtccttccagatgattttgatgatagaagtcaccaggggatttacctgttgaaagttatgaatctgatcacttttcataatctccttatatgcactcttagtattacaaattccattcttagaatgcttccaagttccaacaaagcaattcattatcattatgaatgatctggacctgcaaaattttgttcacagcttgattttcaaagattaaattaagtttctcaccatcccaggttttattatcagtccacaggtcagcaaccatggttgtgaatagggtcaagtttaatgaaatcatgaatatcagaatctagctcacaccatggttggctccaatgaatgcttctccgtggctggccagctgtatgggtgttagggtgtatggcacgaacaatacaaatcataaaaaaaaaaaagaggaaacaatattaagtcccagtggatgcccttccagtgcgtctgaattcatccgatgaaaccggtttgcagtgtgatcctcttctctttgctcattcatcgctgccttccggcttaaacttagtgtttttagtttgatttgacccaacaataaaccatgctgatgtgtcgatttttctaatatatagttaaatggacggaaacagtcaaaatcgacatctctccggaaatgattctcctttggttgagaaaattaatcatatttttcacttttattattcagtgctgacagcaataagatgctacaagaacatagaaaaatcaaattatatatatatatagaataataataataataataataaagaaaaatagtagctcttatacgaaaatgtcggttggtcattgaggaattttcatgattacctgcattcgtttggagaacaaagggagtttgtttatttcgttttccgcgtgcgtacttcccaaactactaaacggtgcgttttttgcaaacattttctatatgaaatttactttaaaaaatcatattaatccatttttaaagtttaaaatagttaatacttaattaatcatgcactaatggcttatctcgttttgcgtatcttcccaattttcttaatcccctctccctcaaacacagacaaaattttatgtagatcgtgcattctacaacttttatgtagttaagtagttagtacacactagagctcaacatgtaagaatgtcaaatcatcattccatactattttcatgatatttcaacatatatttatccatcatgtgtataatgtctaacgtaagttcatctatatatttcacacttgcatctagtttacatgaggtcaacaaccagaaccttgcgatgattgacatatatagtaataattgtataatgcttcttctgagaataacacttagtctctgcaattttcgctaaactatttgtggcagctggctttattggatatgcctatgccagtagttggttccagtattaaattgctataaaaatagtatattagcaaataattacatatatactacccggtagtcaacccttgtattcttcactactaaaaaaacattttttcatgcgatcaaaataggtttttccatgcggaggaattgcctgtctgcactagaagtatgggaaaatcaatattttcacgtgcgggcagctcaaccgcaggggaaaatcatcttccagtgcagtcaggttaagtggactgcatgggataccgcccacacgtaaaagaaaaacaaaataaaaaaaataaaaaatcctaaccctagaatcgcctgacgccgctcccggctgccataatcgcgccgtcgccgcaccctgttgctgtcgtcgtgacgccgcaccgaccgtcgtctacgcccgagaccaccaccgtcgcgccggctgccaccgccattggatccgcacgcatccgggtgggggacggccgccgccgctggatacgggcaggggccagttgccgccgccgtctgtgcccacggtagagccacacggtgcctcgttgccatccgcgcccgcgcctgctggccgccactgccgctcgtcgtcgccgtgatcgcgccaccgccgctcccgattgagcccgccgctgctggcaacgccgcgaccaaccacctttgccgctagctcctgcgggctgcctcctactcctccttgtgcgatcggtggggaggagagggaaggagaggagaggaaagggaaaagtaggagaggaaagtggaaaagtaggtgcgtagacagagagagaggggtgagagtaattgagggatttaatataagggaaaaggaggagagaagttgaaaattttgaagtgagtaggagggaaaaggaggagaggtattttcgcgggcggttcagttaagaggcccgcacgtgaaaatcgattttcgcctgtgggccttttaagggtctgcatgtgaaaatacccttatattttcgtgatggttaagaggcccgcatgcgaaaatcgattttcgtgtgcgggcctcttaagggtccacatgcgaaaatgggacgccaatttatccgtgcgaacgcaaaaacagtccgtctacaatctaaatagctcctcgtacaggaaaaatccttttttagtagtgcttatgaatggcttgaatattagggttttatgaacttaaactgtatatttaggttgtagataaatacattttaaaatttactagaaggagcataaactgtaattcaagaaatggatggcttactgaatcgtttttccttctttattattagccctctatggctctatagtatagacttccaagattgtttaggtagtacgatggatcagtttctcagcgaaatctgtctatctcaggtactctcgagatcttctgcacaagctaaaaatttcacgtctacttgaattcttcaaatttgtataaattttgtttgaactactttcaaatcagttaacatgtgtctgaccaacgagatgagtctgtttagtcctttttcttttctagattatgatataaacgtaggattgaaacgcaagaactaagccaaccgaaggaggggggggtttgaatggttggcatacccaaaaacccaaactttatgcggaattaaaagttaccctcaaattcgacggatcgcggtctgaccgaagtagttgcgtcggtctggccgcctggaagctgtcggtctaaccaagattggaactctggtcggaccgccgagatcacctgccgcgcctgaagttgccgccggtctgacagccgctgaccccccagtatgaccgccgcgattccgccggtctgaccgctggtgtctcgccggttagaccgctgaacccgagaaaacacaaatcgaagaactcttaaagtagataacaactttattgtttctctctgtgtttacaagttgcaacaacagcacccctcacgaaaatctcgactaaacttgaaacactaactcaactctcaactcaatgctctcaaaaccgataccgggaagcctcacgctccctctctatttatacatgaggtaggcagcctaaaggcacgaacaaaactcctactagaagtcctaatccacctaggaaaccttctcgtacaagaaacaaactttacaaactccaatcataccaaatttggactccttccaaattcgactccgcatcccatacgcacacaataagtccatcgtatgccttatggaatattcaccaaccacgtgcattgaactctagcctaatgtagcgcccgttctgtcgtggcgcctagcgggaaaactatctcttaaaaatcctaattggaaatctgtttctttgcttggtgtctagtgtccgtgccatctcagatctcgaatccccgatctatcgtcaagttcaatcccgaatccaaatccttcccaaatcaaatccctccgcaaaagtctactttgcctccctcgggttcgatgggccgaattcctctcggcccatctctccctccctccccatctctctctctctctccccgctctgcccgtgagccgcgccaagccctcctccctctccgctctcgctgccgttcccgccgatgccgcccaaatcgccgcgccacccgggcgcgcgcgccgtggtggccgaccggccagtcgccgccgccgtcagcgcctgccgcgcctgccgcccgtgtcgttgctccgctccaaaccgcccccgccgtcatcgccgtcgtcatcgacccggcccccgccactccgcgcgttagcctccaagggacggaggcagagctcctcccccctctgtcgcgtcgcccccatcccctcctccttttccgaaagtggcaaggggcaagccccctttcttccttccttttcctttttcttcctccgccggcgtcattcccctcctccctgtcgccgatttggccgctagccggagcgccagctcactggcttgaccgtccaaagtcggttcccctctcccaaaccgacattgtcgcccatataaacccaagcttcaccccctttcctttcctctcccattcgcctccactccagtgtcgccgcctcccgtgctctattcgctattgccgttcgccgtcgtgcgtgccggaggagccggcacgagcgaggacacggaaggggactctgggcgctcgccttcttcctcttccccggcccgaggctggagagatcactcccgtgccgtcggcctctcgtcacagcgccccgcctcatctcggtagtgcattcccccgttctccctcctcgatccatctcttccccttagttttcggtagtagcatgtgtagccttcctgtagctagctggcgccgccccgaccgttgccgccgctagctgtgtgctcgccgccgtcgccgcccgtgctccatagcgcccgctcgtcgctggcctcgctcggcgtagctccgcccaatccgacgctagcaacggattcccatagccgcgtagatgctctcaccgccgggaatcggccccacgtgacctcgtcgccgtttccccttccctcgccgccggttgccgccgccgcaatccgccgccgttgagttccctccggcgaatccgagccgttggctcgtctcccctcgtcccatgcaaccccccggtgtgctcgctttcacctgtatcgccgtggttcgct

SEQ ID NO: 18921 - DNA, 16712 bp, Oryza sativa
  unsure (1)..(16712): unsure at all n locations
gtaagtccgtttgactccgttcaacttccaaaattcctcaaatctcgaaatctatctaatggcacgcttagaggtcaataatagggctttatttttcgccgtttgttgagttgtcccgtttcgcgtgtagtttcggagcccgaagacccgcagtgcgaggatttcgaggatcaagctcaagatctcgagcaaggcaagccacctttgaacatattgagcctatatttgaacttaattatattgcttgcaaaatattatgcattgaaaggattgcacttaatctgtttgcaccgtctgcaaggcagaccggtgggcctacctaacttgttgcatctgatccttccattgttaattgttatatcatgttcccttgcaaccccttagttgcgcctcggtaatcgtgcactctgtatgagtatcgacggtcgccatcaaacttaaaatctgagaaacattctgagtaaaacttgggttttacaaaagactcggaaaacccgacacctgggtcggtgcttgcgaactaaatgaatttccaaaatcgcagaccggggaacgtaccgggtgtacggttacccgctcttgcacttaaggaccgtttccttggaatttcatccgaacataagacaagtacgaccacatgggtggaatgggacacccctggctgagtaattagctaatcaggggagccttgatgctgagagacaagtggattcgccggggtggtgtcggggaggacccctgggcttcctggcacagtatggtccgggacctaacctgttgttggtctgggacccctctcgtcagcatatggtgaacctgtgtcggctttcgaaatgccttgtcatgaaagccttaaggtctctagacgtggccgtactacacgggctggatgatccgggttagtaatgtcgtgtgggtaaagtgtaccccctctgcagaggttattaaactgttcgaacagctgtgcccacggtcatgggcggatgtgaggtgatttctagcgtagttttgtttgactactgctttgtgaaatttgctgatgaggtttgggattgatgtttggaaaatctgcggctgatgggatcagccaggctcgggtggccgtttgaaagctgttggccgggtgccaaccttgatcaattcaaaagactgatacattgcacatactccgaccggacgagacgcactgtctcatccgtgtcgtttgagaagcactcacttagttgttttcagaaaagagtttaagtaaaatcaattgcaaaaacaacagcctttccttgaagcctgcattaaacacttatttcccatggcttgctgagtactcctgtactcacccttgctctatataaataatcccccccagttgctgaagaagatgaagtagatcccgctgacgaggagttcttccaggagcaagtcggctacgatgagttttagggttttggcctagttcccaagtcgcgcctgtgatgtttggtccaagtcttggcttccgcttccctcttgtaatgtagttgtgagctcgggatctgtccgcagcccaacatgactgtactcctactctataataaagagactttctgttgctcttgatattctgacttcctgtgataccagcactgtttcctgggactggtatcgattaacaggttaaattggagcgtcacgggctaattccgctcaggactagttcggggtgtgacacctaagtatcctgcatgatatctgaccatcacggacatcgccttatccccaagtcgactcccgatccatcaccggcaatactctcccgaggcatcaagtcaccaacacatgaatcaaacaaagaaaccatattccgagatcaagctatctccaacttgacttattgttagtaaacaacggtattacatatgcatagtatccatctagaagccataaacatgaaacaatcacaactatccgaacaaatcaacccgaaaccggagtcggccggtcagaccacgggctgggccgatcagaccgtgggctgagccggtctgaccactcgatcaccgctggtttgaccggcaacacatgcccgatctgaccggtcctgacaaaccagtaacacctgtatatcacctgtaactccaatcatcttcaaaactactttaccaataatctccaaatttcaaaaccaaaaatctcaaatgccaattgttcatcacagaataagaataaaaaacactttgattttacaatctaccccttgatgaacacattggcaaacccatcaaaaatgttttgttgtttggaaaaataaaaacaaatgtggtggagagcacaaaagtggtaaaaagcacacttcgtaccaaagtacacatcgtgctcaaaatcaaaaagaaaacttttctcacttttaaaaataaagaaatccccccttgaacaaaaaacatgctcttcccaaactcttctcccccttttgacaatgatttcatcatgcataggaattatgttcagtaatattcaagagcttagcatacatatagcatatcgtgtcatgtgtcgcaataaaaagaagatgaacccatcattaatatagcaagcatgcattaaagtataatcatgaaccaaagattttacaatgaagttcaaatcaacaatcataattcatgatttcgtactatttataatgcaacatcttaacaagcacataggttgaaaaataaacactatacatatccacctattgcaatcatcactctttcttgaaagagctctagcacaaaacaaccaagacaattttttaacttttatttgagcctgtttgctcattttttccctcaattatttcgggtatgtccttgtcgtcaagactgtttccaaggattcggcacccattatttttgctcacatcgaatacgttctggtcgtcaagactgtttctaaggattcggtattcattttatctctcatacatattttttattctcttgcacaatgagcaattacaaagctatttgaggaataataattcaataaagcatttataaatcaaaccatatgctagcatatatattgcatttttttaaattcaaatatagaatttaagtgtcatgcatcatctccattgaaagcaatatctaagcctcataaaaaaactaaaatacacacaagctatgctagatacaaataaaccttcatagtattgctagcatgcacaagaatataccatatgtataaaacaaagctctcttttctcaatttttcttattgtcaaattttgcttgataaaaccataatgtacaaaaactccccttcaaatcacgccaaaaggatgaactattcccaattctacacgaagaatagcaaatcgattagaatccaatggtttagtgaaaatatcagcaagttgcaactttgtatccaaaaacgtcaattcaacatctcccctctcaacatgttccctcaaaaagtgaaagcgaatatcaatgtgctttgtgtgtgagtgttgtgcaggattcttagcaatgttaatagcactagtattatcacaaaagagaggtactttctcaaaagtaagaccataatctttcaaagttgatataagccaaagaatttgagaacaacaactagcagcagcaacatattctgattcagcagttgattgaacaacactagattgtttcctagaagaccatgcaatcaatgatgtaccaagaaaatgacaagttccactagtacttttcctatcaactctacaaccagcaaaatcagcattggaatatccactgaagcatatagaagatgaagtagaataccaaattccaaactcaagtatatgattcaaatacgtcattattcgcttgaccgcttgatgatgtgaagcacgaggagaagcttgaaagcgtgcacacaaacacacaacaaattgtatatctggcctagaagcagttagatacaactaagatccaatcatacttctatactccttctgatcaacagctttaccatcttcaccaggatccaacacagctgtagaaccaattcgtgttgatattggcttgcaattctccatcttgaaccgtctcaaaagatccttcgtgtacttcgtttgatgcacaaatgtaccttgaggtgtttgcttaatttgcaatcccaaaaagtacgataactcacccatcatgctcatctcaaattccctgcgtatagtctcagcaaactccacaagcaaagcatgagttgaacaaccaaagatgatatcatccacataaatctgaacgaacagttgattatcaccatgcttaagaacaaaaagcgttttgtcaatctttcccattgaaaaacctttcgcaagcaaaaagttattaagcctatcataccatgttctaggttcttgtttcaaaccatacaaagctttagacaatttaaaaacatgattggaaaaatcaggattttcaaaacctggtggttgtttgacataaacttattactgtataaaacctaaaaccatttagaaaaacacttttcacattcatttgatacaatttaaaatcttttgaagcaacaaaagctaacaaaagtgtaattgccttaattctagcaacaggagcaaaagttttatcaaaatccaaaccctccacctgagtaaaaccttgagcaacaagtctagctttatttctcacaatcaaaccatcctcattttgtttatttttgaaaacccacttggttccaataatgtgcagggtaaccaagaaacattccatcggtagagcgtgcttcaaacttatccaaatttccagatttcaatacaaagtatttgcaaccaaaaacacgcaaatgtgaaactttgggttgacgttcaaatcgaagttcataagaagtttttccaagttttgatctcaagaaaacccgatttgaaatatagcatgtagtgtttatcgcctcagcccaaaattttctaggagttttatactcatccaacatcgttctagccatcccaaccaaaacacgatttttcctttcaacaacaccgttttgttgcagaacacgaggagaagaaaattcacgttcaagacctctttcgttgcaaaattgttcaaaagaagcatttttaaactcaccaccattatcacttcgaattcttttcaaagaactaggaaattcaagatccaatcaaagaaacaaaccacaaaagtgttgaaaagcctcatccttagttgccatgaagaaaacccaagaatatcaagaaaaatcatcaaccataaccaacacataccactgtcctccaacagattgcactctagctggaccaacagtatccatgtgtaatagttgtcccggtgcatccgtcatcacaaaaataataggagcatgtgaagaagtaaccatcttagcatgacgaaactgtgtacaaaccaaatcaagatctttcttaagtttaggcaaaccatgaacaagatccaaaccacttaacctcgtgagatgatcaaaaccaacatgtccaagtctacgatgctaaaacatcacatccttattaaacttagcaaccaaatatgttatcacaggtgaaacaggattttcaaaaccagcttttgtcgaaacaataattcagcaatataaagggggtagcgcatgagacctaaaagtggatggatgcggagacaaagatttagacaggtcaggacctctcgatgagaggtaataccttactcctgtttagggatttgaattcgccgtgtgtattatagatctgacgatctagttgtgtatcatgccccctagagggcctcctgcccaccttatataggatgaggggcaggattacaagatagaaatcttaaccgatacgatatcggtttcctatatgtactttacaatattatcaaatcaggactttaggccattccataatatataaggaaacgtaatacccaagtcatgatccgttacatatttcatagatataagttatcccctataactagtcggataactatgccgtgtgggtatggggtacccataatcttcacagtagcccctgagaccttcacagtcgaaaagataatcttctttcgaactagattactccaaagccgagtgcttcaatcatcttctcatcttcgccatggtttcccgagtacttttaccaaatctaaagactgtggagagctgaaaaataactgaatgtaaacttaggtgcatcaattagattcacctaataggtgtagcccccgactatgtgattagttgaacaagctaaacatatagtcaaggagtaaataatccaaccaaccgagtggttttgataactgtagtcaatcaagtgacttgatattaatatatagcatatgcggtgtgaattcccgaataacatgatccgagtgatataccgactgctttgtaaaatatgatgcgtgcaatctaaagttgactacatcattgaaaatttacatagcaaaacagctataaagaagcttgtatattgtgaataaagaaatttctaaagtattgggcatacaccatgcgcacactgctttaacagatgtgcttaagtccctaaaagacacatgatttcaccacacttggaaatatatggcatatgtggtataaaatccgagtaaataaactcataaaggatttaccaaccacctagaaaaatgaccacaatatataatcagcctaaaccaataaaaatgttcacttacgtggcaaaaagcaacgatattgtatccaatcaattgctttaaaaacccacacagtgccttgacttatataaaaaagtcagtggggtagctatataaagaattctggagttgtcggtaatcctctcttatctcttgtactttatttattactctgatttaatagaaatatcattctgagtaattaagatttacttagtgagaattacttcttggttagttcctaattagcatacgggatcattgttcactatagtccatttatttatagtgattgctttagtgtttgatcggcactaaagtagttattaattgcgtagatgcggtgcctgggtaattaatctccagtggttgatgcatatcccacagtacgtttgaggtgggtctagaggtggtgacagccctcaagagcacttaagtcctccctgtccgggtacgtagtagagcgaaatctgagaacaacgggttgccagtgcctgaagtattgcgttaggattaaagttaagcttttcctagacacatcacttctgaccctaaagggaggtgttcggcggtggacgctagggtttgttggatgcaacctgtagctgtcgttctacgtctattatagtttttagataataaattaaaacccaggcctttacatctaaaatggatgtacagagccatcctagatatatactccctccgtactcgtaaagtaagccgtttaggacaatatttaagtcaaaccttgagaacattaaatcatgaataactcttaagttgttgagtttgaaaatttaaaattatatgaatagatttgccttgaaaaatactttcataaaaatatacatatatcacttttcaataaatattattatagaaacaagaagtcaaagttgtgttttggagaccgtgtcgctgtgcaaaacgacttcctttatgagtaaggagggagtatatatatctgagaggtcgaagatgcattctatcccttgtcccacaattaagctcattgatcagctttcgtcatcatcccactgctccccgcatgttgcccaccttgttggaaataaaccttacacgatgtatctagtagtagctagttttacgttcctttctgttgatgcatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacaagtggtatcagagctcggttcagagcgtggacgcgagatcgcgctcttgagggtgtcttcatgcctcgaggacgcacgcactccccgcgccggcggtcggcgtcaccgtccgtgcatgtttcaggttccggcggccgcgcctcgggcagcggcgggagcgaccgcgggctggtgatccaccgcgtggtcaaggaagcaggaggtgcggcgaactacccgctgttgacaagaaccaactacaacgattggtctttgctgatgaagatcaaactgcaagcccggtgcctgtggggcgccatcgatccaggcggtgtcgagcttcatgaggataggatggcgcttgacgccatttgcagcgcggtgccccccgagatgatctcgaccttggccaccaaggcctcggccaaggaggcatgggattgcatcaggatcctgcgaatcggcgacgaccgaattcgcaaagcaagcgcacagaaggtgcgcatggagtacgagtcgctcgtccttcgcgacggtgagaccgtggaggacttcgccatgcgcctgacctccaccgtcaatcaactcgcgacgctcggcgatcccgagccggcagacaaggtcgtcgagaagtacctgcgcgtcgcccgtcccaggttcacccaactcgtcctttccattgaaactctccttgatatctctacactgtccctggaggaggtgaccggcagactcaaggcaggtgaggacgccatgccattgccatcttcgtcctcagacaacgccggcaagctctacctcaccgaggaagaatggctagagcgccacaagaaaaaggagcaggaggcaaagaagaactcaggcagcccaagcaaccgtggcaagcggcgaggcggcaaaggccgcaacggcggcggcgctgaagtcggcggcgcggagaatacgaactccggagcggcccgtcgtgaagacaaatgccgcaactgtggcaaatacggccactgggccaaggattgcaggagcaagcccaagcgggatgaacaggtccacgtggcccaagacgacgagcccaccttgcttctcctcacaggaggagtaatcacacatgcacgtgaacaggagcatgcaccagcgccgtctgcgccaactccgtcatccgatcccatctacctggaggaaaagaagctgttcgcggcgctcgacgacgccgcggagcgtgatccgggcagctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctcgccaacacctacctcattccacgcctcgctgctaacatcattagtgtcgggcagctagacgagaccggtttcaaggtggaggccgaggatggcgttatgcggatatgggatgagcagcggcgcctgcttgcccgtattcaccgcaatcctggacgtctctacgtcctcgacgtcgagctcgcgcgcccggtctgccttacggcacgcatcggcgacgaagcatggaagtggcatgcacggttcggccacattaacttcactgcgctgcggaaaatggccagagagcagctggtgcgcggtcttccggctgtgtcgcaagttgaccagctttgcgaggcttgcctcgccggcaagcaccgtcggacgccgttcccacagcaggctcaacagcgctccctggagccgctccaactactccacggcgacctctgcggcccgatctcgccaccaactccgaccggcaaccggtactttctccttctcgtcgatgattacagccgtttcatgtggttgtcgctgctcccctccaaggatggggtggcggcagccatcaagcgcatccaagccgcggctgaacgcaagagcggcaagaagctacatgctcttcgcacggataggggggagagttcctggtccaccacttcgcggattactgcgccgagctgggagtccgacgcgagacgacggcgccctactcgccgcaacaaaacggcgtcatggaatgtcgcaaccaatcggtggtcgggacggcgcggagcatgctcaaagccaaagggctgccaggtatgttttggggggaggcagtcaccacagctgtttatctcctgaacaggtcgtcatccaaaagtattggtgggaagacaccatacgagctgtggaacagatcgccgccggccgtccaccacctgcggacgttcgggtgtttggcacacgtcaagaccaccacgccgaatgtcaagaagctcgacgacaggagtaagcccatgatctttgtgggttatgagccggggtcgaaggcgtatcgctgctacgaccctgcctctcggcgcgtgcacatctcacgtgacgtcgcattcgacgaagaggcgcaatggaggtgggacggcgagacggcgagtgagctggacttcaccatcgagtacaccactgtgtaccacccagctgtggcgaacgtgccacgagctgactcggagcagccggagctaccgactccgcccgcgacatcgacaagtccatgcacacctgccgccacggcgggcacaactgcgacatcggcggaattcgcgactccaccaaccatcgccgcggacgacctcgacgccgatcatgatgatgctccgcttcggttccgccgcgtcgacgagatattaggaccggcgaccccgccgggactggctgtgcgcgagttcgatgacgaactcatgatggcaagtgctgaagagccagcgtctctcgccgaggcgcaacagcaagactgttggcgtcaagctatgctggatgagatgaaatcaattgaagaaaacggaacctggctgctcgtcgatcccccacctcgccagcggcccataggactcaagtgggtcttcaagacgaagaaagacgccgccggcaacatcaccaagcacaaagcgcggctcgtcgcaaaaggatacgtgcagcggcagggaatcgactacgacgaagtgttcgccccagttgcacggctcgagtcggttcgtttgctgctggcgtacgcggcgagcgaaggttgggccgtccatcatatggacgtgaaatcagcgttcctcaacggcgagctcaaggaggaagtctacgtcgcgcagccgcccggtttcgtcgtcgacggcaaggaacagaaggtgctgcgcctggtgaaggcgttgtatggacttcgtcaagccccgcgtgcgtggtacaccaagctcgacgcgtcgctgctgtcacttgggttccatcgcagtgcctcagagcacgctgtgtacatgcgcggagctaacgcacgtcgactggtggtcggggtgtacgtcgacgaccttgtcatcaccggcggcaaccactccgagcttgatcaattcaagaaggagatgcgggagacgttccagatgagcgacctcgggctacttcggtactatcttggcctggaggtgagtcagaccgacgagggcatcaccctgagccagggtgcgtgcgcaaagaagatacttgaggcagcaggcatggttggatgcaacccgagccagactccaatggagccacgcctcaaactcagtaagttgagcacatctccttgcgtggatgcaactgattacaggaaaattgttgggtcgctgcgctatttggtgaactcgagaccggacttggcgttctcagtgggttatgtgagtagattcatggagaaacccactaccgagcatctggcagccgtgaaacgtgtgctgcgctatgtcgccggcaccatcaatcgcggctgcagctaccggaggaagaaaggagctgttcatcttgttggattcagtgacagcgatctcgccggcgacgtcgacacgcggaaaagcaccaccggtgtcttcttcttcctcggtgacaacttgattacctggcaatctcagaagcagaaggttgttgccttatcgtcctgtgaagcggagtacattgcggcgacaacagctgcttgccagggtgtgtggctggcgcgtcttcttgccgagctcaagggagaagaagccgacgccgtcacactcaatgtcgacaatcagtcggcaattcaactcagcaaaaaccctgttttccacgatcgcagctagcatatagagaccagatatcactacatcagagaatgcattgaggaggacagggtgaagatcgagttcgtcagtacaaacgatcaactggcggacattctgacgaagtcacttgggcgtgatcggttcaataaactgtgcacaaggattggcctcgtcgaagttaaagggacgtgcaaggtttagggggagatttgttggaaataaaccttacacgatgtatctagtagtagctagttttacgttcctttctgttgctgcatgcatgttagtttttctgttgttgcatgcgcgagctccgggttgtggatgcccatgcatgttagtttttctgttgttgcatgcgcgagctccgggttgtggatgccgtgcacgtagtggctgtcaacgagattaactcgcgactggcctggacaacgggacgtgaacgcgtctctcggatcgcggggatggacgcgaaagaaccgggacgtgggatcgaatcctaagtctgttatttgcataataaaaggagaagaaaaaaaaccgaaaaggtgaagcttcatcgcaccacaaaactcagcgtgtttcctcgtgttcgcgtgtgtttttccacagcttgtttgtcgatcacttagggaaacctgacacacctgaatcaacaagttctgtccccagcaaaaactcattcctgcccggccgtgtcgtaccggcaaggcgcgtcaagtctcgctgctcagcggtatatatatgccctggcaaattcgatcggttccagcgacaccattctctagaaggctaatagcatagtacagcatatataccgatatatctgcagcttttgttgagttttcttctgctctgtggtgacttctgaccctgatctgtcatctcctctttatacagatcactttcaggtttgtgtgctatatgcctactatatccctccggcttaaggctctgtcttgcgtgcttgtggcttaagcaagcttaattatgtccctgtatatgattcgtacatgtattctgtatcagctagcaacagattcatgtttctgttcctaatggaaaataattttcgggtttgttgttgccctcaaaacagacagagttttaagagatggagggagctctagtgagcacagcaaccggggccttgaagcccgtccttgcgaagctagccgctctgcttggtgataagtacacgatcttcaaggggctgcacaaggagatcaagtctctctctaccgaactcatggccatccatgcgttccttctcaatatgtcagaggaggagaatcctgatgcccaagaccaggcttggatgacggaagtaagggagctatcctacgacatggaggacattattgacgagttcatggtccatgttgatgatgaatctgccactccagatgggttcatcagtaagtgtaagaaatcgctcgcaaatatgaagactaaacgtcgaattgccaaggcaatagaagatttcaagagccaaatcaacattgtcggagaaaggcatgcaaggtatagatcagagaagaccatctgcaggaccagcaatacaatcattgaccacagggctctctctatctttgagcatgcttcaaatcttgtaggtattgaagggccgaaaaatgaagtaatcaaattattgtccgatgatgatggctgtgagtcaaagcaacaacatccaaaggttgtctcggttgttggttttggaggacttggtaaaactactcttgcataccaagtataccaacagctcaagggaaatttttcctgttcggttttcgtatcagtatcacgaaatccagacatgatgagaattctgagaactattttaagtgaggtgacacaacgtgattatgctgtgactgaagctggagatgaacaacaacttattattaaaatttccaattttctttcaaaaaaaaggtaatagtgtggtccctagataaatattcttttacatttccctcaaaaaaaatattcttttacatgaaaacgttggcacaattgaatttgtaatttttatttacatatgatctaatttagctatgcatgtttatagaatgatgtatgacgacataatatacgttgccaatatatagtttgtacagtatttagttattcggatgccatgcgaacgagaggggtatgtgctcaaatgacatgcatgctacctccgttcggaaaaagatgttattgcgcagaccaatgaaattgtgttagatgcagcaaaaattgccagtttgcccctaattaagcattattattagctccaatcacctacttttcgtcttggattgctacaaagaaccatgcgtttagctgtgtgccaactggaaattttcacctagaaaaccgaaaacgatatatctatttgagaacggagataatattccttatatagatatttatttcttataaattgattttggtcactatggatgttataaaattgaacacgtggattacaacttatggtcattttaattcttattattagttaattatatctcttgagttgctagctttccaaaaattaagtgcatgcacatacacttagagaacttttacaatacaatataatggaagtatttactatagctagtagtgtactatatcaggactagatcattatggtaaattatgtttgttgctaatctgtctctaattgcctagatatactctctccgtactcctgtactcctaaaggaagtctgtcacttttcaatatatgaaaagatttgtcttgaaaaatacttttataaaagtatacatatatcacttttcaataaatatttttgtagaaacaaaaaagtaaaagttgtgttttggagaccgtgttgctgcccaaaacgacttcctttacgagtatcgagggagtacaattttaattggttagaaaaattactcaataccatttgatcatttatactagcggtatatatatattggcagtacattataatggaggggatttggcctaaaataatttctttacacgtttaagtgaaaattgatagccaaatgcttcttttttttcgttcagagtagtatatattttccttaatctgttctaggcctaaagagaaatcctagctagaaagttcgatatatctaaatttaggagggaaaacattaaactaagtttaggaatagcatccatggtatatgccgtgttatccgaaagttttgttggacctaaatctatgctaatatatatcacccctaatatttatgcaggtactttgttgtaattgatgacatatggaacgtggaaatatggaacattattaaaggtgcattctccatgaacagtcgctgcagtaaaattatcaccactactcgcataagtgatgtcgctagatcgtgttgttcttcatttcgtggtcatttgtataatatacggccccttgataccgtgcactcaagaacgttatttcatagaaggctattcaaccctcaggaaaaatgtccatcacaccttgaagaagtttctgaccaaatattgaaaaaatgtgacggcttacctctggcaatcatagccatatctggtttattggccaacaaactaaggacaaaggatcaatgggaacatgtgaaaaattcaattggttgtgcacttgaaagaaatcctacggttgagggaatgataagtattttatcattgagttactttgatcttcctcctcatctaaaaacttgtcttttgtatctaagtatatttccagaagactatgtaattaggaagaatgacttgatactgagatggattgctgagggattcattcataaagaggacagtaataccttgtatgaatcaggagaaatgtgtttcaatgaactagtcaacaggaatttgctacaacttgagaagcaaaactacaatggatgtcgagttcatgacacggttcttgattttatcatctcgatgtccaagaaaaataactttgttactttagtgacttctccttgtctaactattgagggacagaacaagatccgtcggctctcccttcaagttggcagcgaggaaggaaattcaatccaacgaacaatgttgtctcatgctcgatctcttgatgtgttttggctgcatctacaggagatcccttctctagtggagtttcggcacttgcgtgttctgagctttcaaggttgcaggtggttgcagagccagcatcttgcaaatataggaaagttgtttcagctaagattcctgaacctcaggaaaacaggtctaaatgaactgccagaagaaatcggatttctgcagaacttgcaggcgctgaacttagaaggcagcaatatgcatcgactaccaccacatattacaaggctgggaaatttggtacatctatttactgacattcggattcaannnnnnnnnnnnnnnnnnnnnnnnnnnnnnnnnnnnnnnnnnnnnnnnnnnnnnnnnnnnnnnnnnnn

SEQ ID NO: 18922 - DNA, 10242 bp, Oryza sativa
  unsure (1)..(10242): unsure at all n locations
tttctgcagaacttgcaggcgctgaacttagaaggcagcaatatgcatcgactaccaccacatattacaaggctgggaaatttggtacatctatttactgacattcggattcaactcccggaaggtattgcgaagatgcggtcactagagacattaaaatgggttgacctatccaaccattcatctaacattgtaaaagaacttggccagctagagaatttgagggaactggaggtgtttatgcccaacgatgatatatgcgatgagcacgtgaaggttattggctcttgtctaggtgaattaagtagacataacctccgtcgtctatatatcgtgggttataccgaattgcctaacagcctcttaccagatccgtggtgcccttcaccacttaaactcgaagaacttgacatctctgactcacctatggtacaggttccgagttggatgcgctcattcgtccagcttaaaaggttaggccttattctaaaggatgtcagtgatgaagatctaaccaccctcggtcgcctaccttctctgctacatcttcatctcaatataccaagaggagaaccagggtacgaggataggctcctcatcagtggctgccatggattctcatgcttgaggcagttttatctcacgggtcagcagccaatttttacagcgggatctatgccaaggctagagctactcagagttgaaatggatgaatctaagccagagtttctaactaatgcttctcttgaaaacctcccctgcctcaccactgtgaaatgtttgcttttcaactttcaacgtggtgaggtggctcaaaatgggaagactgccatggcgagagcaatgagttctcatccgaaccaccctagccttgtgtatgagtagagctggcggtctttcatattatatatcgagctatatatttgatgcacaaccaccaaggaacagccagctggtaactgctaaccacttaattctctcaaacaacacatgattaatgcccagaatttgatcacctctttacactatcagatgatacaattattgtactgatgatggccttggggcacggtttcacgcaatctgcagtgacaaggttgcttatttactagcgtacttagttggtcatcctaaactcgatatcttttacagtgtttgcgaggtacttaaagatattaagagatagaacaatgtaaaccattgatcaagagaggggcaaggtacggaataaaagttaatgtaaccgatagcaacgaagtaaataactagtaaaatatgggtattttgggttaatcaaatacctagctgaattgatccgtattgtttggtagaaaaagttgtaaatcttacgaggcattttgtctccgatacattttgtatcattcggtcgaaaatgtaaatcttcccataaattttatctcctaaataagttttatcattttctaatatttgaatgtatttgagagaatagctactttagtccctaaagtttttctgtaggatcagtttagtccctaaccttttaaatggtccaaaaaaatccttaacctttgtcataagacctagaatagtccttggatccaccaaaaccatcatatggatatgccatgtcatcattcatgcaaaatctataatgaattgtccaatttacccttacgtatatcatagaaaaataaatataagggtgaattagatataaccataggaaaaaatactttttttcaccattttgaggtatatttttgctcttgcatataccatatatttttttaacattttccttttgttttttattttcctatgcgtaagggtaaattagacaaatcatatagattttgcatagaaaggtgacatggcatgtccatgtggcaattttggtgggaccaaggactatattagcccacatgacaaatttaaaggacttgtttggacaatatgaaagaataagaactaaaatgacccaggatcgaaactttaggtaccatattagctattctcccaatgtatttttgtgttgtttcatgtatcacaaatttataattaagttgacatgcatgtgtctatataatgtagcgtatgtgttcatgcatgcacgatgattaagttggaaacgatgatgttcaaattagccccaaatttctagcatgcttaacaagagtaacgcaagttattagttagcaagttcaaatatttgggacgaagatgtgagaataagatcaggatcccactaattaacacagttaattactatagaattaaagagaaaacattttttcttaaaagaatttcctccattgtagcgattgcaccctaatcaacacaataataaaaaatgacacattttttttgtccaaaataacatggctgcatgatcaacaaaacatatcaatttccttcttcacttactgtcatatatgttgtactttgatattttttttaagactttgtactttgaaattatagtatctacctatgttcatgttattgagggagaatatgcaaagatgaacaaacatgtaaatatagcgtattgacaatgaattacatatgaacctacaaaccgatgatcttttactgagtttatatgttctttgtgataaaatatcaattttaaaataaccacacgaacattcggtcatattttatccgattgtgttattagacacaaaatatcgggggcgtctaatgggcgggtgatcgctcccccgtccgtccagcgatcacccgtccgcgccctcacttatacaatacactcctccctcctctctccccttcctcctccctttcttctttttctactacagtaaaccacaaaaaaaaatttaaaaaaaaagttagaaaaatttatgcatagaaataatatatataataaatttgaattcaaattcaaatttgaatcgggtatgtaaacttttgacttataaactttgggtctataaactttaggtatataaactttagatgtatagaaatactatatatagaaaatatttaaattcaaattcaaatttgaatcggatataattcaaattcaaatttaaaacgggtatgtaaacttttgacttataaactttaggtctataaactttaggtgtataaactttagatgcataaaaatactatatatagaaaatatttgaattcaaattcaaatttgaatcagatataattcaaattcaaatttaaaacaggtatgtaaacttttgacttataaactttgggtcattaaactttaggtgtataaactttagatgtatagaaatactatatataaaaaaaattgaattgaaattcaaatttgaatttgaatcgaatatataaacttttgacttataaactttggttctctaaactttagatgtgtaaacttgaggtgtataaactttagatgcataaatttactaaaataatagagtaatacggtgccaaaaaaggaaaccaggtggagggagggagggaagaggggatcgatcgctaccccatagccaaggcgatcgattgcccattagaggtttcgcaaaatatcaacttaaaaaaacatcacgatcatactcttaaaaagaaaatgtaaatctaagaaaaaaaacacgtaaattttttttaagggaaaccgaaaactttattactgaggcaggccagccaaatcgctggtcaccaaatactcaaggcccggcggagtgccggcccagctacaagggtcaagcaaattacaacccagtttcgccagttcatgcactacttgttacattccctggggcaataattaaccaagaatgaaataaatcttctagaaatgacattcttgatctccagaatcacaccccccatgacagagagattgaaagagttctcctggagtgtagacttcagcagcagcgagcctatttcaaactctaccttcattatccccctttcacttgccgcccctacagccgctgcacaagcaataatctcagaatggaatgcatccatcatgttatcagctccgccagctccagcctgaaccacccgtccatgatgatcccgaataacatatccccatccgccttgtttggtgctgctgtggaaggccccatccgagttgatgttcaggacatcagaggtgggttttctccattttgccattctcctctccttcaacttcccctctttccaattcaacttcaagaattcctctccctggttatcaatgatatacgccaagtcaattgggtctctggctttacctccttccctcacttcattcatctgcttccaccattgccacaaacaaacgacagctctcatctgtatattctctgggcacccccaaatggtctccagcacacttcttgcattaggttgttgcgctagagataatctcaggtcttccaagttcatcgcctaccaaactttcttaacaagcttgcacttgaaaagcacttgaaaaacacgtgaattttgtaatgcaggattaccgacgatcatgttcctaggaaggaaatgtaaatctttttagaacacgtaaataacggaaatgagaatcacgggtatagtagagatgaggtaccgatgcggaacctgtgtacctagaactaagaagacaattatgcccttctccatcttaaaaaaaatatccttttacacttactacctaagtacctatatcagtacttaaatatcttttaagtggtatcttttattatggaccattagatttttaccaaacaccgtaaaatctctccttcaacatatagggaatgccttggctgtactctcgagcttccgttccatgaagcggccgttgtagaacaccggcctcgtcgtcactggtgatgaggacgcctattcacccattattagttgcaggcattcattgccgctaggtaagctggccaccctaccaatgccagcactccagccggcgccaccaacgctgctacgccgccctcagcaccctccattacgtgccccttcgtccacggaatcgccgccgcccatctcaaaccccttcttgcccagatctgtcaccctccactgcttctgcagggactccaccaccaccacgccggtcaatgtggccgccctcccctggggaggtctcctaggtctcggaaacgccagatcggggctctagcagcccttaattaaggcgttgtttaggcctcgtttacttggcaaaaacttttgcctatacgtaccacatcggatatacggacacacatttaaagtattaaacgtagtctaataataataaaaaaaactatagattccgctaggaaattgcgagaggaatttattaagcacaattaattcttcattagcaaatatttactgtagcaccacattatcaaatcatggcgcaattagacttaaaagatttgtctcgtaatttacacgcaaaatgtgtaattgattttttattttgtccacatttatactccatacatatgtccaaacattcgatgtgatgggtgaaaagtttttgttttggaaactgtggccttgtttagttcgcgaaaaaaaattttaggtgttacatcagacgtttgaccggatgttggaagggtttttgacacgaataaaaaaactaagttcataacttgcctggaaaacgcgagatgaatctttttagtctaattaatctgtcattagcacatgtgggttactatagcacctatggttaatcaggtgcaattaattgcacagtttgcatggaaatcgcgagacgaatcttttgagcctaattagtctatgattaaccataagtgctacagtaacccacatgtactaatgacggattaatcacgctaaaaagattcatttcgcggtttctaggcaagttatgaaattacttttttcattcgtatccaaatacccttctaatatccggtcaaacgcccgatgtgacccccaaaaattttcttttcgcaaactaaacaaggccgtaatctagacacgacgctccttcaatccgctctgccaaccagctcgtctccgcatcccatcgagccttcaaggagaagacgcaaggaaggtgctttatctaccttgcgcatgaccatcaagtggtgactatcagggcaatagcaatgcgtcccatgtatataccgaatctcagatgccacatgggctaaggaactgtggtagtcacaagattcacaatgtagcaactccaaagtggggtccacaaaaataaagttctccttttttttctccacttttccccatctccttctccctttcctcgggaccaccgctatccttcttctcccccatctctcacgccttcccctctctctcctctcatgctcgggtggcaacctgactcagtcttctctccttacaccgtgttgggtcggccaggcggagcagcagcctgcggaaacggcgccgaggtggccgggcagagtggcagcctctgaggcaacggagctaggcggagacagcgccgatgcggccgggcggagcgccggcctctgcggcgacggagccggacggagcgccggcctctatggcgacgaagccgggcaaagaggcgacggcaaccgagtagagaggcgaccgaagcggtgacggtgcaggccggagcagcggaggggtgggctcgccggatctagcctcaggttctctctggcgcggatgcggctccctatccctacccccacctcctctctgtctctctcccgctttctccccacgggcggatgcgatttttttagcaaaagttgattttttttttgacgaggttcttggagccaatgttgatcacgtgaacccggcgaaggaatggtcaccacttccctctctcctccacgcaagcactttttctacctggacaaacattgacacatgtcacgtgcgtgcaccgtgaatggcctcagagacccaatctgatttttctcctgccatcgctcaggttattgtgcctatgaatgcactaaggccattcacagtgcatgtatgtggcgtttggtctcgatgcaccagctcggcgattcccctctacacaagcgttggtcgtaaccctgtgaagtccgcggaaccaattttgtgcactcgttcttctcacaaaatcaaggtcgcgtggcatgggggagaacggtgcagacgcattgtgaggttgtggccttacgggttcgtggctccgcgcttcccctccccatcccccgagctggcgatgaaggaagaagaagagatggcggcggaggaggaagaggaggcgacaaatctggtgcctacctacttgacgccccccgagccatgttgtcactcattgtcgtgtgtcgctccaacccaccggacccatcctcgttttctgatctatgctgctgctcgtcatcatcgcccactccaagccgcaacgacctctccttgacccctccacagcctcaatgggagcctccacgacccatccagatcgatgcgccaccgaggagagggtagaggccgcgctgccgctcgtccttgttgcccatagccatgggcgccgacgaggagagagaaaggatttggcaccgacgaggagaggggtgaagggatttagcgccagagaggggaggagagaggggagatctggcgagcttcgggcttgttttggccgcccggcgctgtcgcttcatggggaccaccgctgcaaacaaccctccgcctggctcgccgtcaccgcttctgcctttcacgagagcatgtgggttggggaaaggggaagcatcggttttggggagagagacggaaaaaggcgagaaaaatattgttttttcatggaccccagttaaggctacatagcccggtgaaacttgtggctaacattattctttggtgttcttggacctacgtgacatatgaggtctggcaaaattcgatgttgcactgctaatgccctaagcagtggtccctaggcaccacctgccgtcaccccccatctctagtgcaaccttcaccgcagagcacctggacggactggcagcgctcacttcgatgacaagctatgcccttgccaccaccacctccaagaactatgcatggaaggcaatggcacttctcggcgacacgcccaattgatgacgagtatctcagcccaacctcctacgcccttgatgaggagcactatgtgacatcctggccctattaggatatggactgtgtggctcatgagagccgtgtgctcctgtttgataccaccttgctaatgtagtgaaaagctggaaccaacttataatggtttgtccctctagtcgtatcactcctaggttaaccattttacacaaagcaaggatgaaagtatatgtgtgctatgtgtaagtgggcccacccataggatggactaggttgcgcggttccaaagggcgtgttgttacatgcttaatttttttccattttggttcgcgttaccataacatatcccattctctaattttatttattcttcaggagaatccaatgatgtgtggttttactttatggatcaacaccgtcagcccgacgtatgatggcagaagagtaactaaagctgaatgcaaacaaagtacaagagaatgaaggagcacaaagttgcagtacgtgctaaacgacgtagaagggggtagtagagaagcttaggcccgattcgttttcggccatttcttttgttatgttggtgtatgtgtcacgaatgtgttatgtttatctgtgtgttagctaatggttaactctctttttcatcgattaagttgatttgtgctaccgctgcaatatctttattctccttctattctttatccaccttctattctttttcatcgattaagttgatttgtgctacggcgacgtgaatatgtgattgtcttacgagggcaaataaattgcgacaaagctatgaaaccaaaaaagccaatgaaagtaataaaaaatatgtaaataaataatacctcattagtccaattattttaataaacaaataaatactagaactacaaaataataatgtattttccacctgagaaaaacataacatatattaaaaaattgctaacgaaattaaccaaacaaacatgtattaaaaaaataatttcggctgtacaaaggtaaagagaggacactcagattgtattgaaagcccgacagacaaaccatatatagtttgattgggattctatttttacaggatgaagaagtacacattacacaaagagcaattttacggtacatgtagagactcctagcagacataggtcgcgactacaaaagaaagtaaactaacgacagaaaacatctgtttttgtgcaacatttctaaacatatccaaggcagctatcagacatccaaacacaatcagacacatcatcatcttgctgcccatagagaattgcttcgtactgccgcgcatgtccaccttatacatggctgggccacttctctccatatttctgcatggcatcacattgccgcaactctttagtagactagtagccatcttatttgaggacattgcacttttctccatatttactgttccattttcacagttcatttgcccatcctccctgcaagtgacagcattattggaatatgatagagggcattgctcccgcgcaactctgctacctggacattatcgaattttcagcggttagattctgccgcgagagttgatcagttctttccatgcttcatcgatttacatatatggtgctacatggtgctagacaatctgcagtttttatcatgttggtttaagacaggtgctaccgcttgaatttttttccctataatatgtatagagagttgatcattgcattagtattaatatgtatagagagttgatcattgcattaagtataatatgtgcaagattaattaagtattaacttaaaaaacttgaaaataaattaatatgatttttatagctactttcatatagatttttttaaaaaaacaacacttaacagttcgtgaagagtaagctagggagtcgaagatgggaagaggtagattcaaactcaaccttaagcgtactgcccatacagttattgatttattagctaaacaacatcaatcaattcttttcatagttcatttcaaatttaagggtgtacagaaaaaaaaacaatcgaccatatgtctaggagtgaggaaagagcctgagtgagattaattattgatgtcgactgaactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 18923 - DNA, 697 bp, Oryza sativa
  unsure (1)..(697): unsure at all n locations
ccaaacaaacatgtattaaaaaaataatttcggctgtacaaaggtaaagagaggacactcagattgtattgaaagcccgacagacaaaccatatatagtttgattgggattctatttttacaggatgaagaagtacacattacacaaagagcaattttgcggtacatgtagagactcctagcagacataggtcgcgactacaaaagaaagtaaactaacgacagaaaacatctgtttttgtgcaacatttctaaacatatccaaggcagctatcagacatccaaacacaatcagacacatcatcatcttgctgcccatagagaattgcttcgtactgccgcgcatgtccaccttatacatggctgggccacttctctccatatttctgcatggcatcacattgccgcaactctttagtagactagtagccatcttatttgaggacattgcacttttctccatatttactgttccattttcacagttcatttgcccatcctccctgcaagtgacagcattattggaatatgatagagggcattgctcccgcgcaactctgctacctggacattatcgaattttcagcggttagattctgccgcgagagttgatcagttctttccatgcttcatcgatttacatnnnnnnnnnnnnnnnnnnnnnnnnnnnnnnnnnnnnnnnnnnnnnnnnnnnnnnn

SEQ ID NO: 18924 - DNA, 733 bp, Oryza sativa
gtatgtgtttagatttattaacatctatatatatgtgggtaatgctagaaaattttacattgtgaaacggagcgagtagtttcgagtatatcaggaaactaccacctagctacgcccgcacacggtagatgaagatcccgagcagagcagcacacatccgtggcgcacgatggagaggggggatgatgaggctgcggagctagcgtctctcgttaccctacgcgtgttgcacgatttgctcatggtcaatcaggatcatagtaactggccaccagccgtagccaccgcccaccgacagctactggatcgatcagtgacaaaaaaagcctgtgaagaatttcgctttgttttctcaacatttctaaaataatatattattgacagaccatataaaattctattttcaaaacggaacctcatatccacgcaatatagcaaaaggacatatagcctattaattgtagtgacttgagtagtactgacttcacatctttataggagcgaatttcagattagattgtttgagaagctaagtcccaatttaaaagattgcatatatccgatcgggtaaaaaatattcttctctaaaaaatccacgcaatataattaacatggtatttaactaatgtcacgccaacacgaatggagtgtcaacatagacgagcacctataccaaaaaaaaatccacgcaatataatcaacgtggtattcaacatgaacggggtgtcaacat

SEQ ID NO: 18925 - DNA, 724 bp, Oryza sativa
  unsure (1)..(724): unsure at all n locations
nnnnnnnnnnnnnnnnnnnnnnnnnnnnnnnnnnttatttatttacatattttttattactttcattggcttttttggtttcatagctttgtcgcaatttatttgccctcgtaagacaatcacatattcacgtcgccgtagcacaaatcaacttaatcgatgaaaaagaatagaaggtggataaagaatagaaggagaataaagatattgcagcggtagcacaaatcaacttaatcgatgaaaaagagagttaaccattagctaacacacagataaacataacacattcgtgacacatacaccaacataacaaaagaaatggccgaaaacgaatcgggcctaagcttctctactacccccttctacgtcgtttagcacgtactgcaactttgtgctccttcattctcttgtactttgtttgcattcagctttagttactcttctgccatcatacgtcgggctgacggtgttgatccataaagtaaaaccacacatcattggattctcctgaagaataaataaaattagagaatgggatatgttatggtaacgcgaaccaaaatggaaaaaaattaagcatgtaacaacacgccctttggaaccgcgcaacctagtccatcctatgggtgggcccacttacacatagcacacatatactttcatccttgctttgtgtaaaagggtaacctaggagtgatacgactagagggacaaaccattataa

SEQ ID NO: 18926 - DNA, 658 bp, Oryza sativa
tatagggcgaattcgagctcggtacccatgcatgtggttgatggagattccatatgtcatacgatggaggtattgtgtgcgtatgggatgcggagtcgaatttggaaggagtccaaatttggtaccattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgttaacacagagagaatcaataaagtcgtcatccactttaagagttcttcgatttgtgtttcaccgggtttcggcggtgtaatcggcggcacaccagcggtcaaaccggcggcattcgggcgggcagaccggtgggtgacctaccgtctgaaccggagcgacattaagcgcgacagggatttcagggctgtccaacccgtagaaacggttatctactttggtagaccgatctcatacaatttgaggtaacttttatttgcgctaaacgtatttggcctttgggtatactaaccatttacccccctttgat

SEQ ID NO: 18927 - DNA, 687 bp, Oryza sativa
  unsure (1)..(687): unsure at all n locations
cggtgaagacgtagacgcccaacaacgncggcataataggctagccgtgcaggcggagacaccagtcgacagcagacgaggcgcccggtcggtgaagacgtagatgcccaacaacggcggcataataggccggccgtgcagccggagacaccagtcggcagcgacgaaggcaagccggtcgttgaagacgtagacgctcaacaacggcagcataataggccagccgtgcaggcggagacaccagtcggtggcagacgaaggcagccggtcggtgaagacgtagatgcccaacaacggcggcataataggccagccgtgcaggcggagacaccagtcggcagcagatgaaggcagccggtcggtgaagacgtagacgcccaacaacggcggcataataggccagccgtgcaggcagaaacaccagtcggcagcggcgaaggcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatataaatataatactcgagaaaaa

SEQ ID NO: 18928 - DNA, 743 bp, Oryza sativa
  unsure (1)..(743): unsure at all n locations
nnnnnnnnnnnnnnnnnnnnnnnnnnnnnnnnnnnnnnnnnnnnnnnnnnnnnnnnnnnnnttaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgtccacataaaacacacccgcggtcacaatcaggaggtgcatattttttatgatctagcatgtatcttttattcagtggatcctttaatgaaagccagccaaaagcttttatgttagacatacatttactcttcaagattcaacagcaaaaccatccacaacttatggatgtgcacaactcatgttctcactcgcaaaaagggactagttcacagctacacatcttcaaagagaagattaattatgtacatgaacactac

SEQ ID NO: 18929 - DNA, 6119 bp, Oryza sativa
gattgacaggctagtgaattattgtcctgtctggacccacttttcgtcacttcactggcgattttttatttcaaatattaataaaacagtatttttaattaccatacaatatttattttgtgaaattgtgcgttttatcatgctaatataattcacgtgacatttgattaatgtcacttcagtttgaattaatgacgtactccctccggttccataattcctgacattttggacaaggttgatgtcaaacttttgcaactttaattatcaataactttagaactattaagtttaaaggaactagaacaacatatatagattcgtctttcaaaataatgtaagaaaagtaaacatgcatttatttattgtatatattattttaggaaaacaaaatgaaatacatattttgaagaccgtgtcattatccaaaacgtcaagaattatggaaccggagggagtagcaaattctggtcaagttggcaagaatctacctatgtagtatagcattactccctccatcccaagatgtagcaatctaggatgggtgactatgaatctggacataagtcttaggacagaggttgctacattttcggacagatgcagtattaaactaggtgaaaccctacgtggtactgtgggagtttactatatgataacaataagtaattataatgtgtaaaataacttaaacaacataagtttatataaacataagtttatataaattgatgtaatttaaatttaaatagtatatacaatgatgactcaaatataaaagtaagatggtgtggccttatgagagaataaaagaaggaagataatttagactatacatataagggctaaaaaagttgagatgatatggcttaatgagagaagaaaaggatagagataatttgaaccacggattaatcgcataagcacaattcatctgatacgacttaacgagagaaaagaaaaatataatgacctaagtgaggatgaactatacataggtatatagtgtattataaaaaaatgatggagagatatattgaaatattatgtaaattatgtgggatgatttaacattattacattttaaatctttaaaatttaataaattattaaattatagataatatagcatgtttgcatgatacttaaatgtaatacttgttagtagatgatgatgtggtatttttacactttagaaattagtgtactttaactttatatatagtatatagtaagagaggattggttgttgtccacaccagtttaattggtgtggtaacctcgtgcaacaatgctaaactttatggcgtgacgacttcgtcgtgcatgcatgcatgtatttgtagacaatgtatatgtttactagatgaataccccattgtgttgctgcggagaattaagttgcataatatatacaaataaaatataatttgattatcaaaacgaaaacaatttgatataattttgagcctgaaaataaatgagattgcatgttttatgagagaagaaagaatagacaatttagaccatagatcttttatccaaaggctagaaataattgaggtggtgtggtttaataagagaagagagaaatatcatgaactacatttagtggggatgaactatataagtatatataagtatatatatatatatgattaccttggttattctaatttgcaaagaagaaccttgctttcacataattaacaacaatttgtcataatataattatttagataactttcaatatatgtactgtttttggtaaaaatatactgatatgtctttatatatagttgagttcgatataatgctgaatgttattggtgctcgtctatgttgacaccccgttcatgttgaataccacgttgattatattgcgtggatttttttttggtataggtgctcgtctatgttgacactccattcgtgttggcgtgacattagttaaataccatgttaattatattgcgtggattttttagagaagaatattttttacccgatcggatatatgcaatcttttaaattgggacttagcttctcaaacaatctaatctgaaattcgctcctataaagatgtgaagtcagtactactcaagtcactacaattaataggctatatgtccttttgctatattgcgtggatatgaggttccgttttgaaaatagaattttatatggtctgtcaataatatattattttagaaatgttgagaaaacaaagcgaaattcttcacaggctttttttgtcactgatcgatccagtagctgtcggtgggcggtggctacggctggtggccagttactatgatcctgattgaccatgagcaaatcgtgcaacacgcgtagggtaacgagagacgctagctccgcagcctcatcatcccccctctccatcgtgcgccacggatgtgtgctgctctgctcgggatcttcatctaccgtgtgcgggcgtagctaggtggtagtttcctgatatactcgaaactactcgctccgtttcacaatgtaaaattttctagcattacctacatatatatagatgttaataaatctaaacacatacacatatctaagattcattaacatctaaatggatacagacaatgctagaaagttttatagtgtgaaacggaggaagtaccaccgattttggcccaaggacccctacctcctaaattctgtctcaagagtaagcacaagaaatgaaaagaagccagcccaagaaagagaaagagaaaacatagcagaagccctaggctgatcggctgggacgcgaccctccactccttgcacgcccgtgagagagccgcaccaccactattctctggctctcgcctctctccactcctcacctcgccgcgccgccgttttcctgtatcgatttgcagagggtagaggagggcagacgggcgacgtggcataggcaaggaacttgctccccgcccagcgcccagctggcttccccctcatggtgccatggcgcccccaccggccccctgaggccctacttgatatctctctctaccaagtcctatcatcctatgctgtctggttgtttgttgttcgatcttggagcgtgcaatggaggaaaattttgatcttggaagagtgaaacaaaacaatgtagtttagctctgagtaatctgcgttcttgggttggtacaactggagaaggttcaaattttctcaacatatagaagatcatgtcttgattaattaccgatattcttcatcgctaacaggcctagtagtccggcctgattgagatataggatgtaatctcaatcgggcctaagggagagcccgacactgatgaatgtcatcggtgatgggctataggtatatacacctctattatgtctatataagtacatctacaacgatgttaatttaggcccgattgagatggcttcattttaacggcccatgttgcctaggcatatgagcggatttgtactagtggctcattttgcttcacttgttctgtgtggagatcagattctatcaacctaatcagctgtttgagagcaacagagctgagcgggagcaccatcagcatgaccgaaaaccagctactcaccttgattaggccaaacctggttcatctaatttgtcacattggaaaatatatggatcgtctgaaataaatgttactcatgtttctttatttgtaccatattctcaacgtattactacttgtatatatcattttaggtgtttgaaaattttgatgtgtaatatgaacttgtgaagtaggactacctatcgaaaaatttctaactacaccagccactctggctcattccggttctggcagcatgctaacctagctagcttagggcaccagcaatgtacaaggagagagagagagggggggggggacattggccatcacggacgggaatggagccaacgacgggggttgcggcagcatgtgcggtcatatgtggcagcatcgacggtgatcgttggttgatctcgcggcggcaacagtgatagcagttgcgaacgcgcgcacgggcgaattcgacggcggtcctggctggatctctggcggtgtcggcgacggtcgaggttggatgcagcgtcagcgatggtggtcgcgggcagatcccgcgacggtgcgaacgagcggatccagcggcggtcgtgggcagatcttcgacggtcgcgggtggatctccggttgcggagatggcagtcgcagggggatttctagtgatatccatgcaggtgcacccatgctctctcactctcccacggcggactacttgctgcttctcctcccttacgggggcaaccaaaagatttggagagagacaaagttggagcagagaagattgaattttttattctttatgagtggtccttttgtataatgcttacttaagtaaagaatagctataaggatcatctccacatacaacgtataagtagatatcataagcataatgccctttccgattttcatattgtggatgccctaactattgagttcggtgtgcgtcgtcctcaggcgtacgtgcgtgccgctgtcgggctcgtgccgcgtcacccggtaatgtgtgacactgatgagttagccgccgaagacgtacgactcgatcgatcgacactgagcggacactctcttgtccccttgtctccttgttctctcctgcacgcggaaacaatgatgaattggatggactataatagtagccgtacaatgttttaattatagtactttgtctaatgcagcttgatacttcgtggtggtactatatatccgttttaaaatatggcaatacagtatcagatggaacatatctcactaatataaataatatggcaatacagtatcagatggaacatatctcactaatataaattttggacagaccctttgtacagattaataatactaggatgcatctcatccgatgctatattgctatattttggaccgatgtagttcaatcaaagcatgcatctaaactattttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaggccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaa

SEQ ID NO: 18930 - DNA, 13132 bp, Oryza sativa
caacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtagtggaggaagaagtggtggtgtacactcccactccgtccggaagtgaggacggtagcgggagtcgtaatccccgccaccaccgccgggactctccgacccctcctcgcgaagccccagacggcggaaggaccccaaccggttaggaggttcggccctttccctgccggctgatgggggaagggcgcgccgcgccggggtacaccgccgcctcacctacgacgacggcggcacgccccaaggcgcgctccaggccgtggaggctctcctacggcaccctcccgtcgttctagagccgaagaccccggtccagcggtggctggatgatgtggccaacttggtcgtagccgcacagcggcagctggccactaacggctggcccttaactgctggtacctcacgtacctctactgccctctcctcatcggcgaggaggagggcttgtcggtcagccatgatctcacggcgatcgacaaccccgacgtcgtcgaggccctcgaaaagccgagggcgttacgatagtctttacggggaacaggacgcccgaatcaacatcaagcgtcacagggatgagcgccgcgctccctgcgcgggggaaggcgcctccttatcaggagtgtcgcgccaccccgcgcgaggcggccggccccccacgcccccgtccggtggggctgggtgcaaggcctttgtggcgagtctccgaaacgtccggtggcccccgaagttccgccccaacctcaccgaggagggaggaggagggaggcaaagtagacttcgtgggccgagggcgtgggccgagggagagaggacagcccgaaaggaaggaggaaaggagggagggggaaacaagccaaggagagagagggagggatttgggccggtaggggcccaaaggaaggaggggaaatttaattggtttttcatttaatttaattgattaattgaattttgtgactttaaaaatttacttcttgagctccgaaaattcacgggaaatttcagagaatatattagggcacagagaatattacaaaaatatttccggccatgatttttaaggaaatttttttaattcccttaataattcacttgattaaattactttaacttttatttaacttctagaaaatgtactattaattgatttgtaatgccgaacgaaaatcggggtgttataaggacttccctaaaaaggaaaacaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaaccaaagtaatttctatagactatttattagtgaattggaacctaaggaaagggaaaactctgggtgtgacattaacctgggaactagcttcacatgagtatgtgtttagagcatttgcgatgttgtagaactctagcttattttttcatgtctcttgagatgtgtaacctggtcgccaccttcgtgtggtttgacggttgactagcacgttgagtcctagtagtcctagtaatatctcctatgctctgtacttgaggcttcgggtttcataacgtgttagctttttgatttgatagggcatcgatgaagttggatggttaccattttatttagattttatcgagaccccatccaactaaatatttcacgatgtcatttgaaataagcttacataatatttaactcggggtgttatctatatttttttaaaaaaaatataatcatttcgttgaacaaaatgaggggatgttcattcgggtgattaaaagagtttgccattgttccaagtgctatcagccatcagtatcaggaaactcaggtggtcacgtacgacacaagggtttagaatcaacattcttgccccatgcatcaccagtgaagttgcttctggcatgcctgcaagaccagtctgactgatccccttagtaacaacctaagtctgtgtggcctttaatcagtttaagaagcaaaaccaatttcaggcaagctagcatctgtcttgtgatagctaggtatgctcggcaatttacatccttaagctgtaactgtggtggtcttcgttttgtagttaattaagatttaagaacatacatcatgtagccttcacatgaagatttaagttgctgatcgaatcctacaaggcacatagagttaatttccaaatcctttttcctggcactgaaccggaagagctgctcctagctagcctcctagggctcatggaaaaaaagcgtgaaatttgcagttttgcactcgaacgacgtaagcattcaccacgctctgcacattattcctggcatttttcgtttctttatctaaggagtgtatctgtactttgcagagagtagtaatccaagaggctgtctcgttttatgtttaccactgcgttaaattgcattcgtttgaaatgctaatatgctaattaattaaaaacaaaagaacaacaaaaatatatagcgaaaaggagccgtaaggatgatagtgccgtcacgaattattgacttaaaataatcacagttgttgtatcttcgccggaccggctgaaagccggccagaatgtattaagacgcgggagcttacaattcttgtaccgtacatgtcacctcggcagtaaatatattatacaattcttatttatttcttgatatatgaatgttccatgaaaaccgtaggatactctttatgataatgttatctttaccaatttagtaaattgtgaaatctgtgcgcatcaaatatacttagggctcctttaaatcataggattgaaaaaatgtaggaacaaaaaaaaactcaggaatagtataggaaatcataggtaaaactaatggttgaaaaacatgggaaaattataggaacgatcgtttgattgatacaaaggaaaaacataggaatgttaagtattaagttaatagccatcaaaatttgaatggttttatgagggtaaacattgtctttcaatagtgttttgcctcgatcctactcataggaaaagaaaaatgagctcaaggtggatgttaattttcctatggaattcccttaaaatcatggtcataggaaattttcccatgcatttcctatattcaattcctacaaatcaaagggatgaacagtaccaaatcccataggattattgatcctatgtttttcctccattttttcctatgaatcgatggaggccttaatgtgctgaggccgtgggcgggtagcgcgctggctttgcttgcctgaatagcattgcgacgacgagcatgtgggcatgggtgcgaagcagcggcggcgagcgtggcggcgcgcagggcgtaggatgatcagatgacgctcggcccatgacatcgcgctgggatgacacgcgcgcagcgtgtgacgggcgcgcatggagcgcagctgcgctgccgtgtcgcgctttgcattggcgcgacgccgacgaagcgacgagctgcggagacgcgcgcgcgcgcggggcggcaggacagcgcgccgcgcggcgcggctccttgggaagacgtcgcgcgaggaaccaatcacagagcaggaatcatatcacaagtaaaaaaattattttcgcagagaatccttttactgcacatatgctacggtccataaggaaatctgccattgcagtaagtcaggagggacctgcatcacgaaaccaccggtggaacttacttttagaggcggtagtcgtaatccagacacctttgaaatttgtctgttttcacagtgcactaagattgttactgatattaggaagggtgtaatcctaatttattgcgtacaaagctacaaaacacttacagatgtagtaataaaggacacaagattaatcacagtatttgtaatatcataagccatatcgaattgtcagaaaatgtgcctataggtatggattatcgccaaaagtttggcagtaatttatatgcttatacaagagtcatgtcttcttgtatgtagttcttgggatgaatgtgccatgaaagccatagggtactctttgtggcaatgttatcttagcaattggtccattttcaaatctctgagcatcaatgacatgtgcctgtaaagttaaagaatcacagtttaatcattaataatatatacccgctgatgggttataagttattcttttaattttcttatcaagctttccggtttgtgagttggtgtcgtcggttgtcaaatctgacacctatgaaggattgccaatcggcatttactaggggttttgtactggtgagtagggagtaaaaatgattatatatgggaataacatgcattgtaatgtaatgtcaagaatataaagaatgttgtaattaacatgctagttcgaatatcaaaagtaattttgaattttattttatctaattttctagacagaacagtcacgatagtttagcacatataatagaagaaagatgattctagagagctcgcctgtgaagtgtttatttcctcgtcatgtacaaaggaaattatccatccatcatcttcatttgctccattgacctttggaacaaaagttgctcccgagcaaaactgatttttaccaagatgatgatactccacatttattagatctccaccaaactatctcaagagttgcaaaccatgatgttataagatatttcaaaaaagaaagcagcaagacaaagacattgttttcttatatatatatatatatatactaccttgttgttatcttgaagatgtagttttgcgaaacctccaaattttggtcgcactacataaaacgaaagtaaagttagcacatgatgaatagttgaatatatccttcttggtcagtttttttaatatacccttagatatggtagatccgacatgatatgcaatatttaggttatgcggcagaaatgttattgtacattttcattatattttccttgttgaaattttttatcctaatcagcaaataaactgtttaacttaattttgtcagttcaacttagtgctgaatatatttaagacaaatgcaatctttgctgagaaaatacctgttccacagccaccttccaggctcccttggacatcaatcacttgtgcatatgcatacttgtgatgcaggccagcatatttgttattgatcactgggaattccagagcaacatctgtcccagttaagtatttacctgtgacagccctgcttttcatgtttaatctccactcatataagcgaggaaaagatttctcactgggtccttgattagctggctcttcattagccgtgtgctcaagtgttatgccagtaattatggaacccggcactcgaaatcctctgatgacaacctaataataaaaaattaaacaacgccaaattatattttgaaagtgtttgcacatttactctacatggatttgatcttgaccaaatcattcaaacacttcagcaatttgattgtttcttcactgagtgtgacaaaaaggctcttgatttttaatgtgtattatgataaaaaaaaacataccacaaccacttgtttactgacaaaatggcctctatgatctaatcatccaattcaaataactgctaatctcttggagcatacattttagtgtagcagttcaattgtgcaacacagcttcatgtcgatagaaaaagcactatacaacaaccacttgatacgctacctcatgatcttcctcaaagcaattgatgagatgcaatgtgcaaaatggttctacatcgaaccatattactgaatctgcatctccatgacggggcatgactccaattcttgcataactttctgtttcaaaatcaatcaacctatagaatgttatataattaatatgttagaaacatggaagattgttgtctcaacaatagtatgtctaacataggtactcacggagctcctcttagaatcctagtaaggtccactgtaagaggcatatccatgataatattgtacctacatatggaagaacggattaatcatacttttgatgcaaatgtagttatcttattttgcatttccaaattgtttctacattgtattgtattgtattatgttgtattatattgtattgtattgtattgtattgtattgtattgcattgtattgtattgtatttgcagccactgtcaccaccgcctcatcaacctgctgactgctgtccatccaatgccactactgctgcgctgagttgctacttctttccaattcctctatatgttactgtgagccaatccaccaagcagagaagcacaggggaagaagaaaatgaagagaagaggagtagaggtagatagtttggagagttgtgttcaatataaggttttcggttgaaattaggctagatgtatcaattttaaatacaattcaagtttaatagtgggcgcttcaaatttaaccttttgattggtaagatgaaacaaaacattgtaatctgggattgatctatcaagaaataagttttatgttctaaataaaagttgtaggtatcagtcatatttttctaatggcacttgtttcatttattttagatcggttatttgtaagtaattgctaaaattttgctaacatggtaagaaaactggtgcagcaatccttttatttcattttgataattataaacacataactaggtcatttgcataacatgaaagttgcaggtactcttctatagatgctccagatgtacttaatgttttcttttgtttaatggtataaaagcaattgctagaatagcgagcaagcaagggtttaggtagttcataaataaatttctatgttttggggttttaaaaattatatcaagaaattagtgtgttgtttatttactagcattgcagttttttttttaatttagatgcatgttatttcgttctttttgtttggaggattctgataccaagttaccactaaggttaaggcaagtgcacggtaactatttgtatatgatgcgtgaactagtttaatttaattgtttcacttttattatgttgtaattattcatgtgattacgtgtaatcttgaatttggtttcatcttatcaatcatgttatatattcatgtttcatgattctgctctttttttggtttaatatcaagtgccacgcatagccacggaactgtaatttggttctttattcatgacacctgagttacattgaacctaatactcaggttaaccagtaaatgctaaaatgatattcgcgtaaaataaaaatagtttccgactcgctcttttttataaattattccgtacacattttctagttccatataatcttgctgagtattttatactcatctttgtgctttatttggtttttaggtatcacgtgacaccagcatgcaaggacgggaatagcacccaacatcgatacacttatgcacatatgaaaattaaacttagtttgtaagattagattaacttggtttcattatatttggatagtttacttcatgtttatgttattatggttgttcctgatacttctaggatgttgttgatggtaccatattcattgatgctggtgtgtttaaatattcttataattgctatcgtgcgtgtctataaatataaatagaactttgccatggtttttaatcaattttagattttagactaaaaaagtttttatgtgtggtgttgatatctaacactccagatgaatagacatagggcataaggcagttaattaatcaaattctcttagttacttaagaaatcaaatgacccattcattcctatgatgtttcacaagtgcatttgaaccatttaagatataggtctatctaaatggaagtcatgcactctgaaggacgggactacagagtgcatgtgcactaattagtgttaaccacatatcatcctcacaaatgctaaagttaatatgtactctcttgctataaagttttggcgtaaaccgccacatcggatccaggggtgtaaagttttggcgtgtcacatcagatatacggacacacatttgaagtattaaacgtagtctaataacaaaacaaattagagaatccgtccgtaaaccgtgagacgaatttattaagcctaattaatccatcatcattagcaaatgtttactttagtaccacattgtcaaatcatggcgtaattaggattaaaagattcgtctcgcaatttacacgcaatctgtgtaattagttttttttgtttatatttaatactccattcatgtgtctaaacatttgatgtgacagagtgtaaaattttgtcaggggatttaaacaggacctctatgttccatattgatcatcataaatgttaaagtcaatttacatgcataaatgcagtaatactacatgtgaagtgaaggggccaaggttatatgatgatcaatttggaatttttgagttttggttatatgatgatcaatatggaatggatggaatatatctttcctacgcaggaatatacattcttgtaataaggaaacgattcctaacacctaaactaaaacaaaattttctcttaagttacttttgtaatatatgcaaattatttttatactttattgaatttacttctagatgtctaaaaagtaatttaatggagtctaaaagtaactagatatgttatataattaatttgtaatttttcatcaaaatataatcatgtgatatcttttataaagatttaattgcaacgaacacaacagtgtaatcggatcttagaaaaaattgaagcttatgtggtaggaatatatatatattttacttgcttgatgaagtagaacagtgcactagttaagctagatttcccggaacaacatatatgcagacaacatatcatagctcgtaacgggatgctcgttaggtcaaaaatgtgcgtgcgtactaatttgattacacacactcttaaataagatagctttcaactaattctagttcatttattaacatatatcaagctgccatgttttgtttgtgcgaacgaaattattaccaagttactggtcactggcaaatgagttgttacttcctcgtttcaaattataaggcgcattttgttttgttaggatgagactttcactaacaactagccacccagtcacgcttcgcgtgactctgagcgctgtataggagttgacgaccgatcttgataattacggaataatttctatgagactattctctctgttctcaaatataaggatttctatattgtttaacaaagattatgtttgatcatataaaactttatatccctttaccgaggaatgataggagtttagaaaaaagttgagagtaggataaaaaaaattgaatggaaagtgagattgaaggtaagttaatctataaatccttatatttttgaataaattataaatatttgtgatgcttatatttgcagatagagagtagctacctttatgcttttttgaagggattaaggagagggcaataaaattaaatgcgagggttgtgttttatttttatttttgatagaaagtgtgaaggttatggttgattgagataaagaagtatatgaagaaattaaaaagataatggttgtagttaattgagatgaaggaatatgtaaagtaggataaattttatatactgtcgctgcgggtgaatgagacgagctgctggtgttctccatctgaaactatctgtatatgcaccggtgtgcaccgatggatgcacaggagctattcatctggaactttcctgatgtgtgattggtatacacaaatggatccaacggtccaattttattcctcctctcatcctaaggctattattcttcacatgacgtggcttattggttttagaaagcttgttgctttcacatatgtagattactatattatgatatcatttaaatgatacaaaagcataataataattaaatacttttgaatacaaatctaataataaatataattgtatcattaaaattatatcgtaatagaataattgttggtcaaagcctatcgtaagaaacaaaatatgtcttttattttaaaacggcgagattaatactttagtattagcaattattacttaacattaattaaatatgggctagtagcttttggagaagttttatctgtcatggtatactattttttcagagaagggtaatttttacccggcctttatttccaaccggatatatgcagccttttaaatttggaacttatcccctcaaacaagccaatataaaattcactcttacaaagatttgaactcaggaccttagggtgttactcagggcactgcaatcacttggctacatcatggtatatgatggtcaatatgcttttttatatgtttggtgaactattgtaatatagaactagtgccaaattttgatatagataaaacaagaaaacatgtttttttgtttgaaaaacagttggtagtggcattgaacttacattttagtgaccccaatttcatggcaatatgtacatctttctagcttgagatcaaccttccgttcaagtttctttccatcctctacagaatgtgtttggcgtgatcaaatgtacttagtacttttttttggtaaaaggatatgcagaaaaagaattgagattacagagctaccaaacctgagacaactccaatagttaggaagggcttcacaatgttaaacccatatatgactaactctcctgaccctggggctacctgcgcccatagaaaaattggatgcaataaggtaacatgaaatagaattaatgtacaaatcaaataattataattaagcatcccaacgtttcccatggtcactcatattcttagcacaagcatacattttatgctagatgttggcctaacatattaaatactccaagaactgctgaatttagcattaataaaatggtaaaaggtgacaaaactataagccagttctttaccatgtttgtcaaggtaggtcaatctgtgaatggcacttttcaagaaaaaacaagtgctgcactattgaccttttttccactagttgataagcttaaattatctctctaccttttttttcaaatttctttctctcctgctcttaagatagtaatgtgcttgtaaatttcatcaaaatggaagacaaacagatgttgagacttatagccaaaagcaacgcaaaacaaaactgaaaagagatagtagaaggcaagtcttctgtagaaaatgctggtgaatatggaacaattagccaagaataaaacaaactgatacataatcttcatgtattcagattcacatgtttaagaggcagagaggcatatgcagagggaccaaccttggggtgtgctgtgaatggcatgttccactgaccatcgacgacccagctacacagtgtgccaagattgtccaagtcaatctcgtagggaatgtcattctctgccactgagaaaaccctctcggcgtgctcaaacacaccggtattactcatgtttctaaacaccttgccaaacctcagctacagcaagatatgcaattaatgatcagtgtcacttgaacactacgtaactacggtgccttagcatatgacactagaacagaagaaaatgctattatcaaatctttatgacccagagggtactatggttcactagagatgtgtggtagtggatcaagggcgaaaatcaaagaggacaaaattgaaattgtgaagttgcaaatgtttgtcaacatagaaaatactccgtgtttgtttttataagacctgtaattttttcaatcttcctgcaaaattgaagtcttgcaccatgagtttgttgaatatgttcaatgtttggacatggatattacatggcctctctcctgcatttatcagaagaatctcactaaccatgtcacttcagctatctataagaagtatgagaagcatggaagttttaactcatactccctgtggcatccctattttcaaaacagaaatcaacatttgaaaatatttttcttatgatgtcaactccgtccatacttgtttgtaatatattatgaaagaagccaatggtaaaactataatattgtataccgtgtagcaaactaatatgtattacttcctccgttctaaaatatgggatattcttgttttccataaagtcaacaattaaaattttgactaattattgagctaacaattaatatatctgtattgtgtcatgcatatagtgccattagatttgtatttgaatgtattttcatccgatgttaattttgttactattaataatatattataaacaaaattagtagttgaagaataagaataaggctggagaccgtgtaaaaggctgttacacataatattttcaaatagagggagtttctctttattgtaaactctatattcattctagctacttaaagtaataattatattttgatagagacaagagtagtaaaaagttccttgccgacaaaaacagagggtgcaagttatttacaaaccatgttcaaaatgctggctgcgattatggcaagagggtcacccttgattgctgagaggaagcatggtctctgacgatccctttcagtattaaaagtgtcagattgcacgtagcggttgttgtatgagactgaccaagtgtttccttctctgctcttggtgaagtagagggcat

SEQ ID NO: 18931 - DNA, 12229 bp, Oryza sativa
  unsure (1)..(12229): unsure at all n locations
nnnnnnnnnnnnnnnnnnnnnnnnnnnnnnnnnnnnnnnnnnnnnnnnnnnnnnnnnnnnnnnnnnnttttcaaatagagggagtttctctttattgtaaactctatattcattctagctacttaaagtaataattatattttgatagagacaagagtagtaaaaagttccttgccgacaaaaacagagggtgcaagttatttacaaaccatgttcaaaatgctggctgcgattatggcaagagggtcacccttgattgctgagaggaagcatggtctctgacgatccctttcagtattaaaagtgtcagattgcacgtagcggttgttgtatgagactgaccaagtgtttccttctctgctcttggtgaagtagagggcatgcagcatgccttctccctcgacccagatgtcttcagactggccgaagattgagttcaccttgtgcaaggctccaaagagagggttggaacctgcattatattggttgagttttaatctattcagaactagagcaaattaagatcaaactttgcgaacctaataatagcattgtgaaaagtaatactgtgaactagcatctgagcacataactgacgtagcacaaaagtcaagagttaagggcttaaactacaatagttttcgctagcttgctagttgctaatgaaagattgaaagaaaattaccatttctgatataaacaccctcaggaaaatcatctgagatcgtcccttctatcctccatatctctgttcttccaccgatttcatcaactggtgcgaaattgctctgctcatggatagatccatcatataaattagcacttgcaattcagccatttttccgatagtccaaactacaccccttaactattggatttgtctaataatataagaaacatccattaactacaaaatcagatattttataacccctaggccttcaactattaaaacaagtcaaaattcaaccataaatgtaatgatattatacacccagttttagtagcggttttcatgattttcacaacaaaatatatattttttgacttatattaaaccactttctacctatctgtctaacttggtttttttatcgtactatttggatttcaaatcatgaatattaccattaaaatcaggttgtattctatttcatccggttatggtaatggaaagctgtaaaatatctatttttttagttgatgggtggttttctaagaaacagggagttcaaaagcatgtgatgaaaattaattggaatctgaagtgttctcccctctactatacctctaaattaaaaaaaaaaggttcaaaacaatttaatattatgatttcttttttcaggcggtgctcttcagcagccatcagcgaaaattggtttccatcgatgggaatataacaaacatgcttgtaaaaatagccctatatttataagtagaccccttaagtgacagccggcgataatcgattttcattggcggtaccactactgcagatttgattttttttctatacaaaacccacaataggttgtaggcagcccataagtgctcccgcatgcaaaaaccactctcgtgggggcgattgatgggcagcatgggataatccagatactgtgattatacgacaattccacaacacccccattctagacgaccatgcaagggtgcaggtagctaaggtccacgctgaacatgtcacgttcgagctagacatccctaaaccagaggggatcgaacttttgggagatgcaatgaaccagtttgtcttgtggcatcatcgagacatcatccttgccggacaaccaccatctgccctagctccatcccaaccaatgacagttgccgctcttgcaccgacctccccgctaggatcaccttccccacaagcttccttgcctctagtaaggtcaccacaccatccaccatccctaccagtttcgattcctccggtaacgtcaccacatcattcacgttctccacctacaccttctgctcaagtcccttgccctcccccttcgccacctaccgaacaaccatctcccattcaccaattaatctcctcctacaccacaatttgctctcgcccaacaagtcccacctcaccaagtaaatcaatctggccccatttctactacccttgaacatcgcaggctcatacgaaaattggtttccatgtacgaccacaaggaaatgtcaagagataaagagaggttcctgttttcaatcttcagtgggagaggttgggcaaagaagaagaaagaagatgttgctgagctgtaaaattcctagaagtcagtagtatgggccaaggatgagttgcaatcttggctatctgtagatgtgccccaagaatataaatatgacaagtcattcttaccatggtacattatgaataatctaccacgacagatgagggtgatgcatgaatggtacctcaaggtatctagaaaggccctaagcttcattagtgtcaaggtcccacgagacgatttcatgagtaaaaccaatgagatctttatcatcaatttccgggacctacacgccctcttcaagctcgataagatggacatcaatctcgttgttgcattttgcgtgtaagtgtttttacactagtttgttgtaagtgaaatgtgtgaaagaaacttccttttcaatcaagctgcattccataggtcacagttctacgacacagaaagagcgaggcaactcgttggctatatcgagccaacaaggatttgcaggccacacaacaaactgtacagcttcttgctaatagcccggaactaacagataagacaccggaggaacacaagcatatatcaagaaattgcacaaggaagaagattgaagtagcttgctacttgggaaccgcaattctcatgcactgagacaaaaacatcataatggtcccttacgctcttatataagcagcatctcttccatttgattattttttttcttgtaatacaagataactagcaaatgtcatctctaattcatctatcttgtttgcaggaccactatattttattcccggtatatccgagggaccacttggtcgtcgcgcttgatctggcacactatccaagaaagcctatatggagttcctcactatttcgaatttcaacgtagtaacataccacctcagtacctaattgccgttccgaaatttgaaagtaacacaaataaatgttttatcggcacagagcacgtaaattttatgtcaaacatcacaggccagtaaaggatgtgcagaggaaaaagcttcatgtgaagacggactggccggtatgtaatggcgtgtgccatgcacacaaattgttgtaatcattactatttttaaactgactggtgttattatcatgtttgttgtgtttcaagcaaccctaggcactaacctatgtggatattaagtgtgcaagatgcttagggtcaacaggagatgcacaacaaacaacaataacgtaagtccggagattgttctctacatagattatttagtcacatttcatttcctgactttcattgtcttcgttttttttcacagatccctcaaataatccttatgtagcaaaccggttcaacaaacaaacaatttcgaacatatgcgctgacctatgccacttcatatgtcgtgactgctgcaatgcattagggaatcctatcttaccataaaattataacccactaaatcctaaatcttaacatacaaagatatcacaacattatacaataatcttactataaagttataacccactaaatttaaaaacttaacatgtaaagatggcacatcatcatgcaataacaagatacaacatcatcatccactaacaattattatatttaaacatcatgcaagcatgctatattatctataattctatcattaattttattttagagttttaaaatgcaagcatgttaaagcatcatcccatatatttcacataatattttaatatatctcttcatcatttttgtaatatcatatatacctatatagttcatccttacttagttaattaatgttatttctctcttctctcattaagtaatatcacctcagttgtttttagccttagttgattaatctacagtccaaactatctccctcatttttttctctcataaagccacatcactttacttttacatttaaatcatcattctgtatactccttccgtcccaaaatataaacatttttgggtctcgacacggtctccgagatactactttgattaacaatatctatggaagtaaaatgttttaaataaaaagagttgcatattatgatagttcatttaatgataaatatagtaacatcaaatttatatgattaatctttttagtttttttgctattaatagtcaatatttaaaaagtttgacttggcactattctaaaaatgtttatattttgggacagagggagtattatttaaatttaaaatatcataaaccccatcaacttatgtaagtttatactatctagtcatcttacgcattattttgactcattgttattatagtaaattcccgtagcaatacccgggattcacctaatttctacgattatcagagcgaactgggcaaagaagacaaattcaagcccctgaaagagagtaggagaaagaacgtatacttataataattatacacacatatatatgtacctcggtgggacgcaaagattggtgactgaatgtgaaggtggagtccacaaacgcatccagcaatagactggaagccatggttactgccgcagatgcctccccaagtttggtggtaagctgctgctgaaactccttgaaatgtggctgcaagtatatatatcgacaacgcaattaaaataggatcaacattagaggaggggaggtcgttcttacattggatgtgatacatttggtgaaatgatcagtcgcattaggccttgtgattgatggtcttggtgttccagtagtgctgctccttctgcacaaccatggttggagagtgccgccatacatggatggagatgctgcggccaccatattgatcgtacgtacgttgtgcgcttccttgctatctaatttgtgtgacagctacaactattgtttcatccactctatttgtcagaggaattcggcaagagacgctcacttttatagtaacctagtagctaagtactaccgtcgaggcatgaggcatccatgcatgggcgcatgtgccgtatttaagacagctttgccccagtaatcaattgtatggtatttttaggacttataaatttgaccacgcggtctatgatattatcacatgtatttattagataaattttatgcatgcattctttcattttaaaacagtatttgaaagtttttttttttgagaagtatttgaaaaatattaatggttgaaatttcatgagtccattaactaagctttgtgtatgtcagatatatatatagttcgatcggatatacagtgtgattttgcaatgcgaacatgcatggtccattgactcatgatcgagttaatcaaagcagccacacagtaatgttgacttcgatcttggaagccacagtagtgtttttggtgtagaatctggcattagttcacccttcagcaaccaaatttgacgatctatggaatgattgtatataagacaacgcgcagggaggcggcgcctacgtacgtatggcgacgaccagggcacacgtacgcttatataatgtcacgcccggaaattcactagtaatttccgaacttattagtgcataaaatcctcgtccagaaatcagccgaggtatacaaactgacaatttaatatacaaatccatcataataataacgttacacacttacaaaagaaaagaaaacagcagcggaataacggtctagcgatagcttcagctccactcccacaggcagctcaactggggtataagtcaaacgtcttctccttctggatcctttttcttcaactgaggttgattgattattgcaagaatgagtataagccaaacgtcttctccttctggatcctttttcttcaactgaggttgattgattattgcaagaatgagcatatgacatactcaacaagctacacagcaaatatgcaagtgcacaaggataccaaaggatggcataatataggctcatttgcaaaagcagcatttagcaaaacatttaagagaagtaaaacagtggagtaattaatcagaaattttaatcaacactgaacaacacacccatgctacacaggcccaaccatcctgaacaaccatacccggctgtacagatctaactccaaaccaggagctaagcaaattattaccaggtataacatccataataattgtgagaggtgtgagactaatcacgaaaaacattgctcaacccgcccataaccgcgggtacggctattcgaatagttttactctggccagaggtgtaccactgtacccacaagacacagcctcaacatcatgtctaccatgcgtcgcgatactggaaagtacccgaatagaggctgtaacaataccctctgcacaacacaactcaccacagtgcaccattcctggatcataattacccccttataaaacagggcatggactccccagcgacccccgtgggcttatctccgccacttctcagtctggtgctccgcaatgaactatgctatacaaaaggtaaagccgttgcccacgctggcttgtggttggcacggttaatgtttcacaacagtagctcgcgaaccggtccttcattgccatgagcacgaccttcaaaaccatgtgcttacaacccaccattaatcatattttaattaccaattaattatcataacacgattaaccatcgtgagctaccattaaatataaccataaataataatgtagtatatatgattcatcccattagtgagctaatgtttctaagcatggctaagcaattatatctaacatctagttgaaccaatatatataaagctcaactagtcaaattataatatcccaaggtatcaaggaatagagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaggctaacacgcaaaaccaagaaaaagactaataaaaaccaaataaacagtaaaaaacaagcataaacagtacatataaagtaaacaaacatgtagatcatgattttgattttagatgaatttagcaacttgaaccactcaaaaccgagttacgatgatttagttatgaatttccgaagatttaatctattagaaaaacaggaaaaagaaaaacgatgatgacgtcatgatgacctcatcaatggccggaccaagatggcgacctcgccggagattggatggtcggatgcgactttggaggacatgtacacgtagaggacgacgagacgaacccaacggtactcaccctcgaaccaaacgacgaacaacgacggccggcgacgaggtctagcggcggcgcggcttcggtcgacggcggcgacggggctccggtgaccggcgacagcgaggagggagcggccgagcttgcccacacctcggcgcaccttacggcggtgacggcgaccggcggcaacggcggaggcgacggcgcgacacggccgaagttcggccggcggcggcggcgaacttggcggcggcggcggagaggctacggggcacgggagaccacgggagtggggcaaacgaaagaggaggactagggggtcctatttatagccttggattgaagagatcggactcctcccgcaagaaatcgatccgggaaatcaaaaactcggttttggagataaactcgaaaacgagttcgattcggataagatactcaacgattagctccgatttttggggtaaagatagaggaggataagaggaatatttcccctcaactaaattggaaaaaggagcaacggggaggcgagatttggaaggaggaggcggcggcactgtgcacggcacggctggctcgggctctgcctgagttggaagatgaacagtagtgcagggaaggaaagtagacttcttgccgggcttttcttttctcagcctgattagaagagggagcaaaaccggactttggctgagagaagaagagaggatgcaggctcgggttgggccggcggaagagagaggaaggaaaggaatgggccgattcagcctaagacaagggaggagaattttattacttttccaattaaaataatcacttaaatgatctttgaattgttaaaaatacttccaatgctcaaataatttcaagaaaaatcctgaaaatactgggacactcaaagtacttaacaaaattataattagaccatttaatggttaatttaatatgtgggtaattactgaaatgctctttgtatgattaaaaattaggaattgagctccgaaaaatccgagaatattccagagagtataattaaccatggagaatttaataaaaattaaatccatccatgctttaggaaattttatctcccacatttaatttcacttgtaaattaatgaacatttaatataaattctaataataatttattaaataatttataaatcctgaaacaaaaatcaggatgtgacatataatgtaggatcgaatcacaacaactaagccaaccagaagggggtgaatggttgatatgcctaaaaaccaaaacttttagtggaaataaaagttaccctcaaattcgacggatcgcggtctgaccgaagtagttccaccggtctaaccgcctggaacacgccggtctgaccgagatcgaactccggtcgaaccgctgagatcgtctgccgctccctgtcgctgccgcccggtgtgaccgccttgtgcccgccggtcttaccgccatgatgccgccggtctgaccgccggtgcgccactggttagaccaccgaaacccggtgaaacataaatcgaagaactcttaaagtggatgacaattttattgattctctctgtgtttacaaagtgcaccaatagcactcattacaaaaatttcgactaaactcgaaaccctaactcaactatcaactcaattgctctcaaaagcgataccgggaagcctcacgctccccctctatttatacccgaggtaggcagcctaaagccacgaaccaaactcatgctagaagtcctaatcaccctaggaaaccctctagtacaagaaacaaactttacataaccaatcataccaaatttggactccttccaaattcgactccgcatcccatacgcacacaatacctccatcgtatgccatatggaatcttcaccaaccatgtgcattgaactctaaccttagtatcccgcatgatctctgaccaccacggacgtcgtcttatccccaagccgactcccggtccatcaccgcaaatactctcccagcatctcgagtcacctacacatagaacaaacaaagaaaccaaaccatattccgagaccaagctatccccaacatgactcattagtagcaaacggcagtattacatacgcatagtatccatctagaagtcataacaatgaaaaaatcacagatatctaaataaacaacccgaaaccgaaaccgacacagcgtcggccggtcagaccatgggctgcgccggtctgaccgcgtgatacacgccggtctgaccggcaacccatgcccggtttgaccggacccaaatccagcagtacctgtagatcacctatgaaatagaatcatctccaaaaccacttcgcaaataaattccaaatcacaaaaccaataatctccaataccaattgttcatcacagaataataatcaaaaacacttttgattttacaatctcccccttgataaacacattggcaaacttatcaaaaatgttttggtgtttggaaaaataaaaacaaaagtggtaaaaagcacacttcatacaaacgtacacatcgtgctcaaaaatccaaaagaaaacttccctcacttttgaaaagaaagaaatttctaatcgaaccaaaaacaacatgctcttctcaactcatttgcttctccaaaaattttcaccttgcttctcccccttttgacaatgatttcatcaagcataggaattatgttcattaatgtttaagagcttagcatacatatagcatatcaagtcatgtgttgcaataaagagaagatgaacccatctataatataacaagcatgcattaaccatgaaccaaagattttacaattaagcttgaatcaactatcaaaattcatgatttcatatgatttataatgcaacatcttaacaagcacataggttgaaaaataaacactaaacacatataccaattgcattaatcacactttctcagatgagcttttgcacaaaacaaccaagagaatttttttaacgttttctttttcttgagcctttttgcccatatttttctcttttattcggggtacgtccctgtcgtcaagactgtttccagggatttggtacccattattttgctcacatcgaatacgtccttatcgtcaagactgtttccaaggattcggtattcatttttttcatattttttattctctttgcacaacgagcaattaattcaataaagcatataagtagagcatttatagatcaaaccatatgctagcatcaacattgcatattagcttaattcaagtatagaattaaagtgtcatgcatcatctcccttaaaaacaaaatctaagtctcataaaaagactagaatacatacaagctatgctagagacaaataaaccttcaaagtattgctagcatgcacaagaaaataccatatgtatagatcaaagctctcttttctcaatttttctcattgtcatattgttgcttgataaaaccatgtgatacaaaactcccactcaaatcatgccaaaaggatgaattattcccaattcaccacgaagaaaagcaaaacgattagaatccaaaggtttagtgaaaatatcagcaagttgcaactttgtgtccaaaaactagaattcaacatctcccttgtcaacatgatccctcaaaaagtgaatacgaatatcaatgtgctttgtgcgtgaatgttgaacataattcttagcaatatttatagtactagtattatcacaaaagagaggtactttctcaaaagtaagaccataatctttcaaagtagattaaagccaaagaatatgggaacaacaactagcagcagcaacacattcagattcagcagttgattgagcaacactagattgtttcctagaagaccatgcaatcaatgatgtaccaagaaaatgacatgttccactagtacttttcctatcaattctacaacccgcaaaatcagcatcggaatatccacttaagcatatagaagatgaagtagaataccaaattccaaacttcgagtgtatgattcaaatacctcattattcgtttgaccgcttgacgatgtgaagcatgagaagaagcttgaaagcgtgcagacaaacacacagcaaactgtatgtctagcctagaagcagttagatacaacaaaaagattcaatcatacttctatactccttttgatcaatagcttcaccatcttcatcaggatccaacacaactgtagaaccaattggtgttgaaattggcctgcaactctccatcttgaaccgtctcaaaagatcctttgtgtacttcgtttgatgcacaaatataccttgagatgtttgcttaatttgcaatcccaaaaaatacgataactcacccatcatgctcatctcaaattccctgcgcatagtctcagcaaacaccacaaccaaagcgtgagttgaacaaccaaagatgatatcatccacataaatctgaacgaacagttgattatcaccatgcttaagaacaaaaagcgttttgtcaatcattcccattgtaaaaccttacgcaagcaaaaagttcttaagcctatcataccatgctctaggtgcttgtttcaaactatacaaagctttagacaatttaaaaacatggttgggaaaatcaggattttcaaaacctgatgattgtttgacataaactt

SEQ ID NO: 18932 - DNA, 8124 bp, Oryza sativa
  unsure (1)..(8124): unsure at all n locations
nnnnnnnnnnnnnnnnnnnnnnnnnnnnnnnnnnnnnnnnnnnnnnnnnnnnnnnaacaacaaagatccaatcatacttctatactctttttgatcaacagcttcaccatcttcatcaggatccaacacagctgtagaaccaataggtgttgaaattggcttgcaattctccatcttgaaccttctcaaaagatccttcgtatacttcgtttgatgcacaaaagtaccttgaggtgtttgcttaatttgcaatcccaaaaagtacgataactcacccatcatgctcatctcaaattcgctgcgcatagtctcagtaaaatctacaaccaaagcgtgagtcgaacaaacaaagatgatatcatccacataaatctgaataaatagttgattatcaccatgcttaagaacaaaaagcgttttgtcaacctttcccattgaaaaacttttcacaagcaaaaagttcttaagcctatcataccatgccctaggagcttgtttcaaaccatacaaagctttagacaatttaaaaacatggttgggaaaatcaggattttcaaaacctggtggttgtttgacataaacttcctcctgtataataccatttagaaaagcacttttcacatccatttgatacaatttaaaaccttttgaagcaggaaaagccaacaaaagtctaattgcctcaattctagcaacaggagcaaaagtttcaacaaaatccaaaccctcaacctgggtaaaatcttgagcaacaagtctagctttatttctcacaatcaaaccatcctcattttgtttatttttgaaaacccacttggttccaataatattatgtccagaaggtggttcaactaaagtccaaactttgtttctctcaaaattttcatgttcttcatgcatggcgttaatccacgattcatcagttaatgcatgtgaaacatctttgggttcaaaagaagcaacaaatgcagaatttacacaaacatcatgagtcgttattttagaccttgtagtccgctcacctatattaccaataatttgttccggcggatgtcgtcattgaatatgcaaaggagcagcgacttctgaagttgattcacgttctgtatcagcactggtcgaagttgtaatctctagaggaccatctcgatcagcatcaacagtacccgaacccgacaagcctggccggtctgaccgcaccccctgtggtggtttgaccggtggcatgccggcggtctgaccggcctggcgctcggtctgactggccgagctgacctcgtcgtcgtcgtcgctctcgtcttcaaaaatacgaccatcctccccctgaacctatgacaatatatctgaaatatcgggtctagtacctagactagcctcatcaaaagaaacttcgcaagtttcaacgattttgttagtctccaaaataagtacacaatagcaacgagaatgtgcagggtaaccaagaaacaatcgatcggtagaacgtgcctcaaacttatacaaatttctagatttcaagacaaagcatttgcaaccaaaaacacacaaatgtgaaactttgggttgacatccaaatcgaagctcataagaagtttttccaagttttgaccttaagaaaacccgatttgaaatatagcatgcagtgttaatcgcctcagcccgaaattttctacgagttttatactcatccaacatcattctagccatctcaaccaaaacacggtttttcctttcaacaacaccgttttggtgcggaacacgaggagaagcaaattcatgttcaagacctctttcattgcataaatgttcaaatgaagcatttttaaattcaccaccattatcacttcgaattcttttcaaagagccaggaaattcaagatccaatcgaagaaacaaaccacgaaagggttgaaaagtttcgtccttagttgccataaagaaaactcaagaatatcgaggaaaatcgtcaacaataaccaacacatactactttcctccaacagattgcactctagctagaccaacaatgtccatatgtaatagctgtcccggtgcatccgtcatcacagaaacaataggagcatgtgaagtagaaaccattttagcatgacgacacggtgtacaaaccaaattaagatctttcttaagtttaggcaaaccacgaactagatccaaaccacttaacctagtgagatgatcaaaaccaacatgtccaagtctacgatgacaaaacatcacatctttattaaacttagcaaccaaacatgttatcacaggtgaaacaggattttcaaaatcagctttaaacactcttccatagcgagaaatattcaacacaaaatcaccacaagaatcaaaaactttacttctagttttcttaaagtgaaccttaaaattttcatcaacaatttgtgaaactgaaagcaaattgtactttaagtcctcaaccaaagttacattcttcaattcaaatttttcatttaccttaaccaaacctatagcgagaacggcacttgtagaagcatcaccaatgataatcgattcagtcttggatgcctttttgagtgaggagaaccaatttttatcaccggtcatgtgccgcgaacaaccgaaatccacgatccacacgttctccttccttgccaccaaagcctacacacaagtagaagtcgaagcctcagtactggggttagatgataataaaaatttaggaatccagtactgagacacatgactagaagatccaataggcatatatccacgtgcaaaatcaattatagaattttcggaaaatttcctccgaggccggtctgaccgaggtacagtggccggtctgaccgcctctgtaccgccagtctgaccgacgctcagtagccagtctgaccggtcaccggtccgaccgcgggacccactgcggtctgaccggtttcctcgagggaaaacccgatttttgccactttgattttgcaaaagcaatctctctctcctttttctgtttatgagctaatctgaaacaaaaaccaacaatatgttcatcttttccacaaaaagaacaagtatatttttcacgatgattagacagattggtagcattagaagatttagcaacacaagcaacaacaggagattttgaatgcacaacattggattttgaaaaagatgcattcaaggtagatatgataccagcagatctaaacacagttttgttagaatcaggtttaaccaaaatctcaccacttctagcaccaacacctaacacaataggaggatgtctagaattatgagcataaggattaaaaactaaaccacggttatgtgtgctaacctttgattgatccaaaatcatgttgaggttctttttaccatcagaaaatcttagcaaagaatttttcaaataagaaacctctttttccaaattagcacaattttcacaatcaccatgacacctttgcttttacgacatttggtgcaataaagcacttcattgtttttcacaacatcttccatgtactcaacacaacctaaagaatctttcaatttcaacttattcaaattacatgttgagcaatccaaaacatcatgaggttgttttaacttttttagcagaaatcatgttaaacatcaaactagcataaaaaccaatttgatatttttgcaacaactttttagttaaaaacaactcatccaaagtgcgtgtgtgcaaagtaaaactacaagcaagagaagatctatttttcaaatcatgtgcagcattaacatctctaatttttgaaatctcattcattaaaacctcacaatttgaacaatcatcatcattaggaataagagattttaagagattcaatgatattcttgtttaagagattcaatgataaattcctgttttctatacatcttctcacacttcttattttttttcactcaaaatattaatagcttcctcaaaagcacttacctcattatcttcatactttgtgtcagattcaccacgcgccatgaagcaaacatcggagatgttctttcccttatcatcatctccactttcaccatctacatcacttagtggctcgaaggcggcgcaaacttgttgaaaagccttactaagattctccagcttcctcccttgggatgaacccttcggcttgttgttgttggtcttctcgccatctttgtcttctcttttgcctctccctaccttaggacaatgcgaacgaagatgatgaattgaaccacattcaaagcaacgatttggaccacctcttttcctgttcctggcactatagctcgagcaattctgtcagcaaccaaagccaaatcctcctcctcgatctgttcgagttgatcatcggatgtggcattaaaaacagcaacaaaagaagacttagatgaagaagcttcaacatccaaagaagaagaagaagaaaccaaaacactcgacttagaatcaacttttcgagaaagaacattcatctcatgtgttttcaattttgtataaagcgaatccaaagtcaaagtagacatgtcaactgactcctgaatagatgtaactttcatctcccaaatagacatatcaagaccgttcaaaaagtgacgagaaatctcatattgtggataattagcaccataagaagaatcaatagatctaagatcactcaaaattttattaaacttagagagatagtcatccaaagcttctccaggtttcatctcaaatttaatatactcctttttgaaaatatcacgacgaagttctttaatgttatttgttccttgaagaaagttactcaaagcattccaaatttcataagcagttcgaaagtgcgcaacacgatcataatccgaacgagaaataccactcaaaagaatgttgcgagctttgcaattttgttcaaatgcagttttttcagcagcagtattaatagcttcaggaattacataaggatgagaaacttttctccaaatatcataatcttcagccaaaatgtaagattgcatcctactacaccaatgagaaaaatccgttccatcgaaaacatgaggcttagttgaaaacctagcaggagtagccatggcaaaaactctagatcgataaaaatccaaagaagaaaacaaggctctgataccacttgtaggatcgaatcacaagaactaagccaatcagaggggggtgaatggttggtatacccaaaaaccaaaaacttttagcgcaaataaaagttaccctcaatttcgatgagatcggtctgaccaaagtagattagccggtctgaccggttggacagccctggaatccctgtcgcgcctgatgtcgccgccggtcagaccgtaggtcacccaccggtctgaccgccgcgatgccgccggtctgaccgctggtgtgccgccgattacaccgccgaaacccggtgaaacacaaatcgaagaactcttaaagtggatgacgactttattgattctctctgtgtttacaaagtgcaccaacagcaatccttacaaaaatttcgactaaactcgaaaccctaactcaaaactcaactcaattgctgtgaaaagcgataccgagaagcctcacgctccccctctatttatacccgaggtaggcatcctaaagccacaaaccaaactcatactaagagtcctaaacaccttaggaaaccctctaatacaagaaagaaactttacataaccaatcgtaccaaatttggactccttccaaattcgactccgcatcccatacgcacacaatacctccatcgtatgacatatggaatctccatcaaccacatgcatcaactctagccttagtatcccgcatgatctctgattaccacggacgtcgtcttatccccaagccgactcccggtccatcaccgcaaatactcttccgagacatcgagtcacctacatatgaattaaacaaagaaaccatattccaagaccaagctatctccaacttgactcattagtagcaaacaacagtattacatacgtatagtatccatctagaagctataatcatgaaataatcacggatatccaaacaaataacccaaaaccgaaactgacacagcgtcggccggtctgaccgcggactggccggtccgaccgctcgatcaccgccggtctgaccggcatacatagcccggtctgaccggtcacataaaatgataaatctgcgatcacctgtgaatccaatcatctccaaaaccactttgtgaataaattccaaataacaaaaccaataatctgcaatgccaatcgttcatcacagaataataatcaaaaacacctttgattttacactctacttctctttcttatatgggacaccttacttatctacttaggaattttgtcatacatataacatttgattctatataggacttggtagcatactagcaaataggatgaatattcaaacatcataacaaaggttaatggagggagtatataacaatataatctgaccgcaaatatcgtggaggaaaaacatttaaaacttgccaatgaaaagtgaattcacactcaacctacatcatatatttgttttttcaagtatgtcattaaacctctctaagcaattgtgattagtaaaaaactagtggctaacccgttgttgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtatagatctgacgatctagttgtctcatatgcctcttagagggccttctgccaaccttatataggatggggggcaggattacaagatagaaaccttaaccaatacggtatcggtttcctaaatctactttacaatattatcaaaccaggactttaggccgttccgtaatatacaaggaaacgtaacacccaaatcatgatctgttacatattacatagatataagttatcccctataactagtcggataaccatgccgtgtgggtatggggtacccataatctccacagtagcccctgagaccttcacagtcgaaaagataatcttctctcgaaccagattactctaaagccgagtgcttcaatcatcttcgccatgatctcccgagtactttttccaaatatgaagactgtggagggctgaaaaataaagttaggtgcatcgactagatgcacctaataggtgtagcccccgactatgtggttagctgaacaaactaagcatatagtcaaggaataaataatctaactaaccaagtggtttcgataattatagtcaaccaagcgacttgatattaatatgtagcatatgcggtgtgaatccctgaataacatgatccgagtgatataccgactgctttgtaaaatatgatgaatgtaacctaaagttggctacatcattgaaaattcacatagcaaaacagctataaagaagcttgtatgttgcgaataaagaaatttctaatgtattgggcatacgccatgcgcacactgctttaacagatgtgcttaagtccctaaaagacacatggtttcaccacacctggaaatatatggcatatgtggtgtgaaatccgagtaaataaactcataaaggatttaccaaccgcctggaaaatgaccaagatatataatcagcttaagccataatattggtcaataaaaatgcacacttacgtggcgaaaagcaatgatattgtatctaatcaattgcttgataaacccaaacagtgtcatgactatataaaaaagtcagcggagcagctatataaagctttactgtttgacaccttttaagatgcattgtaccaactcctaaaaagttgagtaactgcggtataaaaggattttaaggtattgggcacataatcacgtgcacttttgcctaagcaaaaagatgcttaagtccctaaaagaacgtgacaggccacacctgaaaatatgggctgcagacatattaggcctaggccaaaaaatatgccttcgacaccctttgaaggatgacgcatgtaacatgctnnnnnnnnnnnnnnnnnnnnnnnnnnnnnnnnnnnnnnnnnnnnnnnnnnnnnnnnnn

SEQ ID NO: 18933 - DNA, 22893 bp, Oryza sativa
  unsure (1)..(22893): unsure at all n locations
taatattggtcaataaaaatgcacacttacgtggcgaaaagcaatgatattgtatctaatcaattgcttgataaacccaaacagtgtcatgactatataaaaaagtcagcggagcagctatataaagctttactgtttgacaccttttaagatgcattgtaccaactcctaaaaagttgagtaactgcggtataaaaggattttaaggtattgggcacataatcacgtgcacttttgcctaagcaaaaagatgcctaagtccctaaaagaacgtgacaggccacacctgaaaatatgggctgcagacatattaggcctaggccaaaaaatatgccttcgacaccctttgaaggatgacgcatgtaacatgctcccgagtaataaatcttccgagtgatatagaccaagtgtagctcatatgaatagcttctgatctgagtgattatcccttatgggatactcctaaatagatataataattgaatcccgactagcgcaagtattcgattgataacccttacggggaataataaatagtccagtctttgagcatagaaaatagacccatgatcacgaattcatgttgcatgtatccggaagaagtccaaattgaagatataatcctcgcgcttgtgtttgagctgataagcccctgagcatatagcttgtccttctgtcatagtcaaaattgtccatcggtaatagctgatgcaatcggcatggaagcgaagaaaccagtcggaagcagtcatatcaactagcagtgaagatgaaggcacccagcaatagcgacagaattttgtagccatggtgacaaaataatcagtcagaaacagacgagacagctggtgaagaagatgaaaatgcccattagtggcgacataataagccagccgtgaaggcgagaatatcagtcggtggcgatgaaaacaagccaacgatgaagacgtagacgtgcatcaaatacaatggcgaaatcctccaatcatgaaaatgcaggaaatagtcgacgacgacaaatgcaaccgatggtaatgacgattggcagcaatagagatgatcaaatgtgatgatgaagttgcccattgatagcaatgtagcagttaatgataatgatgaggtctcccctcggcggttgcgtagtaggccaaccgtgaaaacgaaataacaagtcggcgatgaaagctagtgatgacagaagcaaccgaaggtgaacacggagtcaccccttagcacggccgaagacgtcaggctcaatgaagtagaggtgctggtgatgatgccagtgacaataatccatcaaactattgagaagatattgaagctcaagtagtttccttgatgcgagcgtgtgcataatgaagactgatacaactcccgaacatgtagattaaatctcaaacttgataattgagaaatttggagtagattgtagcggcgtggagaaaccaaaattactggtgaaataataagagttgctgaagtagattccatagaactcgttggctgattagttgattgcttcatcttgacataaaacctgtcgaattttgagccgtgtatttgtgttgcccccgactctttagttagttgggaaacaactgaacatagagtcgaaaactttagcttcttgtcgtcgagtagtcattgcttgagtgaagatgcatgttgaagatatccgagtagaaatattgaagattggaataccacttgttgtagtaaaataacatggcatcatatttggtgacgcatgccgatataacgaagctcttgtagacgtcgtggctggtgaagtagcaaaactagcgaagtagcggcaatagagtttgtcggtgccggtgacaaagttgcacagccgtagaggcgaagaaaccaatcggcagtagtcaggtcagccagcaatgaagatgaaggcgaccaacaataatggtagcggtataaaccagacgtagaggcgagggcactagagtcagcagcagacgagacgaccggcgatgaagacgataaggccaatcaacactggcagaatcatgcagccatggaagtgaagaaactagtcggcagtagacgtagacagcttgcgttgaagatgatgacgcctattagcggtgacggcgacgtagccagccgtaaagaagatagcatcagttggcgtcataacaagccagctgtgcaggcggaaacaccagtcgacggtggacgaggcagccggtcggtgaagacgtagatgcccaacaacggcggcataataggccaaccgtgcaggcggagacaccagtcggcagcagatgaaggcagccggtcggtgaagacgtagacgcccaacaacggcggcataataggccagccgtgcaggcagaaacaccagtcggcagcggcgaaagcaagccggtcggtgaagacgtagacgcccaacaacggtggcataataggccagccgtgtaggcggagacaccagtcggcggcgacgaaggcaagccggtcggtgatgttctgactgatccatttctgaagcgtaggagataagctttgaaagccatgaatccctattatgcatatctggatctggatcctgcagaacaaacatataggatgagtagtatctgatgtaaatataatactcgagaaaaatttaagtattttaaaatatttataaatatgtatttctcctcttgtcaattttgatttccccgagcagatgactccgtacgtttaaacactctgtccgactagtcatagcccccaagcatcgggagtcagcctaggcacttcccaaacatgcatatgagtgacatgagtttgtcattaatggaataaagtttcacgaatcataatttactactcgggtacttttgcaattgtaaagagcagaaaataaatttatcttatctctatgcttttgatttattctgaataatacttagaaccttgcgttactcagtccatccaacgagcccccgggtgctaggaatcggcccaaaggcaactatccatcgacaaaccaaacggaaagcataggaagatagaactccataactcgataggtacttttgtactcagattatgtcgcaagcaatcaagataaatattatgaaaattgtttaaaaaatacgatataacatctgtagcccccgactcattagtcaacggcgaaccagttgatgtagtgaggcagaggaaaaaaatatcatataaaaaaaattaatgatgacttagctttgtaatattcccctggtgatggcagaggtggccaatgtgggaacaaagtcgtccatcaataacaatgaagacactagtcggcggcgacgaaggcggtcgacggtgaaagcgaagatgcccactaacggcggcataataggctagccgtgtaggcagagacaccagtcggcgacggcaaaggcaagccggtcggtgaagacgtggacagctatgaacggtggtgtgaccaaccaaccgtataggcgagaacaccagtcggcggcgacggaggcaggccggtcggtgaagacgtggacacgcatgaacggtggtgtgaccaaccaaccgtatagacgaggacaccagtcggcggcgacgaaggcaggccggtggtgaagtcgtaaacgcccaacaacggcggcataataggccagccgtgtaggcggagaaaccagtcggcagcggcgacggaggcgagccagtcggtgaagatgatgttgctatcagtagcagcgtagtaggctggccatgaggacgaacaaaccagtcagcgatgaagtccatgtccatgaagatcgtgtcagtgatatcggaaacaacgtgcctgttatatggctgtcgcatagtcggacatgtaaatacaaatcatatctgattaggagataaaagaacgtgcaagcatgcatctgtatttgctccagtagatcaagcctacgattgttggtagcagcctgtagattaaggaatcttgattggttggcttgtagcaggcagccatgcaatacatggtgatgatgagtagatgcatgtaataagagagctgctacgaagcccctgattatgtcgctgtgagatcgaggaaagatgctggccggactgtttggcgatcgaagtagtcagccagaccatgatgcgcgtgcgtagccaaccgtacaccacatatgttgcaagatcaggactgcaaactttgtagcatgccgtgtatcgtccaaggcacgcggcccatgctatcgacgatcctgttaacagtagtatccggttattctcctgacgataaagtttctctctgaagcgaaaaagcgtgctgacgaaggtgacgctggcggcggccatagtagatcgaatcttaaactcgccgtggtagagtggttgttatcctccttagctagattagatcttccccgactgatttgaatcaaagtcaaagagcgaggcttgttgaagttgtcgatggcgaggaagtcaaagctcctgaggcaaaggcgaagctggcgactcataaaattgattccatcgcactcctcaataggaaactcggcgtacaactacctggcgcgccaactgttgaaacataaattcggcaataataaaaggggtagcgcacgagacctaaaagtggatggatgccgagacaaaggatttagacagattcaggccctctcaatgagaggtaataccctacacctgtttggggatttgaatccgccgagtgtatatagatctgacgatctagttgtcttatatgccccctagagggcctcctgcccaccttatataggatggggggcaggattacaagatagaaaccttaaccaatacggtatcggtttcctaaatctactttacaatattatcaaaccagaactttaggccgttccgtaatatacaaggaaacgtaatacccaagtcatgatctgttacatattacatagataaaagttatctcctataactagtcggataaccatgccgtgtgggtatggggtacccataatctccacacccgtgcgttgcaattcactcacatcatctttcctgctcctctatgggtgatcaatctccctcttcaattcgctcacatcatctttcctgctcctttatgggtgatcaatacattttcgatcgaaccaaaggtataacgtcaagtttggtgaggtgaaatcctgctgagttcatgatacgattcttgatttcatccgttcaaagtctacttaagagaacttggttaccctgttaggagttcataatgtgcctattgatttgcggaacaaagttctctctttgttttttccctggttgtgtttgctgaagcactttgggtggatatttctgaaaaatttcaaatatatgggatgggggtagtacttagtcaagactttctcttagtttcaatgagaagtttggtgctctggacaatgttggtaattgcagtgtgtttgaaatatgctagtacgatttatcattgaagtttttacggcctttcctaagtgaggcagtaacagaattcaatggcgcttgttgaggcaagcaacaaaattgcagcaaatggatctccacactggagctttgaagcagccactttgaccttctcttttgggttattacacgaatcagggcaaaaacgatggacgtccatcatcagtgctgtcagatgcagcgctttttttatgatacataaaaccaggcaagaactgctgtcgaagcctttcattgctgtattattccgtgttcgatgaagttcatggcaaaatcagtgtgattctgtctgcgacatgcattcgatgcattccttgccgttcatgcattacatttttgtgtttgttatcacactaaaatgtcatcttcctgctctctagcgttcttcgaacaccatgccattatcgccaggtcatgcttttgcatccgcctgtgcttggaactcctgaagcaaaagcactgaaaaaacccggctgattcgtgaagaatgcatatagatcgatgctgtcatcgtttcctcgggcggccatggctgcaatggccatattctttttactaccaccaagcaagatccacttacaaacttacaatggtagctgaggggagcgaagggagctagccatgcatcatctctcgctagcagcgatatggacttcccctggactggaatggtgagcaatgcgacatcattgcccgttgggttagtgcaggctgccgctttggcccgcatcagtcaaggcaggcatggttagtgatgcgggccagcccgttgggttaggggcataacccgccccacttttagcccactcatcacagagccaacttttcatattaaaagtcgaccaagtcaccttcactgcgattaatgcaaaatcagtctctatctcctcgacggaacagcaaatgttcagcagggatgcatgagtctgtggctaccttgaacttcaaatccatttgagcacccatcactacagcaaccacaggccacttcaagccacgtacggaactcacctatagtgccatcaaagagccggatttcttcatgtaacccactggtaaaacaaccgatcaggcgcatagcaaaactgctttgcacttgtgatattgcaacctctatggtcgactcacttgtgatattgcagctatgtcaatcgcgccacaataaccatggatgcggcatgtaaacgagctataattccatgttgtctatgtcatctatgattgatacaccatcgatcagctgtagatcttcattttcatatatatattcaccagtcttgatcttcatgtcatattcgattagattagtgccgatcaattggatccctcgcttagggccagccatgtggatgagagaaccctacagaatcaaataagagtaagaaatatctaaagctgaatgcttcccttatgatgtttcacttgtagcaatatttttataccctacagaatcaaatgaaagtaaggaatatctaagacatgttttattattgatggccaagaactttgtcctgtatcaaacagaatgtacaaaatacataacggtgttagagagggaaattgattttgttctgaatcacaggtactaaatcaaataagcatgtaatatattcatgtgcctataagacttagtattcatgctatgcatgttcatatgcctataaacaaatgattcagttttgtgaggtttacttgctagcaaccaagagtccagaattattctatttgattttgtttggaatacatgatacttagtttcatagtatagatctgtttttgttgtaaatcatcatttcacaatatatataagactttgtaaggtagtggcttattgtcatgggccagattttgtaatggcatgataagcatggggccaaatattcggcccagtactaactatccaactactgtcagaagactaggttaaaccagagcctgctccgatgataacatgttaacagacttattaactataaaataattgcatacatgtataaatgtgcacgcctgctccacgacaatgggatcatccctgctaaaattgacaaaataattaagaaatgtatccagcctatcccgcactgctatgtatccatacaactccaccaaaccatggtccgcaggtactttagccaaccttaatgagaaaaattgcaacatacaacaagttccgtgtgacatgcaaattccattgctgtcgatgttgcaatccgtgggctttgaaaacatcattgcctcccaccgagcttcacagaaaaatacaagttctgttaaaattaaaataacacaataaacaaatgctggcgatacaaaatgtaaacatgcttcttgaggattccatagtcccattggaaagttcccctctcatctaaatgaaaaactatccgctcccttgaaaaatttttcttctaggaaatcccaaggataaagagagccatatcaggagtccgggattgatcatgtttttttttttctgtacaggcaaggaacctatccaacatctgttcttccagtgtgttgtctccactagaaaagtagaaagaacgcagatatagctaacctgacaagatcggagtccatgtaggcattagttttaaatcagtgaagaacctttcagtgagttcctgctcactggagagcaacgaaagcctgaagaatcagagcagtgcgaggatgatgagctggaaggggggttttgctgtgctgagctgcactgcacggttgtatctagcttttcttctgcaaatgatgcagagggaatgtgctctggaaaacctggcatatatgatgttattttcatcttgatgccatgcaaatgtactggaactctaaaacgagagtaatctctaaccaccccagaagggaaaaggttcatttattttataaccccctaaactattcctcagttcactatactcccagaactagcaagacaggtcatttcaccccgtaatgaaatatattttcttttttcgttttctagaaatcctcttttatgttgatcttttcccgatggtagacaacacattctatattataattattttcgtgatttccatgactatctgcatagtagggtgtagctagacctgttcaacacttagtatgcacatgtgtgcaccaaaaagaatgaaaagccatagcacagggcatgattacatctatcacttcacaaattttcaaaataaaacatgcttttataagaaacaagaagatcaataacattctggagttaactgaacaaatttccaggcaaaaaaatggcttagggagttatctggacaatcagaaaactttggatagataggagatacaatgtctagtgagatcacaaccttgagtatgatgtcctacacccagggcgatgtcagcacaggctgcaatctgctaaaggtatgatcgttagatgcctcgtgcttttgcacacaccaagcaatgaaaccatgagttgttaatttcagaagatttccatttatatatgccaatgcaccgcaatcaaaaattataagtaaacagaggaaagaaaaattaagtcgagatttacggagagaatatatcagttgaccctatagcttggaaaacgccctaataatgaataaaaataagaaaaagagatcgaccacttactttcattacggtcagcaatatgatactcttttttccagcaatctgtgcccctgtatatagaaccgtcacaatggctgctatatgggagtatctccatagggggtacaccatcctcaattgggtaaacaattagctgaggtacccctgcagccaagctctcttttgtctccactggtcagttcacaaccagtaacatccacaatttctcctgttgcatcagcttgtgtgtctatgactccaaaggttgtcccacaaacaccttcgtaaccagaaatgacattcccgcttgatgtcctcctatcttctgctccattcccgtacaatgagtaatgaacttgttcattgtgtcagtattgcttttctctatatccttcgtgccttgggaaatggcagagtgcttgcccaaggaaataatgaaacccttggcagaagggttgagaggtcttctttctggttcacccaactcctcgccatttactatattgctgctagccatatttcgatatccatgaagaaatctatcacaaagagcatcaaagtcataaataagatggtaagtattatcagtcaggaatgaagtcatatagaatactagtatatccaagcctgaaattggtttctggtttctatctgtgagcctcttttctctgtgtttggaaatcatcatggattaattgcgtggttttcccccatttgcctttttttataaaagaaatcaacaacacaagaagtgtaaataaaaacccagacttggtcccaatccagatcctttataaaggcttgtttggtttactatcataccaaaaaaaataatcaaaatctaggtaattttttacaatagcaatgttttggtaaggtaacattgaaaatgaatgtgtttggattgatgtcaattaggagccaaaatttatattatggtgaagaaagttctagaattgtgtcaaattgagcatgggcattaccaacctttggcttgaaaccaagccaccacattactaactatttaaactaaaaaatactatatattttggcattgatccaaacatgccctaaaatctatatagtagcaacaaaaggcacaaacattaccgtgagaagagaagggctcaccgggaaacactacaggtaggtcgattggctgcggaatcaaagcaatgaactcgtcgcgcaagcgctgatggccaccaccatggagatgccacgaaagacaggagataaggagaggacgaggcggcaaagaggcggcgcattgaggcaggaaaagttgtccagccgctctccaccgtcgctggtcccgcttcgctctccgccgtcagccggccggtcacgaggcggcggcgccggtgcttcgattgttggctgggatcgatggggttagggattttagtggggagacgaacagtttagttggtgaaaagaaatttatttttgtcattgaccggatattaaaagatattttcaaatacgaataaaagaactaatttcataactcgcctagaaaccgcgatacgaatttattaagcctaattaatccatcattagcacatgtgggtttatgtagcacttatggctaatcatggactaattaggcttaaaagattcgtcttgtgatttccatgcaaactgtacaactagttttttattttatttatatttaatgctccatgtatgtgttaaagattcgatgtgtctgcattgtactgtgtaattttaaaaaaaaattctcctccactctgtgtgtgtttggtttctggaatagttagaaaagaatggaagtttgaggggtggggttgttaaatacgttgtttggatggtatctacggattgaaggagttctactcggacaagactgggtctttaccatatcgtgaggggtccgatatctccgagtcctacttggagatcaagtgacccgcggtatataagataccccctgggtaggacctaaggcatcgaatatcaccaccaacacatccaccacagcctacggagccggagcacgcaggagccaagccaccgggagatctagtgggaccaactcgactacggtctcgtcggtatcatcgagttctgctattccctttataatctgtggttttcatcatataatcccataccaactggattatggctattacttaccaaggagcctgaaccagtataatccttgtcttttgtttgcttgttgtcgtactatgtagatcctcgtaccaatggaccccaataccctctatatctggtctacgggtacccaccgtcgacagcgctgccttcctgtggcgaccctgctgccgcctcccctcccgctggatctggcagaggagagggcgccaccgcttgccgccacctccccgtgggaagcacgccgcccctgcaacactccccgacctccatcaccagagagatagagtggatagagagagaggggtaagaggaggagaagaagaagaagagatagggggagagagaggggatcgcggagaggatgaggagaaaaagaatctcgatgacctattgcatcgtgcactttgtagtccaccacttgactcggctcggttttggaaggtatcggttttaaattaaccatctgttaacaacggaattttgcatcagaattggaaaagaaggaacaagattgaagtggattttgtgcggaattgagttggatttggagtcggactgcgcatcgtctaggcatcgtatcagctagaaacagagtcggagtttgactaagccgatatggcaagtggccgatacggcctgacttgggttcgatatgggcccagattggaatatccgtcattgccaattagagataaaactcgattaaggcaatttggaattatctatttatgttatcctaagttgcaatgatgcatatcttggttgaccacgagtaccaataattgtgtactgaaactggtattggcaatgcggttccatggaattcagttcacgccaatttcctatggcgcaccctctttggtgtcactattaggtggtgccagggcgggttgtgatagccagccattccgaagttcttgccttgccatcccgccatccgccctattgacttgtggaacaaagcttgatggtctattttctgcagtcttccaatggacaatggtagaccgaggtatttcattgggaacaaaggtctggtcactaggatgttttctaggatctcatcgaggccgatgtcactgcatctaatagggcaacctgtgacttttgtatgttggcgcacaacccagttgcctgcccaaagttttgcaatgcctggacatcttcttgtttttaggtcgatgaagaccgccagtcatatgcatatattaagattcggaaacgcaccgaccttcctcaaggattactaatcagcccaaggtccgttgctttggatatatagcagtcgttgctataggtctattgctgtgatgatagaaagtgggtctccttgaaataggtccatggcatgatgtatcacatttgcggggatgctattttgcgggatcttaaaaccgaaagttgtcaacaaccccacaacccagtcatcatatctttgtggaaaactatgttgatgtagttccactttatagagtcaaaagctttttgaaatgtccacttaaagaggagcatgaagttgttatgtatgctcgcccacaaataaagacattttgattgccgaaatcaacaagtgtattagagcaggtgcaataaggctgattttggcacttagctttcctaactcatactctttgtttttagctttcctagatagactgtagttttgtatttatgtttaacgtttgaccgtccgttttattttgaaaaaaaaattacgattagtatttttgttgttattagatgatactttatgtgtgactaattgtttttataattttttcacataagataaacgatcaaacgttggacataaaaactataactatacttaaaatgagacagaaatagtatttgaaaaacgtgctaacagaaaatcgtaaactcaattagcccttatagggctctactcacagtatattcatttcatctcaaacccatggtctgcactgctagaaaataaaaataaaaaataaaaaacgatgagtaaaatttggaaatggagagagcaaagcaaccaactcgctggctcgctgtgggcccggcctatcgacttctccacctgctccgtctgctgcgagtcaaacatgttctcgtcctcttcgtctatgaccagttgaccaccactccactgaccactgatcagtctctgctgctgctgcgtggaactcttccagctcgccgccgagcttccccaggatcacggcggtgagctccggccatcaatcaacattcgcccccgccgtcttttgcggttcgtgttgattccccacctgctgatctagatctgcttctgcttctgtttcgcaggatctttctttgcgtacggtcgaggagcatatggaggggtttctggtgaccgcggccaccggggcactcaagtccgtcctggtgaagctcgccgccatggccggcgaattcgaaggggtgcgcggccagatcagtttcctcgccgacgagttcgccgccatgcacgcgttcctcctcaggatgtcggattcggaggaggggaacgctgaccctcaggacaaggcctggacgagggaggtgcgggagctctcctacgacatcgaggacagcctcgacgagttcatgctccatgtcgtcgacggatccgctaatccggatgggttcatcgtcaaatgcaggaatttgctgaccaagaccatggcccggcgtcggattgccaagatgattgctgagttcaaggcacaaatcaaagaagtgggggagaggaatgcgcgatatatgaatggtgggatcagtttgatgaggacagctaatgcgaccgtagaccaaagagctcttaccatctttcaggatgtgtcatctctagttggggttgatcagccgaagaaggagctcatcgatctgttgatgaaagatgatgggcatgtggcatccgagcatctaaggaccatctccattgttggaattgggggattagggaagacaacgatcgcaaacctcatctttgaggagctgagggagcaattcgattgttctgcttttgtgtctgtgtcaagaaaccctgtgtggatattatgggtaccccatacccatacggcatggttatccgactagtcataggggataacttatatctatgggatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacagttggcgcgccaggtaggggtgcgtcgagattcccgtcggtaaagtgcgttggaatcaatcaccaacatgaccggatcgtacacgcgcgtcattcaccgccgcaagaagcacggagggcgcgtctcatcagagcgttgagcgcctgccagatcgagagatcgcgccgatcggtcgtgtgctgtttggacttccggatcggcgagcagctacgcgtgaccggcagcaaccagccgccggcgcatgatctccgtcgacgtcgcttggtctaattcaatccggccgaccacctcgatcaatctacatccatgcggctgtatagtccacgcgtcagatcgatccgcatgtgcatcacatgacgagggtcaagcagggagcaagactatggcatatgcatctaatcttcttccctgctaatagattgaatattaaatcagattgattgatggtctttttcctctttgctctttcttctggtgtatgcatgttgccggcgaccaaggtgttcaattaggcacggtatgattaagccgtcgctacgcaaggcgaagccgtccactctctgagcgaatccaactcgtgggctggacaggcatgcacgaaagttcacataacgagatcgctggagatgtacaggatgtgtcgattcaaccgccatgcatggattaattaatccagccatacatgcattcaatcgctgagatttatacatttaatttgctgatattaatcagatttattttatttgtttccatgagaatctcggagcatcaccgatggacgtcctgcgggctatggccaccacgggccacacatgggaacagccagcctatggctaatcaggagagaacacgtgcagaaagttgatcttaccgatcaacaagcaccattaatttacttaatcatgcctatatatttttatcattaaccaagttggtttgttgtcttgttctgtaagcacgccgagccatggatcgcttgattagtcctagcgacagagtgcaacaccagcaaccaattttctccgtctcggagtcagtccggtcgagaaaatcaatctcggcgagttcaacaatttaaatctccgactccgccgggttttttccttttcaacttattgttgtttattagattgatctctaaatatcagattaatctcttggtatttcctgttgtttacatgtaatgctgtggcactgctgttgccgattggtgtttccgcctgcacggctggcctattatgccgtcgttgttgggcatctacgacttcactgtcggcctacctccgtcgccgccaactggtgtcctcgcctaaacggttggttggtcacaccaccgttcatgggcgtccacgtcttcaccgatcggctagccttcgttgccgccgactggtgttctcgcctatacggttggatggtcgcaccaccgttcataggcatccacgacttcaccgccggcctgcctccgtcgccgccgagtggtgcctccgcctacacggctggcctattatgccgccgctgttgggcgtctgcgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagcggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgctgttgggcgtcttcgctttcacaatcgaccgccatcgtcgccgccgactggtgtcttcattgttattgatggacgactttgttcccacattggccacttctaccatcaccaaggggaatattacaaagctaagtcatcatttattttattctttatatgatatttttcctttttctctgcctcactacaccaattggtcttccattgagtagtgagtcgggggctacagatgttatatcatattttttataatatttatcttcattgcttgcgacataatctgagtacaaaagtacctatcgagttatggagttctatcttcctctgctttccgtttggtttgccaatggatggttgcctttgggccgattcctagcacccgggggctcgttggatggaccgagtaacgcaaggtgctaaatattattcggaataaatcaaaagcatagagatgagataaatttattttctgctcttaataattgcaaaagtacccgagtagtaaattctgatccgtgaaactttattccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggttttaagcttatctcttacgctccaggaatggatcagtcagaacatcaccaaccggccgcctcgtctgccgccgactggtgcttccgcctgcacggctgacttattatgccgccgttgttgggcgtctacgacttcaccgaccggcttgccttcgccgccgccgactggtgcttccgcctgcacggctgacttattatgccgccgttgttgggcgtctacgacttcaccgaccggcttgccttcgccgccgccgactggtgtttccgcctgcacggctggcctttaatgccgccgttgttgggcgtctacgtcttcaccgaccggcttgccttcgccgccgccgactggtgcttccgcctgcacggctggcctattatgccgccgttgttgggcgtctacgtcttcaccgaccggcttgccttcgccgccgccgactggtgtttccgcctgcacggctgacttattatgccgccgttgttgggcgtctacgtcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacggctggcctattatgctgccgttgttaggcgtctacgtcttcaccgaccggccgccgcatccgccgctgactggtgtcaccgcttgcacggctggcctgttataacgccaactgatgctatcttcttcacggctggctacatagctgtcactactaataggcatcagtatcttcaacacaagctgcctacatttgccatggctgccgactgttttcttcacttccatggctgcatgattctgccagtgttgattggccttaccatcttcatcgccggtcgtctcgtctgctgctgactagtgccctcgcttctacatctggtttatacaactatcactactgatgaacatcacgtcttccgtcgccgactggatatgttgtcgccgactagtgcttttattttcacaactgcgcgtcttcactaccagtttgctactgttgccgacgactcgtgttcacttcatcacggcaatgcaactttgtcatcatggtagagcgacttcatctttattatcttcggcactggcaaactctattgatgctacttcgcaagttttgctacttcaccaaccacgacgtctttgtgagcctcgacatctcggcatgcgatgccatgttattttactacaacaagaggctctccaatattcaggatttctacttgaacatcttcaacacatatcttcaatcaagcaataactattcgacgacaagaggctacagttctcgactctatgttcagttgtttcccaactaatcaaagagtcgggggctacacaaatacaaggctcaaaatttgacaaattttatgtcaagctgaagaaatcaattcatcaacccacgagtcaactccaggagtcattatcttcatctttgcttcggagcagacattctacttcaacaacttcaaatatttcggtttagacgagttggacaacaacatcaactctcctccaagtgaagcatctacaacagctataacattaatttgatggattattgtcactgacatcatcaccagcacctctgcttcatcgaccctgacatctctgctgttgctaatggatgattatgttttcgccgacttattatttcaccttcacggttgacctactatgcaaatgctgatgagcgtctttgtcattttcattggttgctacactgctattggctggatcaccgacatcgtcatcttcatcatgtcggttgcgtttgttgtcgtcaactacacaactttatcgctgagcgccttcatattcattgctggctgacctgactgccgccgactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcagatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttacttaactttttaggagttggtacaatgcatcttaaaaggtgtcaaatagtaaagctttatatagctgtcccgctgacttttttatatataagtcaaggtgctgtttgggtttttaagcaattgattggatacaatatcattgcttttcgccacgtaagtgtgcatttttattgaccaatattatggcttaggctgattatatattgtggtcattttctaggcggttggtaaatcctttatgagtttatttactcggattttacaccacatatgccatatatttctaggtgtggtgaaaccatgtgtcttctagggacttaagcacatctgttaaagcagtgtgcgcatggcgtatgcccaatactttggaaattcctttattcacaatatacaagcttctttatagctattttgctatatcactcatcatattttacaaagcagttggtatatcactcggatcatgttatttggaggattcacaccgcatatgctatatattgatatcaagtcacttggttgattacgattatcaaaaccactcggttggttggattatttattccttgactatatgcttggtttgttcacttaaccacatngtcgggggctacacctattaggtgcatctagtcggtgcacctgacttattttcaagccctccacaatcttcagatttggtaaaagtactcgggagaccatgacaaagatgattgaagcactccgctttggagtaatatggttcgagagaagattatcttttcgactgcgaaggtctcaggggctactgtggatattatgggtaccccatacccatacggcatggttatccgactagtcataggggataacttatatctatgggatatgtaatagatcatgactcgggtattacgtttcccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgagacaacctgatcgtcagatcaatacacactcggcggattcaaatccccaaacaggagtagggtattacctctcattgagagggcctgaacctgtctaaatcctttgtcttcgcatccatccacttttaggtctcgtgcgctacccccttttattattgccgaattcatgtttcgacaccctgacatctctggaatcttgagaattattctcagtgaagttagcgccgaaccttatggcaacactgaatcaggggacatacaacaactcattagaaaaatcactacttcccttaagaacaaaaggtatgcaaaattctaaccttcaatcatatattcttatctccaaaatatatggtgtgtgtattataaggccagaccttcaagattttaagcctttagttcattctttgccggtccaacttgctaagtagtccgtgttttcttttacttgcattcagctctcttatgtgcataccattctgcttttcagattttatttacaaatataggtttgaaccatagcaaaaggttgagcaaaaatcattcgaggacatagtcttgccaaacatgaaaactgctcactttcattatgattttttaataaagtatccataagggacacatttcacctaacaaaaatattgtttttgacaagagggaccagattcttggctgttgaatgaattatggtttagctgattcattagtggatggagtctgagaactacccgccttgttacatttctttaatcaaatatccatgtgctataagtgttacaaccatagctacaatcatgcaaaatcagtaacaatggggacacatttcacctaactgagacatgatttagagaagcgagaccagatttgtgttaatttaacaagtcagctttagttgaattattctaggacgacatgagaccgaaatgggaaaaatatcccctttctaacatttatttgatcaaatatttctactgatgcttataataaaaaaattggcaggtatcttattgtgattgatgacttatggaatatagaaagttggaaaattattagatgtgctttttcaagaagtattactggcagccgaatcatcacaaccacacgtataaatgaagtagctgaatcttgctgcttcccacatgtgcatcgggtatataaattaaggcctcttcattttgttgattcaaaaaggttgtttctgaagagaatttttggtctggaggaatgtccatcacacctgactgaagtttgttgtaacatattggcaaaatgtgatggtttacccttggcaactattgcaatatccagtttattggctacaaaagcaccgacagaagatcaatggaatcaagtggaaaagtcaattggttatgcattggaaagaaacgaggatgtcaatggaatgataaggatactgtcgcttagttactttgatcttcctcataacttgcgtacatgtctattatatctatgtacatttccagaagattatattattcataaaaaacggttggttagaagatggattgcagagggatttattcacgaggaacatggacatacattatatgaattggggcagaggtgtttcaatgagctgatcaatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcggcagaagaaggtccggcggctatccctccttgttaatactgaagagtatnnnnnnnnnnnnnnnnnnnnnnnnnnnnnnnnnnnnnn

SEQ ID NO: 18934 - DNA, 7499 bp, Oryza sativa
  unsure (1)..(7499): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgattgatcttcctcataacttgcgtacatgtctattatatctatgtacatttccagaagattatattattcataaaaaacggttggttagaagatggattgcagagggatttattcacgaggaacatggacatacattatatgaattggggcagaggtgtttcaatgagctgatcaatagaagtttgattgagccaaggtatattggcaagttcggtgaggtgaaatcctgtcgagttcatgatacgattcttgatttcatccggtcaaagtctattgaagagaacttcgtaaccttgttaggaattcctaacgttcctattgatcggcagaagaaggtccggcggctatccctccttgttaatactgaagagtattatagcagtttggaggagaataacataaaatatgtcctggataaaaaagaagatgatagcaatgagcaggaagataacagtaacggttttcatatcctaaaaaagttgaatttgtgcaatgctcgattgctaactatttttccacattctgtgaaagtcccatctttgttgcagtttaggcggttgcgtgtgctcgactttgaaggctgtgagcagttagaaaatcatcaccttgcaaatatagagaatttattgcacctgaagtacctcagcatcaaagatacaattgttaatgtgcttccgactcagataacaagactacgatgtttacagacattgaatgtagatgtaagaggggcaattaacattccaacacatatttatcgacttcgacaactgacttatctacttgttgatatgagatgtcaactgccggataaaattgggaacatgcaagcattgcaagagctcaaagttgtgaatgtgcttgcgcagtcactgaacacgctgcaaggacttggtaaattaacaaacctgaggaagcttagtatatttatgcctggccatcacgctgatgcggcagaaagatacaagggtcatatgaaagcaatgatctcttccatatgtaagctaggcagagacaaccttcattgtctaacaattcatatttcatccgtatcagcagatgacttcatccaggaaccatggtgccctcctccattgagtcttcaagaacttgtcatcaatcaggcgccaatgtctagggttccaagatggattggctcacttgtcaacctccaacgattaggtttatatctgaaggaactctcgcaagaagatgtcagtacactgggaggactgccagccctgctctctctcattctctatgtggaagaagtaattacagaggagggaggaaggcttaggatcagcagcagttatggattcccatccttggaacgtatccgaatcggtggggaaagttgcaggcttgagttgacttttgaaattgggtgcttgccgaagctacaacaactgaacctcgaatgcatggtagcagaagaaaaccacaccagcagcagtaatgttgtgtttggcatagagcatctgtcccgcctcacaaccatatattgctgtattcattacaagtatgaaaccagactggccaaggtggctatgctggctgcattggagagatcaatcatcagccatcccaaccaacccacatttacaaaggaggaatatggtgattttgtagatgagtcctgttgaaggcaaaatttttaatgtggatcagttcaaaggcgtagctcttgctaaggataatcatgttacagcaaaatggaaagttggtaggtaatgtgattttttgcaatatggatgaggcaatacattatttgtttcactgcccttctttttctatggcggtccctttacattttttctaatttttctaccttcaatagtcaatactgtcagtaacatatttggaattcgatgcagaagctcaacagaaggctcaatcatgcatgttttaaacaggtacagaatgttctaatttatgttggtcagttaggctttattgtaataatgctgttcttatagaaaaggattgctattttgtcacagttattatacaagtatacaaattggctccatttgtggtctattatgcattgctgtgtaaggaagcccagcatttgtttgcaagtcgtggtctcgagccacatatttgaagtcgatcactgggaaactcttatcctaatctgggttgcacaaaagtccaataaaagattaccattgacgtaggcaacttcccctgtttatagatgttttctagttcttgctgaccaaatggttgctagctagaagctcttttcctgatttggatggctcaatagtccaataaaatattatcatttgcataggtaattcccttgtttacagatgttctagtactctttcttaccaaaggttcacgaggcttgtcgcggcccttggagatgctctctttaggttcactcacatggtatagggtctggaggattagtatctgatttattggtgtagagaactttgttcaggaggaggttatgacgatgatcaacaaagttataagagggctctggaggtatcccatgtgcccatatgcatcatccaagcaagcttcaggaccaattcttattctcaaacaaatcagtttttttttagcttcaaccacacattcttattactgggtagattcagtgagatcacgaatcaccaaaacatttacaaaatctgtgagggggtctacccaaagagtgacctgggtcccaactcacacctagctgggcaagattatgaacaacgctattacgagagcgatggggcaaacgagaccttggagctagcaaagtgaagttgcagaagcagttttatttccgttaagattgttgcaaaagcagtgttgacctgatagttccctcttgcattcactcacatcatctctcttgatgttttttcctcctctttttgtgcatgaatttaagcagggaactggctcctgcaatttcattgtttttatcattggactggtcaatctttctttgtttattcaccctgattgtgtttgctgaagcacttttggtggatatttctgaaaaatttcggataataattagtcaagactatcttttggtttcttgcctctgataaaacaatgggaagtttggtgatctggaaagtgttggtatgcacagtgtgtttaaaactacactaatatgtttttatcatctgtactttttacagctttccctaagaaggcagtaacagaattcaatggcgcctgttgagccaagcaacagaattgcagcaaatggatctccaccctggagctttaaaagcagccaatttgaccttttctttttgggttattataagaaattcagggtgcacacaaacacaatggacgtaaatagtcggtgctttatttatgatttatgtattgtatttaaaccctggcaagaattgctgtcaaagcctttcaatgctctatagtgcacgtgttctctgacctgtgaataaaaaaaactccaacgaataaataaaccaactcgagtattttcacggaaatctattatatccgcnnnnnnnnnnnnnnnnnnnnnnnnnnnnnnnnngttctttgctgaagttaattcgcaaatcaaattttcattgtgtaaaaattaaatcatgagaattatattgtgattgtggttgaaacgctcaagcttgctgtcatttttaaataattcaatctcttactgtcaattttaaatactaggagagctcaggttaggccatctactttcaacctattcaccggatgtggttcgaaacgctcaagcttgctgtcatttttaataattcaatttannnnnnnnnnnnnnnnnnnnnnnnnnnnnnnntcaattttcaattctagcggagcttaaggccatcccggcccaaatgggtgccgttggcgaggagccttgttcacgccgttcggctcgccatcgcttttggagccggagccatctagtgcgctccctagtagaggtacgtgcctccctgtgctcctcggctccttttcatcgagccatgaagctaggctctgtgttgggcgatgtcatgcctagcctcatactcatggacactgctcccgcaccagagatttcttcttctaccctcggccttgtcgctagaagtaggaacacgncggtgggaaggagtcagagccggtgagatgatggaggagctgtcggcggtcctggtgaagatggatctgtgatacggccgaccagatctggcctcctgaccagccgctcgtcgtcgaccaccgcgtcctgcgccccgctcgatgtcgggcatcctgccctgcgtgttgcttgccgtgcggagggagagagaggcggcgacgggcggagggtgagggacaacgtgggagaggggatcctgttaccgacgtggtggatggcgacgagcggcgggagagagagagggagagcgaggcgacgagaaaagatgaggccacatggggtggctggctggcgggcggagaaaaaaaaaagaaagaggagaccaggctgtgaaatatagtagggacacacattgtggctggattcgagtactttcaaacagttgcctcagattttgtagggcccatttaagtgtgtcttccattgggagatatgtatcccatgccgtgtatagtctcgggttgtatggctcacctgaggctacttatagctatggctttcgttggggatgccctaagctatgcagtttcctggtcatcccttgggtgaatctatatcaggctactgggtatttatataatggtagtgcgagtgcgcataggggttggcaagctcggatgcagccatcttatatatcatcataataaggtttaggcatagctacactaataaaaaacgattttcctggacatggacccatttagctagattgcagacggaccataactggtcgtgtctggtaaaataagctcattttcgcgtgcggtccatttaagaggaccgcacggaaaaatcaccgcacgcgaaaataccactctctttccctcctacccactttaaatttcccctctttctctcctctcctcccgagtcccggcggcggcatggcgacggtgcgcgggatcccgcgggcggcggccaacccccgcacggatccggcagctggcggccctcgcgccccgagatctggctcccctgccctccccttccttccctccccagatccggcggaggggagggccatcagcggcagcacggacagaggggagcgcggatccgacaggtgggggacctcccctccccttccttccctccccagatccgccggaggggaggggtgtcgacggcggtggagtatagtaaaaattaaagactatccttaatgataaaatattctaataattatttccttttctatattctcgtacaacaaagtttcattttataaacgttaagtgtcgatgtaaaggcgttatcaacataacaactatccatgtttctctttctttctcgcttttttttccctgtcagcaaacttacctcgtcaacaactctgtgtccactcttagttgccgttgtacatgcccttacggaagtatctcaggtaactcagacgatccaatgtctcagatccaatgtctcagatggattcaacgggcacgaaaatttagtccccgtgtttcacaaatccatctctaaatacattcactgtttcagcacaacagccgcctagctaagctactatatataataaatatccgactctcagcatggtactgaagggctcatcaattcttgcaactactctcaacttgttgcatgattgttggatcgttatggttttcttacaatgtttattttttaaacgaacaacacaggaccatgcgagtttcatatttatataggagtaaaatatatggccggttcttaaacttgagtgaagatgtcacttaagtccgtaaatttaaaaattatacattgcagtccacgatcttgttttattgaatcatatacaactggagaaaccatcttttgtgggttgcgcaaaaaccacaatagccctagttcatccaaaaaccgggactaaaaaccatttttagtcccggttggtcatctttagtccctgttcattcattgtcaggtcgtggtagataccctagtatttttagtcccggttagtgttaacaaccgtgactaaagatcagtactttactttagtcccggttatttataccaaccaggattaaagattaaaaaaagcacgcgcggaagggagaggagaaaaagcacgcatggaagggagagagacatttgcgcgcgggggagagaacaaaaaaaatctctatctctctttctccccctcaatcttattttcttctactagaactcatcattatcatcttatcctcttatcctcctcctcccataggccctcccctctcctcccctcccctcttcgtcggctgcggccggcgggcggcgggaatgcgggatgcggcaggatgaggtgggtagcgggtcgcgggatgtagcggccatagtggagagtggcggtaggcggtggcgccggtcatggctgaggctacgggcggcggggcgcggccgtcgcgaagggcggcggctaggcggcggtgggtgctgtgaatgattttgtgaattttgtgtcataaaattggggatgatttttagatgtttatgtgaatgattttgggatgtaaatttgtggatgattttgtgatgtttgtgtgaatgtggatgattttgttgttgaatttgtggatgattttgtgaatgaggatgattttatcattgagttcggtttaaaatcaacattcaagcagaaaaaacaataaaaaatgactaatgatggctgtgccaggcatgtggcgcagccctctttagacctggttggtgttatcatccgggactaaagatacatctttactcctgggtatttgaaccgggactaaagatcgccatctttgtcctagattctctctcccggtttgtaaaccgcacttaaggggcttccaaaccaagagagatgagggtttctctagtagtgataaccggtccaaaacgcgtttgatcagagctgaccgcctatgtggtgcttcacgtaggcaacatcttacatccagccccctccatatctaaacgtgctactaattttgcacttaccccctattgctactgtagacatcaaaatctcccaaaatatcccaaatcattttggaccggctatggtcagctatgctcccgtacatcttagcctcctcctccatgcacgtcatcgtcttatatgtaggatcgaatcacaacaactaagccaaccaaagggggggtgaatggttggtatacccaaaagtgaatggttggta

SEQ ID NO: 18935 - DNA, 740 bp, Oryza sativa
catccaatctccggcgaggtcgccatcttggtccgaccattgatgaggtcatcatgacgtcatcatcgtttttctttttcctgtttttctaatagattaaatcttcgggaatttcataactaaatcatcgtaactcggttttgagtggttcaagttgctaaattcatctaaaatcaaaatcatgatctacatgtttgtttactttatatgtactgtttatgcttgtttttaactgtttatttggtttttattagtctttttcttggttttgcgtgttagcctgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggggattaaaatatgattaatggtgggttgg

SEQ ID NO: 18936 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnagataccacatacaccgccgctacggtccctaccttggagaggggcccacatcggtctgggttgaacagcttcccaatcctttggccggaagtgaagtgtgcgctcgtcctcaggtggtccctagcgaagtccttcgcctgacacgggggacatcccctatcattccctcatacatttttggagacttcgtgggttcacgcgcgtggggtgcaccgacctgcacgtcgatcccctgctgtcgatgggacggggtatacctgcccccacgtcgcctgatacagggtagggcgtgggtgcgctgccgcctgtcacatccgtctgtcaccgatcgcacgccggtcgcagaccggtcaaggctgcttgacgcacgtcttccggtgggcggttggggcgctgcccataaatgcgcctggcagtccccgcgttcccgcctgctcgatccccctcgcggtcaccacgtggcgccgagcgagggcctcgaggtaaggcagcccctcggggccgagggatatggcgagataccccgagccccctgggggagcgcggacgctcctgggctattcaccgtccgtgcgtccaaccccccgatgtggggcctgggccacgcggccacgtggctgacgggaaaggatccctttccctcagcataggtacccccgggcccatatcaccgacacggcggaaacaggcaagcacctctcccctgctaatgccgtcacctaccg

SEQ ID NO: 18937 - DNA, 761 bp, Oryza sativa
  unsure (1)..(761): unsure at all n locations
nnnnnnnnnnnnnnnnnnnnnnnnnnnnnnnnnnnnnnnnnnnnnnnnnnnnnnnnnnnaaacagctgtggtgactgcctccccccaaaacatacctggcagccctttggctttgagcatgctccgcgccgtcccgaccaccgattggttgcgacattccatgacgccgttttgttgcggcgagtagggcgccgtcgtctcgcgtcggactcccagctcggcgcagtaatccgcgaagtggtggaccaggaactctcccccctatccgtgcgaagagcatgtagcttcttgccgctcttgcgttcagccgcggcttggatgcgcttgatggctgccgccaccccatccttggaggggagcagcgacaaccacatgaaacggctgtaatcatcgacgagaaggagaaagtaccggttgccggtcggagttggtggcgagatcgggccgcagaggtcgccgtggagtagttggagcggctccagggagcgctgttgagcctgctgtgggaacggcgtccgacggtgcttgccggcgaggcaagcctcgcaaagctggtcaacttgcgacacaggcggaagaccgcgcaccaactgctctctggccatttttcgcagcgcagtgaagttaatgtggccgaaccgtgcatgccactttcatgcttcgtcggcgatgcgtgccgtaaggcaaaccgggcgcgcgagctcgacgtcgaggacgtatagacgtccaagattgcggtgaaaaacggcaaagcaggcgcc

SEQ ID NO: 18938 - DNA, 346 bp, Oryza sativa
aaaagaaggagggagggaaattagactttcctcgggcggctagggcgcggcccgagagaaaggggcggctcggccgagcttaatgggccggccggcccaagaaggcggcccaaagcgcgcgcgcgggcggggaggagagagtgagagagccggtgggccaggtccatcccgcgtggtcccgggtgggacccgcttgtcggcgactcggctcaccgtgagcgaggtgcacgcggggcgtgctagggtttttggagggaggcgcggcgcatgcgcgcggttcgcggaggacgcggtgcggcgggcccacgcgtagcctcacggctcaccgcggaccatgcgcacgggg

SEQ ID NO: 18939 - DNA, 731 bp, Oryza sativa
  unsure (1)..(731): unsure at all n locations
gtttgccaatgtgttcatcaaggggtagattgtaaaatcaaagtgttttttattcttattctgtgatgaacaattggcatttgagatttttggttttgaaatttggagattattggtgaagtagttttggagatgattggagttacaggtgatatacaggtgttactggtttgtcaggaccggtcagatcgggcatgtgttgccggtcaaaccagcggtgatcgagtggtcagaccggctcagcccacggtctgatcggcccagcccgtggtctgaccggccgactccggtttcgggttgatttgttcggatagttgtgattgtttcatgtttatggcttctagatggatactatgcatatgtaataccgttgtttactaacaataagtcaagttggagatagcttgatctcggaatatggtttctttgtttgattcatgtgttggtgacttgatgcctcgggagagtattgccggtgatggatcgggagtcgacttggggataaggcgatgtccgtgatggtcagatatcatgcaggatacttaggtgtcacaccccgaactagtcctgagcggaattagcccgtgacgctccaatttaacctgttaatcgataccagtcccaggaaacagtgctggtatcacaggaagtcagaatatcagagnnnnnnnnnnnnnnnnnnnnnnnnnnnnnnnnnnnnnnnnnnnnnnnnnnnnnnnnnnnnnnnnnnn

SEQ ID NO: 18940 - DNA, 439 bp, Oryza sativa
  unsure (1)..(439): unsure at all n locations
tagggcgaattcgagctcggtacccatctacctggaggaaaagaagctgttcgcggcgctcgacgacgccgcggagcgtgatccgggcagctggattgtggactccggcgcctccaaccacatgaccggctgccggacggccttctccgacattgacacaggcatcaccggcaacgtccgactaggagacggctccgtcgtccgaatcgaagggcgaggcaccgtgctcttctcctgtaagaatggggagcatcgaaccctcgccaacacctacctcattccacgcctcgctgctaacatcattagtgtcgggcagctagacgagaccggtttcaaggtggaggccgaggatggcgttatgcggatatnnnnnnnnnnnnnnnnnnnnnnnnnnnnnnnnnnnnnnnnnnnnnnnnnnnnnnnnnnnnnnnnnnnnnnn

SEQ ID NO: 18941 - DNA, 1245 bp, Oryza sativa
ctttttaccatcagaaaatcttagcaaagaatttttcaaataagaaacctatttttccaaattagcacaattttcacaatctaccatgacacctttgcttttacgacacttggggcaagaaagcacttcattgtttttcacaacatcttccttgtactcaacatgacctaaagcgtcctttaacttcaacttattcaaagtacatgttgagcaatccaaaacactatgaggttgttttaactttttagcacaaatcatgttaaacatcaaactagcatgaaaagcaatttgttatttttacaacaactttttagtcaaaaacaactcatccaaagtgcgtgtgtgcaaagcaaatccaagagctagagaagatctatttttcaaaccatgtgcagcattaacatctctaaattttgaaatctcattcattaagacctcacaacttttgcaatcatcatcattgggaataagatattttaatctagcaaattcagaattaagagattcgataataaactcttgttttctatacatcttctcacacaatatattttttgcactcaaaatattaatagctgcctcaagagcacttacctcattgtcttcacactctgaatccgattcgccacgcgccatgaagcaaacaccggagatgttctttcccttatcttcatctctactctcaccatctacatgcttagtggctcaaacgcggcgtagacttgatcaaaagccttcttgagagtctccttgatcttcctccctttgaatgtaccctttggcttgttgtcattggtcttctcatcaccattatcttccttcctctctcccaagcttaggacaacgtgaacgaaagtgatatgtataaccacattcaaagcagcgatttgttccacctcttttgctgtacctaacattggacacagctcgagaaagtctgttatttaacaaaaccaagtcctcctcctcgaactgttcaagttggtcatcggacatggcattaaacaaagcaaatacagaagacttcgatgaagaagcatcaacatccaaagaagttgaggaagaaaccaaagcactcgacttagaatcaactttacgagaaagaaccgtcatctcatgtgttttcagtcttgtgtaaagtgaatccaaagtcaaagtatacatatcaaccgacttctgaatagatgccactttcatctcccaaatagtcatgtcaagaccattcaaaaagtggcgagaaatctc

SEQ ID NO: 18942 - DNA, 694 bp, Oryza sativa
cttgttatatttcaactcgggttttcttgagatctaaacttggaaaaacttcttatgaacttcgatttggtcatcaacccaaagtttcacatttgcgtgtttttggttgcaagtgctttgtcttgaaatctggaaatttggataagtttgaggcacgttctaccgatggattgtttcttggttaccccgcacatactcgtggctatcgtgtacttattttggagactaacaaaatcgttgagacttgcgaagtttcttttgatgaggctagtccaggtactagacccgatattgcaggtacactatcacaggttcagggggaggatggttgtatttttgaagacgagagcaacgacaacgacgatgacgaggtcggctcggccggtcagaccgggtgccaggccggtcagaccaccggcacaccttcggtcagaccgacggaagacgtgcggtaagaccggccagggccgtcggctgagggttctgttgacgctgttcgagatggtcctccggagattacaacttcgactagtactgatacggaacgtggatcaacttcagaagtcgctgctcctttgcacattcaacaacgacatccgccggaacaaattattggtaatacaggtgagcggactacaaggtctaaggtaacgactcatgatgtttgtgtaaattctgcatttgttgcttcttt

SEQ ID NO: 18943 - DNA, 772 bp, Oryza sativa
ctttatagtaagattattgtataatgttgtgatatctttgtatgttaagatttaggatttagtgggttataattttatggtaagataggattccctaatgcattgcagcagtcacgacatatgaagtggcataggtcagcgcatatgttcgaaattgtttgtttgttgaaccggtttgctacataaggattatttgagggatctgtgaaaaaaaacgaagacaatgaaagtcaggaaatgaaatgtgactaaataatctatgtagagaacaatctccggacttacgttattgttgtttgttgtgcatctcctgttgaccctaagcatcttgcacacttaatatccacataggttagtgcctagggttgcttgaaacacaacaaacatgataataacaccagtcagtttaaaaatagtaatgattacaacaatttgtgtgcatggcacacgccattacataccggccagtccgtcttcacatgaagctttttcctctgcacatcctttactggcctgtgatgtttgacataaaatttacgtgctctgtgccgataaaacatttatttgtgttactttcaaatttcggaacggcaattaggtactgaggtggtatgttactacgttgaaattcgaaatagtgaggaactccatataggctttcttggatagtgtgccagatcaagcgcgacgaccaagtggtccctcggatataccgggaataaaatatagtggtcctgcaaacaagatagatgaattagagatgacatttgct

SEQ ID NO: 18944 - DNA, 602 bp, Oryza sativa
tgtggcttatgtggtagtgggcggtggtttttcttccatttgctttagctattacagatgtcatgtaagtgtcatagtatggtccgatccttgtaccagtaaaccggcttagatggaaacaccgatatgagaaggccaattatctagcatgtctttgtcctgaacctacagtttctgtatgggacaaatacacgttaacggatgaatcacgcacaatgatgcaaagtcaaaacaaccggagcaacatcgtcagaaatctgatcacagaaagaggctaaggccctctttatttagactttagactgattggcctagacttttaagtcagcttattggcttatatgatttataagccagtggatttaatgtcctaagtttaatggtagagttatacatctatctcatataagccaaaaaaaaagcttctccaacctagtttttggcttaatagtgttagagtggcttatggtttaaaaaagccaaatgaaaaagctgcttgtttgttttggcttagacttttcgacttataagttggcttataagcctaaacaaagagggcataagctggctaacttgctattaaaattttcatacgttcttaa

SEQ ID NO: 18945 - DNA, 744 bp, Oryza sativa
aaaatatgttcttcattgcatcctctgttcatcgaggtataatgaagtaatgatataagcgaagaagaaaaaaaaagatgataattgctatctctgcacttctgcaggaaaggtgaaaatgccagacaaatcatccatcaattaccgatcatgcattggattgcttgacacaagaatcgatcttgacgagaagatcaaaccagaggatagaaactaccacgctgccctgtcgatcatggctgcaaaactagcctacgagaacgaactcgtcgtcagaactgttgttcagaaccactggcaggtcagtgaaaattcgttcaaactctgcatagtcccaaatcttgaaatcgccgtcacatttttaacctctcctcacgagtctgtttcttctgcagatgaatttcgtgggcttctacaactgctggaatggtaaaaatacaactttttggaaaacattataatgtcgtttgattttttttctagtcaaactttttttaggtatgaccaaatttatagaaaatacagtattattttcaacacaaaacaaacatattatcaaaatatattcaatgttcaatttaatgaaactaatttaatagtttagatgttgcgaaatttttctataaatttagtcaaacttaacaaaatttaattagaaaaagagtcaaacaactttacgaaacggagggagtagtaaattcgtgcacattgtgagttgcatatgccattttcaccaactcgctt

SEQ ID NO: 18946 - DNA, 474 bp, Oryza sativa
ccggactcttccccggtgaataaaaaaaatatcacaccacctgatcgtttcctctcaccgtggcgcggcttctggccgaggccgaggccgtagaaacaagaaaagaactggagaaaaacaagatgccacgcctacgctcccggcacgggacgaacccgagagacaaaggagagagagacctatccactcctccatgcggcatcgcacctcacttcccagccactacttgccaccaccaccaccacccacaccgaactaacctcgccgtggaaaccaaacccccgcgtccgaaccaccacctcgcctcctacccccctcttcttccagccccaccgcgcgcagcagcggcagaccacggcacggcgccgcgcggccgtaccatgccgtgaccggccggaacccaccaccgcctcgaccgccgcgcatatgcaccccatggccgtggctgtggccgccgccgtctcatgcccgcgc

SEQ ID NO: 18947 - DNA, 471 bp, Oryza sativa
tttgtttttattgaaaccaacggcaagaggtcaatcttgaatataatattttaacctttagttggaaatacaggtttgtctagacttaactattcttgctctcaggttatacaattttgcatagattcaaatttaaagtatacaatttcatgatcattataattacgacgcatatctaaatatatacacatggattttatacgggaatacaaagtcgtgcaacgcacgactaaatggctagtgctagtgtgaattacaaattccatctagaattaaagtgagaagaaatgatagttgcttacttgccggagtgcagaatcatccggacgaagccgacgagcggcacggtgtcctcgaggatgaggtcctcccaatccacccactccctctccgtccccttcctcctcccctcctccggcgtctcatactcccccgaaccaccacccggcgaggactccgcctcgctctccc

SEQ ID NO: 18948 - DNA, 977 bp, Oryza sativa
atatattggttctatttttgactgtatcgttgtttagagtcgtatcggcttagtacttcctcgattaggtccgatattccgactaagctggtatttctctaatcacattgttgtttttgattgattcgatatccatcatgtttgtgtagatctattggctaaataggtttttcttatcatcttcgatcttatactgtctcggttaggtctgatctattagattattgttgttaataagtttgattcttgtaaggcgataggtttttatgcaatggccattagagttctagctgatgtgttatcataattttgggcttcaactatcatacgtatcagctagctagccgatatacatgcgaatctacttgcataagatctccagccgatgtacgctagcattaaccatcggacctgcatctaccacattatatcagtattggtcgattggttcattggttcaattctttatatcatccttgttagttgtaggatcaaactaactaatacgtcttgaaccctaaaattaggatttgcactggagttaagcagatctccaaggccttcgtgtgtcacgacatattttgtgtcaacagaaggcaaaactcaaagaaaacttgaagtaggcaattgaagtggatgcgtagcttgcagttgctggatcttgtcgcctagaggcagcccgggtggcgaagttccatgtggttgctggttccggcaaacaatcagtagattcaaggggtagggaggggtatgcttgaaaccatcatatccagttgaaaggaagcagacaaagtgacaccggtctttaaaccatatggggcaataccaggtggtgaagtgctccgacatcaagttgtggacaatgtaagacgacttcaatattgctatctctgtgaaggccatcgccgacttcttgtagaaaagagagtggtcatgccgactcctttgatgttatttttgccttctgttgcagtttg

SEQ ID NO: 18949 - DNA, 689 bp, Oryza sativa
  unsure (1)..(689): unsure at all n locations
tgtcctaatgcagccttgaacgacgccgaacgtagatgagacaattgcgtgggccaacggaacattggactaacccattcgccggagatcgaacaccgatgcagcctcgcgtcaggtgccaagtcccgccggacgataaaataaagtagaaaaggtaaaaggtggcgatgcgccgaattgtattgatcgtgaggatatattacatagaccccgggtgtacatatttatacccatgggttgatacaagtccttgtcagacaagaaagaaactaacctaaagataaaaggaaaatataaagtccttatcggacactaaacacactttcttaaagataaaaggaagctaacaaactattcctaattaatagataaactgtcatgccgcatcctctttaaactcggtcacttaggaataagcttcctttagtagattgatttccttaaccgaatatagcaggaatccgactattggcgacttgataactcccatcgactgattccgagatgctacagccgataatgattctaagccgatgacgtctttgccaattaccaaatttcactattaacaggaatataacaaaggtgattttcaccatataagaggttgttatattcttttcccaaatagtgtnnnnnnnnnnnnnnnnnnnnnnnnnnnnnnnnnnnnnnnnnnnnnnnnnnnnnnn

SEQ ID NO: 18950 - DNA, 927 bp, Oryza sativa
  unsure (1)..(927): unsure at all n locations
nnnnnnnnnnnnnnnnnnnnnnnnnnnnnnnnnnnnnnnnnnnnnnnnnnnnnctgtgagtatatgggtaacatcttgtgctcagatgctcgcttatctgtatttttatagcgatacggatgattatcaattatataagcaagcacaacttattctgaaccgaatagagtatccagaaaaattagtgtataatttctcaaatccatagagattaataaagattacaacaagtaaagatcacatatgccatccattatccatcggcattctcatagctgctgactcaaaactggaagaaaaaaaacaccttctgaaagaaactgtgaaaatatcttactgatcaaaggcagaaaacactttcttctgcacgagctccacgcttagacgaggcgataatctgggaagcttttcctgcaaaacgatcattgatatgagctatgatgacacaaactctagactcaaaacacctaaactgaaggccaggagcgagcgcgattgggaggacgacaccacacctcgctgccgtcgggaagaaccttggcgagcaccgggatctcgtactggtacatctgctcccaatccggattcgtcgtgatgtccctctcctgatcgaaacacaaaccccaacttctcaggatgaaaccccccaagggagagagagcgcaagagccacgaacgtggtctagtctgcttgcctggagctcgagggaggcgagcgagtagggtgtgccggcgagcaggaaggcggcctggagcttctccttgaggccgtcgcagaggcagcacccgggcttcgtgtacagcaccagccttcccgcccgcggcgccggggacgcctcgccgtcgccggctgcggcgcaaagtaggcgggaggcagacctcccatgctgcgagaggcgcagtacgcccgccgcgcgcggaagcacg

SEQ ID NO: 18951 - DNA, 13198 bp, Oryza sativa
  unsure (1)..(13198): unsure at all n locations
cgcgtgttcatgatgggccaggcccacctcacttttgttatgggcccaaaacgcgcaaggctcgcgtgttcccgatgggctaggcccacctcaccatggatatgggcccaaaacacgaacccacaacgccgcgacgtcgcgcatctcctcctcctcctcccccatccaaagcgagcgagccgagggctcgagggctcgaggccggccgccatggcggcatccgctatccgccaatcccaaatctcccccccaactctcccccttctacgccgcacgcgccatccacatgccggcggagctggcggcgcggaccggcggaacctcgtggcgttcggtttccggtaagttttcgctacttccgcgtagacatttgttactgcttgtctggtacactggtacagtccaccatggtggagcacatcagcggtagtgcttatctggaaatgcccttgccacatcgatggtgatgcagaaaaattgccaaacgggatactgcagagtgtcaattagttgatgcaagtagcgggtagaatacactgtggagtgaatatgaacgaattatcatctttgcaagttgaaagcttgataaggatgtgattttatcaccaattaaatgcatggtgttgtggcgtgcgatacaaaagatgcatattactgcgcctgtatttttctccagtgttgataaacagtacgagagagatggttgcaatgatttgtagattggattgcaattctgtagttaattgatggtttaggactttatgtttcaatagttcatttgtcagtctttagtttctcgaatgtatatatcataactatgcagctcaattctttcttgtaattttgcaaccgaagagtgggtattatacacctagttttctggtgaatatatagacaatgtatcaagatgttgttttcttgtcattttcagttcttttctgtgtagcaatgctcgatggtcatatttactgcttatcatcagtataatatgccttattgtcatgcctaccaattcagaaactctgttaatgaaaattgactgatgttggctgagaatgatttcacatggttttcaaatcaagggctctattttccgaatcgagaggattggagcttgtctacaacatttcgcattcgcaagaaaatggaacactgacaagagctacccattggccatattttagtattttgccaccctaatctgctctttacagttttaggatttattaagcatatgagttggggccttgggggatctatgggcctgcttataatgaaatggtgattcttcacaaactgaataggataagtgcatctactataacaatataatgatacaaataatattgcttatgattaagacatgcataaggtgaatttctagcaacattagtattatggtagaactataaactatagtatggatcgactacagtaagcacaacccctgggttctgtatgcatatcatcttaaaggacatacatgctagtgagctctttctctaaaaaaaaagataagggggacatgccattatagcagatggtctaatagtatagctatttgttcttttcacctcagtacattttgaatttggtgctcgtgccagttgttttattctggttctatcattcagttagggtacaatacaaatgcaatcttactttcactatctttttggagattgcagaatagatgccagtaccaatctatcagctgttaagcactatcaagtatcaaattttaatgggtaattgttttcttggtgcagagtggctctagtgcacaaacaaatatactgctgctgtaccttttattgaagtggccacaggagagccatacaggtaccataacatcttgctactactactcatgatttctgaggctgcttttctttctttcttttttctgaaatccttggttacattgacaagcacttttacaccagggtgtttcctaaaccatttgatttgtgatagttctctcaaattttaaacaaattcctgagcaagtaacattgagtcacagtatgaagttggttagtgagagtgtgagcctaggcacttaggcagtacaggccaccatcggttggcttttttttttctaataagccaaaacggcttattagggaataaaaataaatttgtaggtaaaacttttatatatgtgttctttgtaacttaaaagccaatgctgaaaaaaaactacgttgaaaatatttcaaaatcaatttcaaaattaagtttaaaaattcaaattttggcttattctttggcttattggaccatccgatgggagccacagccttcagtgactgatcattctagaactcctccaaacaaagccatcctccttttctcttacttttgtactgggaaagtgaaatcaatcaggtgattgatgcagtctcatttttaaaaagggacaaagggtagctgttgaaatttcgttttctaaaaaattgtctgcgatatagctgtccctaattcccaaaaacttttcaggttactgattcttgattcccagcactttgaatcgtagccatctctaatccctagaccttgtagtagtgactgaataccactgtcaatacaagtgacgatcctagttttgaaagttagatattgaaattctcacgttcctagtagactggaaaggtaaatggatattttaaagaccaagtgagcctcaactctcaactcctgcaaaatacatgtccctcttttgctgaaactttccccgaccagtggtcatgatggcacaacgtagaaagtaagtatttgtgtagtacaattaagtggtcctttgaacaagatattgcctagaactcccatatttttctaatgagcaaacacttaaaagttggaaaccatttctacagtggaagaccaaaatcccctagtaacaaatggcagtagaaaataatctccatctaatctgtcataagttctgaaccttaatactagtagaattctgtttctactgataacagaactcgtaaatcaaccgttggtatcacttcaattcatgataatattggcaacaaaatactaacagtaatgactaccgtaaagttactcaaaattcttatctgctacgaaatcctaatgtcttcaggatcacactacagttattaggctttatttaacgcttcacctaattgaataatgttttttcagatgtactaaaattaagtgggacttaacatgtgtttttttaaaaaaaacacttaggctgagtttgaacctgtaggttcggaacctctatttggcacgaaaaacagagtacctcattaacaaatgattaattaaatactacaataaaaaagtaaaaatagattaatatattttttgaagcaaatttcatatataatttttttcagaaacgtactctttagcagttcgggaagcatgcgtgtgaaaaagagagagtagaagattagaaccatcagtttcgaacgcgcccttagaccataaaggttgtggttatacgacacaagtcataatacaataatacattgatttttttacgaactttgactatgtttaaacatagtgtaaatttgttcggagttgaaaacccatttcaacaccctagaacccgtagttacacattgcagtagaaaatgatccccacctaatttgtggatcctctaatctgctacaaaatcggaatgtcttcagaatcacactacagttattaggcaagcaaagtttatttcccagcagaggcataaactctgccttttccaaagccaggttaacatcaccttcaccccctccctcacatgcaaaacagaaaaaccacagcactcaaaagcgatcgaagttgagccgagagcggctgagcccccgcccccatcacgctaataatcacgcacgcaagaggaagcttccctccccatccactgtcccctgctcctaatgcattccagctctttgccgcgaggatgaaagatcttcccctctttctctctctctctctctgggagataatttattcgagctgtccttctcgctttgacgatccgacgaaccagaaggaaaagaggggaaggagatgacaaaaaacgatcatccctgcccctgtgtgtagcgatcggattgcatcatggggttttttttttttcttgtgcgagctaggctgttaaaccgcgtcgccgtgggggcggcaagacggcagctagtttgttgtcttgctcactcgctgtcttgctgacctctgagagaccggttcttctctcgtttgtctgatgaggtagacgcctgcctgcctgcctgctactgctggtgcattcatgtacatgctgtgagagggacaagagttccaaaatgcgacgataaccgctcggttctcgggtttattggtgttgatgtgttgtgaagttgatccatatttcaaaattatccaaacaaatgttcaattttttgataaaatttgtctaagttccatcgtgtttttatcggtttatcgtggttgtcaatgaaaccggtagggggtagtattggactacctgtcgtatttgtaaattatagggagagatattcctagcaaagtgtgagatttgaaggcgtctttttaatgaaacgtctctctgcacatcgcaatcgactaatcgagcgatgtctaaacgaggtgacgttagtctgcttgaaaaatgaggctggtcatttttggtcgctatctcctctttgatcttggccttttgaccctcctggatttcaggcttgtctacgtagagggttacagaagaccagctgtcactacctcttttgtattgttggtatacgtggcaaattgctagggtgtgttttacttacctgtgtgattatactagggattggtcgtgatcaggttgtgtcatgagaacaatatgttcataccaattctttttctttctttctgatttttttgtcttgcactggcattggtatggaggctatacctactcgtcggcaggttggcttttttacagaccaagttatttaggagatactcccaccgtttcaggttactagatgtttttactttcattatagttaaactatttcaagtttaactaaatttataataaatatagtaatatttatcatgctaaattagttttatcaaatcaataattgaatatattttcataataaatttatcttgtgttgaaaatgttattatttttttctacaaacttggtcaaacttaaagcagtttgactttgaccaaagtcaaaacatcttataacctgaaacggatgaagtacaatagtggacatctgttggtgatgcttttagatactctttgtgtatttttcttttcacattatatttagatagagattatctagttatcaatcacctgaaaacaacagaaatttcactcaattttttttgggtggataggattgcaaataaaccctcaactctaacctcgtcaccgtcgctgtgcatttattgaagaagagtttgtcgtcgctattgccgtcgcagttgatttaccccttctccctcccaaaatccagtgctcgattgaaggtgagtgaaattcatagtaatttcagtcactttaaatctcgcaaatcccatttaaataatatgcaaataacttgtataatttttggccaaaagataactcgtaatcccatttacataatatgcaaaaaacaaaaagttgtacagttttttaccaaaagataactcgtacaatttatttttaacaatgcagaaaatgtaatattgtctataaaaacgggtacatcgttttattgttcatgcatttaacagtttattgtatgctacgtgttctttcaactttttttcatgcgccaaaatgtgagatcggtgatatgaccatgtgtagttgtgtactcatgtatctgtgacatagagagaaggggtttggcaatatctgttacagattgctcggaaattcaccgagattccggcatttccaaacatgcctgactgaactgcataccaatcatgtgagggtaacacagtcaaggcaaaagaaaaaatagaagtcctatgttgatatgtgttcctactttgaccagtgatatcctgcgtaagcagataacgctatactctccttgaacacacacatcctagccaatagccaccatacagaagaaccccagctagcagtgatccatatgctctgcttacctgcctcccggaccagcagagccccttgtccaaatcaacaattccacacccccaaacacacaagaatcaccgtgactgataaaacaagtacagagccgagctgcgaggtatcttctctgaccgagcagatccatctcaccgttctgtcataaaactaatccctttctctaatccctttcacactactaaattttatgcattcccttatatatccctgaattttaatttggatttcttccatacccctttttgtttagttatcgtgagttgactgttgtattcctatcaaaaagtccatttttttcctttggtacgaagaaacatataagattatgaaatacttcatccgtttcatattataagactttctagcattgcccacatttacccacatttatatatatgttaatgaatatagacatatatgtgttcctagatacattaacatctatatgaatgtggacaatgctaaaaaatcttataacctgaaatggaggtagtatattgttggaggatagaaatttgttatttgagactattatatctataagtttattatgcaagatattatttatcacaaaatttacttgtagatatggcaaaactaatatttatttattatagttattaaaaattatttatgtagcatataaatagatttgtttatatagcaaacatgttgtactactatccacaaaataaactacatatacatttttaataattaaaaaataaataatatttttatgtcatatctaagaataaattgtcataaataatatcttgtattataaactcataactataaaagtctcaaataataaattcttatattttacaaatttagagtatttgtttttcataccatagggtaaattagacttcttcataagagtttaactgtcactgacgtaaaaggtatggaaggaatccaaactaaaattcagagatatataagaagatgagcaaaattcaggaacatataaatgggcaaattttcaaagacacgctagaaattttctaaaaaactaatcaacacacctcaacctttaaaaaacaatccaagcacccatcccagaacaagttactgttctttagtcttcatgaccaatcatgtgacatgcgcacacgtactctgtaccacgcatgcacgctgctggcacgatgatatcgtgtgccgcctgcacctgtttggtcagtactgtacgcggtccgagcatgaacaatgtatagtggcctcgaggtttagcttcgaagagagtgtgcaacatagattagagcaaggctaatacagccgacctgttggctataaggttctttgtagccttctcttagcctacccatataatagttagcactttattgttaatacagggcccacttgtctctctcacagagtttcttggtccttgtgtccaagccggctataagtttacagcccgcttcttctctcttctctcctccacccttagcatttagccagcttatagtttaccattatacttgctcttaaagataaaatcacaactgaggatacctcattcccaatgcccggtgatttgaatgggtctagaaaaggatttgcttctcagccttacttttttttaagcaagaactagctctatctattactatattatctataaacaacttaatagtcttcacatataatagttagatacatatttattgcattattgataattggtcacaccttattcttacaaaatttcttagtgtccctgctggaactgattacaaatctatcgcttgtttttttttctcttctcttttctctcctccaactcagtacgaatttgaggtggcaacttctatagctcatctatatcaatttattgtacatgctcttacagtctataaaataatttaactttgatacaaatatgcacattaatcccttatatcataaatcattttataacaatgcactggccctcgtgtcaggtgaacaaatactcctctgtccttcccctagctccattcctttcttttttgttcttcgatatatgcatgttgccgaccttctcaactctttgttgctgttgtcctttttggctctcgatggcaccgtagctctgtgctctagatttggtcactgcccttctgtgctttgggatctgtcctccaccgtcgtcaccagtggtggagctacatgttacctatggggtcagggtttttacaaaatagccaaaagctattgatatttgggttgcaacaacagaaaacttgccatccatccctcgtgacttcaaccagccaccatagtgtctttgtgctccaaacgtggccgccccgccactatgctcaccgagtatcgattcaccttccaggcatagttattaggaccggaccggacatcgaaccggtcgtagcctcggttcgcggtttgattggtttgattggttgaaccactggcccaacacggtttaaataaattgaggtatatagcctaactgcacaagtatgcatagctcagtggtggggttgcttgagtctaaaggggagattgagtgtttgaacccctcaacccacctttttctcctattttcttccctctcccccacgtttcagcctgcgctgggccctttctcacccaatttccccacatgcacccggttctttagcggtttacttgcccggttctttccaaaaactggtggttcaatcgatttttcctgggttgattgcacgttcgatctttaaattggacctgacctgctaagcccctggttctggtttttttgggtcagaccgtcgatccggtcctaatagctatgcttccaggttgctaaagtcaaccgcagggtaccctgatctaggagaagcgcggcggttgtggttgcgagagtggtgtatcaccgccctcttgctcgactccatgagagatactcgatcagatgaccttagcgtccacctccttcccctttcaagcaacagttgaatgttctctcaccataaatcacatcatttttgtcaacccaaccacgctctctaaaagccactcactttttctcatctctcctccacggcaacttgccattgaggcggagccgtaaagtcataagctacggtgggacgttgtccatgccctcaggcgaatttagatatactttaaaacacattaattttatttgaattttataaagaaaacttaacatgaatcagtctaacagtaggataaattttctgtattttaaaggaagcctcaaccttgaagcggcatggcgatcactcgaagtgagtgcagagctagggtacatgtggttgtacggctggggatacacccaaagtcaagatcgtgcaggtggtgggttccggcgtggggtggggggccgagcagcacgtacagctagctggcctggaaaccggctggccgccggcggcggctgccggccgggaccggacggacgcggaccacggtacttgttcgatctggactataatggccgccagtttgtccccgtggtacggaggcgctgtggctatagcgctggtttaagagcaaggtcaataatgcagctaacaacaggcggtaaaacggcccatgtcagatagtgcagctaatattaaaagctagtatgtacagcagtaggctgcactccattttccggtgttagtttttcattttctaatcgtactttactagatcagtccatcacgtgattaggtggtgttaggttggccccacaaaatgtgtgaaaagctgcgctgtagccgggcggtaaaataagcgtcggcttatttctctctcctgagttctctctcctctacataggaattaaatgatgtggcatattttggagcctgtctagtcagcttattgtacctgctctaagggagaaattacatgatgtacatctctcgagtgtgagtttgcgatcactaaattaatagtttgatgcagtaattaactcggactcaatttaattaccagtgaagctagtacttaatgaatatgttgctcgttgttaggcctggtttagtttccaactttttctttaaatttccaactttaccatcacatcaaaactttcatacacacatgaacttccaactttttcgtcacatcgttccaatttcaatcaaacttaaacttttaattttggtgtggactaaccacactcttagtttgcctaagattatggctatcgttggcgcacaaagacagcacacatcagacaaacctatatgcctggtacaacgacagactctaaccaggcaagaggcaaccatatacagttacgcacgccctcatgttgaacacaaatgtctgccacttttgactgaaagcacatgtgacagattaagattggtgtgaatgtgtaaatgtaatgatgattttctatatggacaaagcatgtgagcatgtatgctatcttcagataccctccgatacccttaatgccttgctccggagctgttcttctttttccgtgaaggaaaatgagtcttctcctgaaacatatagcgatttcgtatcaaaagtcgtagttttcaaccttttcagttgctgacagcacgagcgaatgtgatgtagttttcaatcacccaggtagaagcacgtatgtactttccagccatccgttcgcaccagtattgtacgctggctactataataaatacatacgatccaccaaccattacaatcttcctcgactttggccttgtacttttctagatttttttattagattaccgaaacggagtatttaattcatgctttagaaaaatacgttttactcaagaaaaattcttctaccttaagtaattagatcacgcattttaagttaattggtaagcttatttcagtaaatatttagcttatccttatgatcaagctgataattcacaacaatcatatgcagtaatctactacaaattaaataagacctttggcgatgaaggtcatgtacaccattgcatttttttagataatgaaaaaacctactattacacccgggacatggcatatgcatgtatacacgcatgccgtcatagtatagggcatgtttggtttgaaactctaccaaaacattggtagtaccaaaccttgggcaaattttggcactaccaaatttttgatagtatagatttggctccactctattgatttggcaaaaattggttccaatccaaaatgctaacatgcactattcaaaactactaaagaattgttagggcaagaattggtaccaaaccaaaatggcccatattgccatagcgttattaacgggcagtagtaccagtgtacaagtaatcactatggacaaatagatgtggctacagtcctacgcaaggcaacgtcagcgtgaggcagccatcgctatccgggaatctgcttgcagctgctaaggtcatcggctagctaggatagatggatcggagtgcgacattgacgtgctcaatctgatcctcttcctctcgatcgccatcgatcggtatcaactccacgcggtttgcggtcggtcgcaaccctgcctgcctgccagtgcagctccagctagctctcgctatagcatcttctcatcttctctcctctcccctcccccctccctgccgccgcgacatcgacgactgcatgccacgcgcgcgcaccgaattcaaagcgccggttggttgttgtcttttgtctcccctcccctcgcgcccgcgcagcggtgtgtctcgtctcacttttaaaaaatgagttaaatttgataagtgcaattgtaaatttgtcgttacaattcctctctttataaccatgccacttaaattctataaaattagaaccatgctacgaattctggtcaaacttttccttaaaaaaaataactgacacggttacgagtaggcgaattgtaatagcatttatttgaattggtgcatttgcaatgacacatactccctccgtaacaaaatataagtgattttaggtggacatgacacatcctaatactacatatctagacatgagttatgtacaaatttgtagtagtagtatatgtcacatccacccaaaatcctttatattttgggatggatggagtatcaagttaacccttaaaaaaatatagggttcgttcgcacagtttcagctctagttacatcttttttttagccgaagaccaaccagatttagcttcacccaaaaaaggagtggagttgactaaactgctctcacaaattaaactagggaggtgaagctagacttaggcagctccacaatttcaatacagacccaactcctgaagttaaatttagaaattgaaacactaccaaacagactcatagtaccccatttttttaaataatgaactccttcacatgatgaatgttgagtttttggaaatacaccatgttacttattagagaacaagcgcaaaaccatcccggggaaaatgaagttatttgaactaagggagtttttgaggtaaaaccataaatcggtaatagacagggtcggtcaacgaggagcaacggcattgtcgcaatgatttcatccacatgcctctactagcatgcatattgtttgaaaaaatggcgatcctttcagttgccttcgtaaaccgcacaaattgaggtttatagttgactcatagttttttctctcaccggactcactcaaatgttgccatggttttcgctgtcaaaattgagaagcactagcaacaaacttgtcgtccagtgttttcataggcaattgacacccaacctgaattgcacatggttacaactataattaaagtactgagaacccgcctccgatcctcctccccatcttaatccaatatacatggttcgtgcaaggttttggatggtaaccgtgaaatatgtttcaactggaaatcaacaaactgcaacagaaggcaaaaataacatcaaaggagtcggcatgaccactctcttttctacaagaagtcggcgatggccttcacagagatagcaatattgaagtcgtcttacattgtccacannnnnnnnnnnnnnnnnnnnnnnnnnnnnnnnnnnnnnnnnnnnnnnnnnnnnnnnnnnnnnnnnn

SEQ ID NO: 18952 - DNA, 1546 bp, Oryza sativa
catgtatatcggctagctagctgatacgtatgatagttgaagcccaaaattatgataacacatcagctagaactctaatggccattgcataaaaacctatcgccttacaagaatcaaacttattaacaacaataatctaatagatcagacctaaccgagacagtataagatcgaagatgataagaaaaacctatttagccaatagatctacacaaacatgatggatatcgaatcaatcaaaaacaacaatgtgattagagaaataccagcttagtcggaatatcggacctaatcgaggaagtactaagccgatacgactctaaacaacgatacagtcaaaaatagaaccaatatattagatagacatccttttgcatcaacttggttagaatattgtacctatcagagaaagttctaggcacactgatatagacgaagatgatggaaattacttcctcgctgaagatccaaacgatgtagcccaactcgaaactaagaacttgccggaataaaaggtggcaatgcaccgaaagtaattgtattgatgtgtggagatgtctcgtaaagccctagggtgtaaaaatttataccctcagattgatacaagtcttgatcaaacacgatacaagatttcttaataacaagaaaaggaaaataaataacctgtctattcaagatatatgtactaaaaatacaaaaattgcctcgttgtggtcttcacaattccttcttgaactcggtttgatctagataaacatccatctaccaattagttaatttctttaaccaaatccactaaagaaccgtaccaaatttcattaaccaccatggttaatgctgtggtgtttttgggcacaccatagcatagcctcaacgtttcttccactatcctcgagatgaggagaccggatgctagcaaacttgatcacaaaatgagaacaacctgattatgggagatatccgaccagcctacgctcactactaatagtggagatgagcctaatctggcctctccttcccttcacccacgtgaatcgccgagcccgagaggaaaatgggtcataaatgggagttttttttttctacattactttttgcggaagtcagggagggatcgagcaagagaacaaatgtccctcactatctcagaagcaacattatactactcctcttatctaaaaatataagagattttgacggaatataacacatcctaacacttattcagattcacagtactaatgtgtcatatccggttaaaattacttagactttgggatagagagagtacgttatttaaggactggcaagtgcttaaaatgcgatggtaatagttggtacaaacacagaaattgttttataagaattcgggctatttcttagtttttttaaagaaaagcttattccgggtttcaccggtttttaccggtaatatatcgagcggtaatcacagtggaaacgccgttcaggaactgtattcggtaaccgaacggttttaaacaagtggccgtggcgccgcgtccccagttccccacggcacacacat

SEQ ID NO: 18953 - DNA, 5871 bp, Oryza sativa
tctacatatatatatgtagtatatacttaatcaatgtactagtgctactgcttcttgattattttaggctaattctgaattgcgtgggagctctgatgaagctacatgttttaaggcagctttccatggagcaaaactcccctcaattccatgtcataccatgtgtaaaagtggtgttcctgcaattgcaagtaatgaagtataatcaattactatgatgttaattatactcctctcaacttatgtccaaagcataatggtcctttttactagtgcagttatggcatgattggtatctagtcgacgcagaatttccgggatccttacgactgaaattaaattaacttctgtgcgtgtgtctgtggggcccttgtcagtcgtatgcgtctgtcgtatttcagtacccagctttgatccatcgccgtcctctgctgaaaatgctacacttgtcccgcttctctaattgtcaaatccaaaacgttttatttactaatcgagctgatgcggtcaatatttatttttatactgtcacgtatcaactgcagtatgcatctgtatatgtttgcaagaaaagggtatgggcgttgtgagctgtggtcaaaagcaacagagaatttcctttccctatcatgtaaaacagctggatttcgtagcggatcatggcgcgccgcttagattaatcgcagtgtccgtcggagaagaaagcgaccggccaaatctcaaaaaaaaaaagagagggtaaaaacgagaggaggcacgtatcggtctcgtcacgctcgagcccgaatccgcatttcgcggggtaatgcgagttcggatctgaggaaacgagcccgacccgttaaaggcgcgtcgtccagccgcccgaatgcccgatccacctcgtccatagcagcctcgcatccgaacccgagaggccgagacagcctcgcctttgccctactcgtctccttccttccttccgccgccgccgccgccgccgcgagggccatggggtacaccaaggagcagctcctcgcgcgactccaggttggtgccgccgccgccgcccactgggcgccactgctctctacctcccaactcctcgactgttcgctttgcgtcgtttcctggtagtggggatcggctggattggtggtcgtggatgcgccggtgctacggattgtagcgtcggcgagatgcttcccgttccgttctagcttgatttggttttggttagcatagttataaatggaagcgcgatagggcgtttttgctgccgaatttagttgggttgtgctgcggatagtttttttttttttttttaaccccggatgtgcgcatgaatcgaaggccggaattgcccagttatattgtgcgattatcgagaattgtcacatcctatgtgtggcaaactagaattgcttgccttctggcatcacagtggaccgcgactcaatttagtggtattgtcttgtgcaggagctcaacattgaattctcgtgctacgatcacccggttgtgttgacggtggaggaacaggtttgcaaaccgtgaagttcacacttcgttctacaatacttttgatggatttactgtaagtgctaattgaacttccgcaatgttaggccaaacatgttgggcatttaggaggtgctttgagtaaaaatttgctactgaaggtatgtgtcttaccaagtgatggacagttaatttcttggaacctattttcatgtattgatatttttaaattctgagtttcaggacaaaaagcataggctgtacgttgtttctgcccttgctggcaccaaagttgacatgaaaagtaggtgcatttcttgaaaactatatcctctttgttacttatttgaatgtatgccaactaattttctgttttccttaaacccattagttttatcacagcgtcttggtttgggaaaaggtggtctgcggatggctcctgaggaaaatttgcttgaagtgcttcaggtcagccattattcatgtttatctaaaactgcatactgtttgaaagcaacgaagagcgaaatatagtgcatctttcagtttcatatattacgtgaaaatttcacaaaagttaaaaaaaaaattctgcctgtgatgaatattgttggttgtgaaaaaacaaatatcccttcatgtattgtcttgccctttttctgtttcatctttaatgagtacttgaattttggtgcttcctggctctaccagcattttagctggatagcttattgttatagtttcaccctatataattttcttcacatgttaatgtattttgtccttgattatgtccaggtacccttaggctgtgttactccatttgcactacttaatgagtctgcaaggtatgggtgcttgctttcacatgttaattaaatatgattggaatgggaattcggtccattgttgtggaatttgtatttctaatagcttgaagcctttaaacttgaaaaaaaaaaactttgtgagctctgttcactttaccttaaacggtgaagagctatttactagtgtgatgtgctcattttatatccgagcgtcgttgttttcattccacttgatggtttccacttttaggatagaaattagaaatgcaaatgctatggttgtgactgatggaaccacatgcctcttgttttataatgcttagcttttaatgtgtcctattatattatacttatatatcagtttttttcatggttatgctattgcctttttaactgattcatataactgtgtatttgcaagcagtgctgtctcactactactggaccaaggtttcaagtcaaaacagagctgctacttccatccactgacaaatgatgtgacaatcggtatggttgatactatcatcacttccgtaaccaacactgtttcatcacaccatgtgtaatgtcattagttagtcattactgtgatactagaatgcacaccattccgttagttagttatcatggcacagtttcatgtaggttgcacaaggccttggtctggctactgttatattatttttataaggagggagacctccgttcaactttctttacctttttcaaaagaagaatagattagtaaaatggctttcttttcctgatttactccatttcagctctcagctcaagcaatctggacaagtttctcatgtccattgggaggcaaccagcttatgtagacttagaggtaatctttggatcaccggaatatgtgcatatgatttcattcggtccttccgtcccaaattataaggccctcaatatcatactttgatcattaatttcttccataatgttattaacaactacaaaattagtatcatatgaaagtactttcatacacaagtctaaatgttatgaatgcgtaacactaaacatagatattattagcttaattattagttaaaagttaccaatattgatttttcctagaaataagggtgccttatatttttgggatggagggagtatgtgctgggaagggattgtgaaattattggttttgtgcaggcttcaccagttgtaggcaaggataatcctcctgatctagcagattttgtaccatcaggtgtcccaaattctgcagaaccaattgagaaggtcacacctacaaatgttcctcgtcaaaatgatgtgcccaaagagaaaacatgtcttcctggtaagctgttatctactgatatatatattgtcccttgttatttcttctgtatatgcaatctatagtccttacatttgggcagtacatgagcgtagtagtagtgctactataaggaggtactactgtattataacaactattgttaattaaacaagcaggaatagatgacagtgtgaggatgaaacatgtgaacttgttcatgttgtcttttactcattaacctccatttcttttacatttttcttgtgtttttttttattacactttcaagttacaataaccagacatggcatactttgttcttgtatcagaagtgaaggctaagcctaaagttcagaacaagggtgcagaaaagacgcagagcaagatacctacaaacggagctaatgttgagaaatttgtaaatgatgtatttgacatcatgtccccgttgttcctttctgaggtaataagattgtgcatgatgaccctcatgaataatgtccactctttttgttgataaatttcttttgcaggtatcaaagaaactgaatgttaagcaggaagaactttcttctatatttgatggctttaaagaacaagccactattgatttggagagtgtacggttagttctcttctgctatatgttagcactgattgctcatttgtgttcatgataggcaaccgtggtaaataccctagcttccactaatatgtgtcgaacaagcatctgtggtaaaaattaaccaaacaaaaaaaaaaagccatgggcctaagtaaatgttgcaagtcacaatttctttgtgaaggccttcataagaaactttcgttgtggtaaaatcaggcatcaaactgcccacgtttggagtttggtgtggtgatgtacttcagtttgaacttcaataaatttctacctcgttaagttgtgaagcatgtaacggacgcggctgtgtttcactgcagacgagtctgaagaatgcagcatacaccgctggatttgaggctggcttcgagactatgctcaattcaggtttaaaaggacaggcttctcggaagtaaattgtttcttttaatacaatggacataagtcgattcagtgaattttgtatgacatttagtgtaaaatcgatcaaattataaattatgctttcctttgacctgttgtctacttcatgtttgctcaatttttcaagaaggttgagagatcaaccttgtcagttgaggtaaaattagatctcttataagctctctaaatgaaaaacaccgttgaacggacaagcgttggaaaacaccggttaaatttattctccgtgtttgataaactttaaaacgttgcattgagcattacataatttcattgtctgctcaaataggaacattctgcactgccatgtctatcatttacatggtcaacttttacagcagatgttcttcagccatccatcattgtcaccaactttcggaaatttccatggtcgttacacattctacctgccattgccaacaaaacattagttaatcagagcaactttactaatcaggtagtaacaaaaagagaagaatggtagctatcaggttacttaactgatcaaacaggtatttctctttgattgctatttggcgatgatcttcaaatttagaaaagaaacagagagcgccaccaagcgtagaatgctgaaatgagaattgaagaacagcaaaaacttcaaaacaatagcataaaatcaatcaaatcagcaagtgaagccaattcccggaagcccttttcccccttttgttcttccatagtagattcattgtacataatcatgtatgatctcatgggaagagtggcagatgagatcaagagtggctgttgccttttgagtgtttggtcggaggttcaagacttcaagtaaggaaggagaagaagaaaacgcaagtagcgacgagaacaaaagactggagggccgtcatgtcattaccgccggcgtcgcccgcctctggccttcctcgccgtccgtactcccacccgtcgtcggggtcttcgagcccccgcggcggccacatccacgagaagggcccccacctcacgatcgtctgctccctgtcccggccatcgccgccgccgccgccgccaccgttgttggcgctgccgcggcgagctcggctgttggcgttggacccggcggcggcggaggacagcagctggtaccggcagacggggcaggagttgtggaggcggagccacgg

SEQ ID NO: 18954 - DNA, 3953 bp, Oryza sativa
  unsure (1)..(3953): unsure at all n locations
nnnnnnnnnnnnnnnnnnnnnnnnnnnnnnnnnnnnnnnnnnnnnnnnnnnnnnnnnnnnnnnnnnnattcgaataaccgtggacctggaatgctgtcgggcccaaagaggtcaggctggtgactggtcccgtcccgtcgggtggagcggatgggcgggcggaataatgctgcccgtgccggtcacgaatattcacctgcatattcttgccactgtctccgccagtcgttgtgaacgttacgctatgaactggtcgccgccgccgacgacgacgcgaggcatctgctcggagaaatatactcctaccatgagtccatgactttacagtactcgtagagtctcataaacctttcagccaaatataaagtcgacgtattaattggtcggtattttcatatcgaaaatagtagctcttgacccccaaaaaaaggaactgctgggtagctcttggccaataattatttctcataacaaaaaggagatgactaagaaaaaaataagaggtagtgcttgatcgtattcaaaagagtgtacaatacacgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacctcccaaaagatcgatgccctaacaacttggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcgatggcgctctccgaccgctcccgcgagtcgctcctcccgagcttcctctacacctcctccgccgcgaggtccttcgccaccggggccacccgctttcccttcccggtgtccccagcttccccggctccgggtgccgtcgggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcaggtgagttgggggaacgcctggatctgtgaccctgctggctttggcgcttctgggagccctgctccttcgtagatctggtgatatttagttttgttcgatggttagaggaacgtgtggttgcgaacttgtgatatccatctaggaatctaggcatgtcgccatccgtttgcgtaaatccagccgcgcgcgctttgctgtgcatacagctttgactgtcgttaaaatctgtagtttttatttgtcccgtcaatgttcttcgtcggttccaatgtgcttgcttctcattatttagttggcgtagggattgatgaggagtagatactagagtagctatcgatgttaaacatgttcagtactagtgtttctgcagttgaactggcgtatgtagaaactggagagttgattcacctgccctcttatttaagttacactactaatccttcttctttacttggttgcaaattattccgctaccagcaattatatttatctactgttaagttccaagctttttgttagtgttagtgtcgtggagcaaaatgcttgtgtatcttttggtgaagatactttatatttctcactttgataatactttatgtttctcactttgataagtcgattggtgcatctcccttttgccggtctctactttgtttattggaatgtagtttgattctttgagatggttgggtaggcaggtaaaatgatcggtgaatgtgcgatgtccagtcaatgtttgttttaagttgtaattgaaatgtttctattatggattttggactgacaagttttggttgatttttttcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggtaagtataaataacatgtttttatcttagaatctgatatgtggcaactctttctctagttttatgcgccttgacaaatctcattccttgataatgacaggctttacaagggaattgttcctctgtggggtcgccaaatcccttgtaagtattagtcactttgctacattgatattatttttaatgttttcatttatgtaactgctacacgagactggcactaaaacctgatgttccaggacttgcttgtgtgataattctgcactatcttgtttttctttgatagttgcaatatccaacactgcttcataacttgctaacttgtcaactgaattttctgtacaagtgaacttctattgcctccatggctcatgctgatattattcacttttcttttttttattgtcaatattttttttcatagtttatatggtttattcacttaagttctgtttacttattcatggttgaaatttaattcatttagttgaactagggttggtcagattacccatgggttgtcctgtgtccacccctaaacactggctatttcctgaaacaacacaaaaataaacccttcacatctgttactattttctgttggtagagaactccgtttcaaatttccttaaattaactgttctgttttggataatgtagttatcagtttaggcggaagtttactactactaaagtgttttgtagtttctgctatatgtgtagttccgcagattggctatcctcagttagcttttgttaacatttatatatatatgaatatttattgaacactctaaagtatgaaccatcaactgtgtatggattaacagtagctgtcaatgtaacagctatgtaactattatgtgataaatttatgcgtacggggatttgaacacagtgtggcatggcaccaatgagtttttgtttgtttatttttatgagagctatgctgtcatgttatttcttctatgcatccattgaatatttccatcgtgtccagatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgtaagcatgtcttctactaataaaacccattatgtgcaagttttatttcttatcttgatgttactttcatgttggttgactgcatatgaaagttgcatttctgtatgttcctttcatcagagtccatcaaagttgtagttaatgttacataactgctcccatcaaatcttcgtaaacactagaaaagttatagcacaagagaggtttatttctataggcggattattaaaaatagtctgccagtaatgatgatgaacttgtgtggttaaatgagctgtcagtatcctaataaatatgggatatccgatatatttatgtactaagctcgacaggaccaccatataccaagttctatatggaatcaagtttcataca

SEQ ID NO: 18955 - DNA, 3744 bp, Oryza sativa
  unsure (1)..(3744): unsure at all n locations
ccttttcactagaggactgccccttcgtattgttatgattggaactcttactggtgctcaatggggtatttatgatgcttttaaagtcatggttggactgtaagtattccttttgcttgctaattaatttaattgttagaacattaaaaggcttttgaggaatcaaggacttatggcccatttatatattttcagtccaacaaccggtggtgttacgcccgcgcccggtgcagcagagaaagcattgcaagccagtgcttgattcttatgcagagataatggcgatgtattcctgaagatccatctttgttgtggctggaattgtatcaattacttgagtttagcacctaaatcttaattttagtggatgattcttgtgtcatccttttgatgagaggaactcattaatcaggtgaagtaggtcttttttgcccccgggaaagtttgatgcttgatacataataaatttttggacagcaaggctgttagagctcaggttttggcatcacctgtactgaggaatactcacatctttgtgttccttaaaagcatacataccttgaatcaatgctaccctattttttttgttgcaagtcagatatatgtgtgtgaaactgtcaataccaggaatctcttgcttccggtggtgtttcatttctacacgagggctgtgttcgcatgtggatgatgggaacatagtgcctccacacggaaaacggagcattccattagcacatgattaattaagtattagctattttttttaaaaaaaaatagattaatttgatttttttaagcaacttttatatagaaacttttttttaaaaaaaaacgcaccgtttagcagtttgcggaaaaggagggatttaggttgggagaggtccgaacacacccgaggttggtatctaaacaccagttgaatctaaactctaaaggcatttttctgccaagtcggctgccgtagcttgatgtgcttattttgaccaggtggcagaacttcattctatttcctttcttagccttcaggattttcgttttgcaactgtctttctaatctgaccactgtttgcatcgggggcaaaatggaacatgccatactaaaatcctcttgatctcggcggcaaagccctctgaagtctcttgtccaatgcaggccacacagtttctcttctttgtttcgcggttgctgcttgacctaaacctttgattgatcttgacatccagcgctagttgactttcgtatgtgcagtgttgcggcgttaaagcggtttttgtatttccctggtgaaagtcatgcaagtggcgtattgacaatcaggttttctacggctacatcatgtataagcagacgatcttcgtccagaattgtccgtgctcagcgatgctgccgtacaaatgtacaatacatacctgggatgtatagcatgttattatgcatccataatcataacctgctgcagaaggaacgtgcagctatcaaactggcaataggatatgtacaaaatcttgatgcatgcatcaagttgattcggaaaacaattgcaacttgcttcaaactcggcgaaaaacaattgcatcgaaacatgtctactacttaacatcaaattgacggtttgagtgtacaagctcaatgtctagttaacagcaacttgccggttgattgtacatcgacattctggatgaggtcgttgtttagatcatatgtgttactctcactttctcaaaataatcatcataaatgtttatgcaccaagaccaatgataatttaaatcacatcaattaagacaccatacacacattttcctacatatcgagaagaaaagagaacagagaaaagaaagtgggctatagatttgtagccggctgcaacacgtactccaagacgttatatgtgtataagaggtgggaccgggtattagtggtgtagtatatttttatagttaactattgtataaatgtgctattagattagctatagataatttggagccagtagttggctatactattaaactttctcttagcatgcacatattctcctatgctgtattaattgtattttatanaattcgtgttcatgcgattatatgatgatcaatttaagaaattttaaattttattatatgattatcaatttgggaaggagggagtattaatactgcttctgatcatagatgatgccttgagaagcctcagttacaggagaaaaaaaaattgctatctgagcgatccatgtgatttgtttgtgctcatgattaagaaagtaaatcagccgggtttaaaaccaagtgcggttttcctatcacgtccacttgcacgcctgcacgttggttgctaactaatcaaccaaatctgcacgcatgtgatgagctgcggatcatgtgccgatctccacgcaagcactacgctacagcgagcggcgccggagaaggaagctgctgccgtcgtgctccggctggccggccggtcggccgcgacgccgcgtacatcacgcgtgacgtcttcacgtatcacaccacgttaaacaagctctcgcacactcattccagagacgagtaaacaacagagaaataaatggagatcagcatggtgcccctaccttgcctagcctccaacggacaaccatataatttgtagttaagtacctccctgaacaagagatacatttgttaactagagttagagcaggtacaatagcagactattagtcagctgtaaacatattttaatgagataaaagatgagagagaagagcagtggactccaagacgcaatatgtgtatgataggtgggactatattaatagtatagtaagcaactattgtatgaattagctataaataaattggagctagtagtgggctatactattaaacttgctcttagacgaagtacaggcgtactgatgacgatgatgatgttgatcgtgcagttctctcgatctataccactgtaacctgcccacaaaaagggtcaggttcatatgaccaacccttcatatattttggtttatcccccctttcaaaagacgctagctctcctcactgcttgtgatctattttgtcaggacccaggattgattccaccttataatcaccataaaatatgtgatcatgtactaataatactactcctcctaagtctaaaatatccaccaaactcttaactaatcagcaaagataaccaacacactggctggccagtagacatgcatatgaaaaaaataatatgattgcttcgaatcgaaccgctccccgcgttgccggcagccgattcgatggatcgccacgttcaaacgccgccgttggctcgcacaaagaatcaaggctttcccttcgaacttccaaaaattcggtcacaatatgcatgtagcattaggggttggtttgttttgaggcctatattggccttaccaatatttagcaatttcaatagtgtttattgtctatttggtgtggagctaaattttgacatgcctaagaaaataggccatttcaaccgttaatttaggctattttggcttcaatccaaacacaatttttcctttgccaaaattagccatgccaaaagttaccaaaatttgacattgacaaaaattggtaaggccaatttaggccacaaaccaaaccagccctagatatagacaaaaaaaactaattgcacaatttgcatgtaaattgcgagacgaatcttttgagcttaattacgccatgatttaacaatgtagtgctacagtaaacatt

SEQ ID NO: 18956 - DNA, 17695 bp, Oryza sativa
  unsure (1)..(17695): unsure at all n locations
nnnnnnnnnnnnnnnnnnnnnnnnnnnnnnnnnnnnnnnnnnnnnnnnnnnnnnnnnnnnnnattaggggttggtttgttttgaggcctatattggccttaccaatatttagcaatttcaatagtgtttattgtctatttggtgtggagctaaattttgacatgcctaagaaaataggccatttcaaccgttaatttaggctattttggcttcaatccaaacacaatttttcctttgccaaaattagccatgccaaaagttaccaaaatttgacattgacaaaaattggtaaggccaatttaggccacaaaccaaaccagccctagatatagacaaaaaaaactaattgcacaatttgcatgtaaattgcgagacgaatcttttgagcttaattacgccatgatttaacaatgtagtgctacagtaaacatttactaatgataaattaattaggcttaatagattcgtctcgtagttgacagacgaaatctgtaatttattttattattagtcaatgtttaatattttaaatgtgtatccgtacacttaaattttttttttgaaaaacaggcggcagcgacaccaactctctagccgcacgctgcactcgcgagtcgtcgtctcgccgcattattattttttttcttcgtctcttgcacacgcagatcccagcgcggccaatggcgccacccgagtcaaccccctctcgcggcacaaacccacccaccccgcaatcgcaatgccatcgcgtcacgccgcctgccgctcccgcctcccccatgagatgacccctcccccgccgccgtcccatgtgctcgccaccgtcgatgcggcggcatccgctgctccctctcctcgccgccgtccttgtcggcgccgccgtccgcgccgggaagatcgccacggaggtggtcgtgccggacttcgtggcgtcgtacctgctgttcattgacacctacggcgtgttcctccagtccggcggcggcggcgcgttccaggccgtcgtgtacaacccggcggggcagcaggaccggtactacctcgccgtggtgcacgcgccgtccaagacctgcgtctgggtcgccaaccgcgacgcgcccatcaccgaccgcgccgcgccgctgcggctcacggcgagggggatctccgccgaggatcccaacgggaccgtcgtgtggtcgacgccggcgttcgcgtcccccgtggcggcgctccggctcgacgaatccggcaacctcgcgctgctcgatgggaggaaccgcacgctctggcagtcgttcgaccggcccaccgacgtgctcgtgtcgccgcagcggctccccgtcgggggcttcttggcgtcggccgtgtcggactcggactacacggtgggcggctaccggctcgacgtgacggcggccgatgcggcgctgacatggaacgggtcactgtactggctcctgtccatcgacgtcaaatccaccagagatcgcgacggcgccgtggcgtctatggcggtgaacggcaccggcctgtaccttctcgccgcggacgacaccgtcctcatccagctccccttgccggacgccaagctgcgtatcgtcaagctgggcgtggaagggaagctggtcatcacaagctacgcttcggcgaacgccacgtcgccgtcgccgacggacgctgggttcgtcgcgccgaacagcgggtgcgacctgccgctctcctgcggcgcgctcgggttctgcgcgcccaacgggaacgcctccagctgcacgtgcccgccgctgttcgcgtcgtcgcatgacggtggctgcacaccggccgacggctccaaggcgatgaccgtcgcctcctgcggcggcgccggtggtgatgccgccccgacctcgtacatcagtctcggcaatggtgtcgcgtactacgccaataggttctcacggccagacatggtcggctccaacgggtcgtcgtgccaagcactctgctccggcaactgctcctgcctcggttacttctacgacgagtcgtccttgtcttgcttcttggtgcagcaccagatcggctccctggttaacgccaactcgaggcgaggcgacatggtcggtttcatcaaggtccagagctcgcagtcaccggggtcgccgagcggttcatcttccaacaacagcacgctcatcgccatcctcctgccgacgatcgtcgcgttcgtgctcgtcgtcgtcgtcggcgccgtcatcgtcgtgtcgtggcgcaagcaagagcggcgcgcggggaggcgggcctcgcgatccagggacgtgcagctccggcgccaccgctcgccggcgtccgactcggcgcaccttgtctacggcaacgacgacgacggcaacgacattgtgatccctggactcccgacccggttcacgcacgaggagatcgaagacatgaccaacagcttccgcatcaagatcggcgccggcgggttcggcgccgtgtacaaaggcgagctccncgacagctncgncgtggccgtgaagaaaatcgaaggcgtttggatgcagggcaagcgcgagttctgcacggagatcgcccgtatcggcaacatccggcacgtcaacctagtccgcctccgaggcttctgcgtcgagggccagcgccgcctgctcgtgtacgagtacatgaaccggggctcgctcgaccggacgctgttccgggcggccgccggccagccgctcgagtggaaggagaggatggaggtggcgatcggcgcggcgagggggctcgcgtaccttcacttcggctgcgaccagaggatcatccactgcgacgtcaagccggagaacatcctcctcgccgacggcggccaggtgaagattgccgacttcgggctcgcgaagctcctcacgccggagcagtcggggctcttcacgacgatgcgcggcacccgcgggtacctcgcgccggagtggctcaccaacacggggatcaccgaccgcaccgacgtgtacagcttcgggatggtgctcctcgagctcgtgcgcggccgcaagaaccgcagcgagcacgtgagcgacggcgccggcgccggcaccggagacgactccaactcctcgaacgggacgacgggcagctcgtcgcgcggcgcccggagcgattacttcccgctcatggcgctggaggggcacgaggcggggcagtacgccgcgctggccgacccgcggctggaggggaaggtggtcgccggcgaggtggagagggtggtaaaggtggggctctgctgcctccacgaggacccgcagctgcggccgagcatggcgatggtggccggcatgctcgagggcaccatggaactgtgggagccacgcgtgcagtcgctcgggttcctccggctctacggccgggggttcgccggaccggccgacggctcgggcggcagcggcggcggcatcaagcaagccatggcgggttccaatggggaccacacaaggtcggggacgacgacggtgacgacgatgagcgggtggccgtcgtacatgtcgtcgtcgcagctctccggtccaagatagggcggcgcacaccggcgagaagattgtgttgttagagatagattatacggttgcattgatcattttggttgatttgtaaacagagggattaatttgtgcattcgtgaggtctatacaaattttgtcctgttttcccatctgcttttctcaagaaaaatggaaggataagtgagtttttttttctttttgggttgaagccgatgaaatcgaactgcctggttggtggaaatggttgaccaagtgaatcagtgatcaaaaaattctaaaggagttcgtaaatgttttgactttcccacatctctcatttcaaatggattataaaactcaacatatatgggacgggattttcatccctccaaaagatgttgtctcgttacatacatgttatttaaatagttataaaatttttttaaaaaaattgccatcacagattaatatgaaatgtatcactccataaacatttgtggagtgatatattacatattaatatatcttataatttttttaaaaaaaattataattatttagttgatatgcacgaaaggaggggatatgcatgtgtatgcctttgtaagtttatcgtgtgccatgcaaatacgccattcgcgtcgattggtactcattggtactatttacgagacctatttagttgatatgcaagaaaggaggggatatgcacgtgtatgcctttgttagtttatcgtgtgccatgaaagtacgccatttgcgtcgattgttactcgttggtactatttacgagatctgaacaagcaactgaattgcatgcgcgatgcgtgcgaaatgaaggacgaaacggaaaaaggcaagttttccgcctagtctccctctcgtcctctcgttgccgtccccgtcgccgtgcatcagatcatttcatcaccggcaagtgcagtcgcccctttaaatctcagctccacttgtctcgttgccgacgcgtgtgtttgctgagacgccattgtcacatcggttgctgcttccttctcggaagatagcaccaccagaggtcgtcgttgggttgtaatggcggaggtgcagagcgtgcaggcgctggcgtcgtcgctggcggcgctgccgccggagttcgtgcgttccgagcacgagcggccgggggcgaccacgttccgcggcggcgacgcgccggagatcccggtgatcgacatggcggcgcccgagtccgccgcgcgcgtggcggaggcggcggcggagtgggggctcttccaggtggtgaaccacggcgtgcccgccgcggcggtggcggagctgcagcgcgttgggcgcgagttcttcgcgctgccgcaggaggagaaggcgcggtacgccatggacgcgtcctccggcaagatggagggctacggcagcaagctgcagaaggacctcgagggcaagaaggcgtgggccgacttcttcttccacaacgtcgcgccgccggccatggtcaaccacgacatctggcccagccatccggctggctacaggtacgcgtctccatccatacatagctcgccatgcgcgccggaagcggaagctaatggcgaccgggcgcggcagggaggcgaacgaggagtactgcaagcacatgcagcggctggcgcggaagctgttcgagcacctgtcgacggcgctgggactggatggcggcgccatgtgggaggcgttcggcggcgacgagctggtgttcctgcataagatcaacttctacccgccgtgcccggagccggagctaaccctcggcgtcgcgccgcacaccgacatgagcacgttcaccgtcctcgtccccaacgacgtccagggcctccaggtattcaaggatggccactggtacgacgtcaagtacgtccccgacgccctcatcatccacatcggcgaccagatcgaggtacgaagctctcttcttcctcctcatcttcgcctcccgcgcattgcgtcgaacacctgacatgcatggagctgccatgtgatgcgatacagattctgagcaacgggaggtacaaggcggtgctgcatcggacgacggtggacaaggacaggacgcggatgtcgtggccggtgttcgtcgagccgccgccggagcacgtcgtcgggccgcacccgcagctcgtcaccgacgggagcccggccaagtacaaggccaagaagttcaaagattaccggcactgcaagatcaataagctccccatgtaaatttgtaattgggccatggaaacatcgcccccatgacacccaagtaccaagagtgctattgctggatgtggacgctgctcaatgtgatgctagttaagttgctctgattgctaatctgctgctttctgattcgtaatcaccttcggagcatctaaattcagattttaaacaaactctttctgaattgccttccatgccgacaccggcatgtaggccatttgatgcgatgggagcatggagtaatgtttttccatctcttgaacagtacacccgaaagttgacggagaatgggtcgcttgatggtgataaaatcggacgattcattccaccggcctacaaccaccatcaaatgatttgtcgatcaccgccttctctccctgcatgattcccttctttctctctctccagtctctcttatgcatataactagttttatgtttttctttcaaattatttattcgatctataatatgatatagtcactgtaactatatttttataacaaaatatgacatgactatattctgatgataaaaatatacatgtttcaactgtttagatatgaggtttcactttcacatgaaagaagttaatgtttcaattgtaaatcaaccatgtttagatatgaggtttcactttcacatgaaagaagttaatgtttcaattgtaaatcaaccatgttgcgcattttaagtttttggattacaatggatccgtgcttaatgttgcataatagttattgagatgtttcactagtttgtttgcaaatgttgcacgtaatgttcttagagtgtttcagcgacactagttcatttgcacatattgcatgtagtgttctttgaatgtttcagcatgcatttcgttatgtttcagcatttacaattccatgtcgcatgtatgatatgttttaattaggagtataatcataaatttttaatctaaaatataatcacttgagattctgttccagagattcagttgcaataaatataatagtgtaattagattttaaattggataagtaatttaagagagaaatggtttagttgaaaagttacttggagagagcatggaggaagagagctatagcactatagattttttttaattgaaaatataagcatgcagaggcaaaggaaacatgcatgcgacaagacaggcatcaagcatccattggagaagaggagggcgtccgattttgtcggagaaaatttgggcgcccgatccatagtttcttcaaatattgtcgtagaaaatcaagagcttttaattatctatgtgatttcaatatgtcaacgcattatattatagtcttgccaaaaaaagaatcatctaaattagagccaaatgtgtctcgattctgtttttgaagctaatgatcaagtaaatcgattgtctggtagtcttctgattggcaaatttacagttttttagcttgcctcggacgttagtgtaccagtttgcccaattttcaaattcttacattaaaatgcgtctacctactaaattcttgtatcttgtacaagtacaatctggcaataatttcaatcccttcctcccttgccactggtgaggtcgaaggggcgccatggcaggtcctaggatgatgaggcaaccgtagatctataggggacgcaactcctgagggaccctgacaaatggggtccagcatcatgagtccacatggcctaactcaatgctttctaagagcaggtacaatagcagactatttaccagctataaacatatttttaataagataaaatatgagagagaagagcagcgggctacagatctgtagccagctgcagcacggacttcaagacgcaatgtgtgtatgacaggtgagaccatatattaataatatagtaagcaactattgtatgaattggctattagatcggctatagatgaattggagctagtagtgggctatactattaaacttgagttgggatcctctcctgtaatgcatgtgcagtaagtgccattgacatgtgggcccggaataggtgggacccatatgtcagtgacacgtactgcaggtgcagtataacagtggatttgcattgctctaagatggagtcagggatctgacgagttgatgactccgacggcagccatcggagacggaagggacggaaggagagctggaggctggagatagtgtagtaggcttcttttctcagtaggtctttgaggcccaacaactaatggcctctgatttcgttaccgctgggccgtttccttgagcaccggaggcccacatcgagttgttatggaccttttcaggcccatagtcttcgcgttttggatcgaggaaaggcccgtatcagaacgttcagccatttcggcccaccccaatatgggtcgcaaccactggtaggcggtagcgatccaaatctggcaatccctggccccatggacatcagattccacggcggcaggcggcagaatggacattccaatatgccatcgtcttcgtctctcgtagtctcgtgaagaaaagatcacgtttataattgtacatacatgttactatttacttactgtgttaactccgaattggatcgacatgtcataccaaagttaggttcttgacgcagacggtttcagtgaccaaactggacaagcagaggtgtcctggttatctgatacgtacaggccagattagcattgacttggcatactctggagcaggcaaaattcacagaatcgcttttactgaccagattacaccatcattaacataataaagatgcttgtacagtcaggggcgaagctatagcaagttattggggtcagtagaccccgatgatttcttctgagtcccttatactcctttttattttacagctatgaccccggtcaaagaaaacactagaccctggtgattgtttcgttaaagctcaactggtggcaaggaacgataccattatcagctagcaaatagaaaattagttagcaattgtgattatatatcagtctacatagatatacatatacattttagactggcgctcataaagtggcccttatttaggattaattgctccagtagccaactaatcctattattatttcttgattatcatcacaatttggttgaacctagtctctcaagtctgaatttgaggaaattagagttttgaaatataaacgtctgatttttcaagttcagttacatgatcatgatgcatgagcctgggggaattgttgacgaaaaaatcgaacacaccggcctgggagatctgcttagctcctgtgcaggtccaaaaattaatgaggtgcgggcgtgccagtcagtttgatcctacaactgacaagatatgtaaatggtagatcaaaacagccgatcggctgacaagcctatggagtagttccagccgatagccgataatagccgatgccgataccagccgatagcgatagggtttaagcaatcggctatatgtccaatgtagataatgatataaaggcaaacggctgatgatgatgtaataaaataacaatacaatccaatataaaccaatcggctagcaatgatatgataaataagcatcgatccgaaagttaaagcatacatcggctggaggtccgatgtcataaaatccacaagattatatttaaaaattaaatcttattgcgatcggctaaatccaatatgtatgcagtccttgtaagccgatgcaacgtccagataactcatcggctgaaaccccgatgaaacccttattggcaatcaagaagcagactagaaattatggttctaagcacgacttagtagatcaaacttaactgatgtagcactaagtatgaaaagaaacacaatatctagacaattaagccgttgactgattttcagggtggtagatgcctaggctaatctaatctagtaaggcgatttaaccgatactggcagaaaccctaaagcgagagatagccgatagaactaaattgagatgctaggactagattaacatagacatatgataaatagccaagcaaatatattatctaaaccagagtaatccaagaggtcgaatgtcctgatgcagccttgaacgacgccgacgtagatgagacaattgcctgggccaacggaacattggacttaccccttcgccggagatcgaacaccgatgcagccctgcgtcaggtgccaagtcccgccggacgataaaataaagtagaaaaggtaaaaggtggcgatgcgccgaattgtattgatcgtgaggatatattacatagaccccgggtgtacatatttatacccatgggttgatacaagtccttgtcagacaagaaagaaactaacctaaagataaaaggaaaatataaagtccttatcggacactaaacacactttcctaaagataaaaggaaactaacaaactattcctaattaatagataaactgtcatgccgcatcctctttaaactcggtcacttaggaataagcttcctttagtagattgatttccttaaccgaatatagcaggaatccgactattggcgacttgataactcccatcgactgattccgagatgctacagccgataatgattctaagccgatgacgtctttgccaattaccaaatttcactattaacaggaatataacaaaggtgattttcaccatataagaggttgttatattcttttcccaaatagtgtaacctagtacaataatgatgtggttgtaattgaggccctgtttagttcccacacaaaaaatttacgccatatcacatcgaacgtttaacacctgcatgaagtattaaatataggctaaaaaattagctaattgcacatattgcgactaatttgtaagacgaatcttttaagcctaattgctccatgatttgataatgtcgtgctacggtagacactttctaatgacagattaattaggcttaataaattcgtctcgctgtttactgacggattatataattagttttttttattagtgcccgatcaccccatgtgataccctatataatatccgatgtgacacgctaaaactttacacccctagatctaaacaccccctgatatgtaaaaggtaactactactacaacaatagacttaaaattattagaagctatagccaattgttaggatcgttaattaatagtgaccccggtgaccatctatcctggcttcgccctgattttactatgactaatggccagatcactgaagaattgagatttttcctgagctgcttctttgcatatttgctagtagaagttgttactaaggcgtattcttcttgtaagcgacgctttacgtcgttatcttgtaagcgacgtccaggaagaccaaagactcgatgctactacattgccggtctatttttggagacgtggttatctacttattttccatttactaatgatgtctagtgctttttcagtggagagtaagatccaaaatggttcatccatttcgtctgaatttgcgagatatacacacaaagtgacatacacctgtttctgtttggaccataatttccatgtggatccacatccactgtatcaaacagcacacacgtagttgaagtgagtgtagcacgagtgcacaactggttaggtttcttgtggtgaaaccaacccaccttgatacaagttttaaacttaacacagtactcatttatgactaattatttttttagtgagatattcatggtgacttcgtcgattttaagatatatcggcataatcttctaaacgtgctcataggggtagggtgtgcgtgtgtgtttaggcgggatgagtctgcgtattatgaacgcttacaattgtaccgtgtttctaaaaaatactgcacacgtgtagcaatttaactatgaacaaaaacatcacaccatttttttaagtaaaaacagtaggaaattaaggacaaattcttaggagtatcacgcggtgttttccaccaaatttgtttgcttgaggagcccggcggggatcgaatcgaacgccaagaccaagaagaaatggaaatggaagagaagtagctagccagccattgatgcctcgttagttgggagatcactccaatgcttcgtgagcctcacgtaacagccggtgatgcatattgcatagctagtttctgaccgagatggtggggggtgaaggaacgcatcaagcaataatcgagctgcagcaactggggtggcttgttacggatatggtgatagcttccaaggatgaaattgccatgtcactctcttaattgcttctattgaatcattctttcaggactcgttttccagccaaatgataccccatctcgatcgataatacctatgtctactgctgacgaaatgtacacaaactttttttgccgccagctgaacaatgcctatactagtactagtagcaaggttatgacaaaggaatcgcattgttaattgtcagataaatctgtagttaatgatgaactgttggctaggtcgctatcgttgcacgcatgacaggcgcactagctagagatcagtacatctacgcttctccgtgagaactgtgactggccaatcccctttatgctgagaaatattgcaagaaagaaacttaagatgcacgtcgcataccatgcacgcacagcaaaaaccaccaaataaactgttacgaaattgtgaaatgcctcaggatttcaaatatcgcatcttacaaatgtacgcaaaaacaagagtctgacttggctgaaaaagatattgtgtgtgtgtgtactcgcgtggacatgaacacggttttatatatcatcgttgatcggactgatcactttgaactggttaattaaactcatccaagctttgcactaatctcatacgctaattggcagagttgacacggctaggtcagctgctaattgcgcttatatgcctctacctaattgcattgcatgaccacttctatataaacatcgctgtgcttcgacgtacgggaagagcaacgagctgtgtcgacgctagctaagccaacaccaacgaagattcgaagctcgcggttttcttggctttggtcgtaagcatcaaaaatggccggagctggagaatacggcggcggcggcggcggcggcggcggcttcggcggcgacttcatggtgctgcggccggacaagggcggcatcggcgacctgttccacctgctgtggtcgtgcaaggtggcggagaacgccgccgtggactgccccatcggcacggagatcgccgagcgtcggcggcggtgggcgctgttcgtgtcgctggtggcgcagatgctgctgctgtggacgaagaagccgatggcgctgctcggcggcgggacggagtactggatgaacctcctcaacgagaatggcggcagcgtcttcatgctcatcaccaacgctctgcaaggtacagattttaactctgtacaggttaactagctacctagctagcttggcttgcatgttcttctgcagttaaacttgcaagaaaaacttgctcctcgtacaaatacagctgtcagttacatttatcacggcctcgtagatttgcatttatgattatttcgctttcacgttcgtgcgtgctccgatcttgagtttgctctgcatcacagacaagaacatttcctcgtattacaacgtagcagtatacagctagcagctaacttccatcctgatttctactcctagctagtgttcaatgttacaaagcaagggagactcgatatttaaggctgtttttcagttttttctaagcaaatttatcatattccgtgtttctgggctgcttaattgattgcgcttctctaattagatatgcaaaaaaataagcgctagttttttgtttttttttgtcgtttttgccctatcattttctatttcaacagttgaagatttctcgtagactagctacttaaaatatgttcttcattgcatcctctgttcatcgaggtataatgaagtaatgatataagcgaagaagaaaaaaaaagatgataattgctatctctgcacttctgcaggaaaggtgaaaatgccagacaaatcatccatcaattaccgatcatgcattggattgcttgacacaagaatcgatcttgacgagaagatcaaaccagaggatagaaactaccacgctgccctgtcgatcatggctgcaaaactagcctacgagaacgaactcgtcgtcagaactgttgttcagaaccactggcaggtcagtgaaaattcgttcaaactctgcatagtcccaaatcttgaaatcgccgtcacatttttaacctctcctcacgagtctgtttcttctgcagatgaatttcgtgggcttctacaactgctggaatggtaaaaatacaactttttggaaaacattataatgtcgtttgattttttttctagtcaaactttttttaggtatgaccaaatttatagaaaatacagtattattttcaacacaaaacaaacatattatcaaaatatattcaatgttcaatttaatgaaactaatttaatagtttagatgttgcgaaatttttctataaatttagtcaaacttaacaaaatttaattagaaaaagagtcaaacaactttacgaaacggagggagtagtaaattcgtgcacattgtgagttgcatatgccattttcaccaactcgcttaatttgttccattttttgtgcagaattccaggaggactacacgacccaggcgttcatggtgtcggacaaggcggaggacgcgagcctcgccgtggtggcgttctgcggcacgaagccgttcgacacggagcagtggtgcgccgacgtggacttctcgtggtacgagatccccggcgtcggcaaggtccacggcggcttcatgaaggcgctgggcctgcagaggaacggcggctggccggagcaacccaccggcgccggagacgacggcggcagcgacaagaagccgttcgcctactacgtcatccgcgagcggctcagggcgttcctggcggagaacccgcgcgcccggttcgtggtcgccgggcacagcctcggcggcgcgctcgccatcctcttcccgaccgtgctggcgctgcacggcgaggaggacatgctggcgaggctccacggcgtgtacacgttcgggcagccgcgcgtcggcgacgaggggctctgccggttcatggacgggcacctggcgacgccggtgagccggtacttcaggttcgtgtactgcaacgacatcgtgcccagggtgccctacgacgacacggcccttctgttcaagcactttgggacgtgcctctacttcgacagcttctacaaaggccatgtcagtgtccaactctagtctttctacctatagtactacggatctaatatgagatgtgacacattctagtattataaatctagatagatatatgtttagatcttataaaaaccaacttagtatcagatataatacatcctaatataatatatttgaatatgtgtctgtttagatttgtagtattagaatatgtcgcataggttgtttttttattaattgagcgagtacgttgttagtagtgtagggccggcctgttgacagattgcattagattgggttgtttcttggcatctaatccaatcccctgaaagagcttggaaaggggtccagtgaccaatatacacacggtcatgttttcaaggcaagcaagcatggcttgcaagcaagaatttggtgttaagaacaatagaaagtgagaagcttcttttctcgtcatgggcagcatccttgccttgcttgctgaaagcctggaactggagcccactttggtgtgggatggagagaagaggatgatgctgcaaactgtgccaattggcagatgcagcatgtgctagttgtagcccacaactgtgttccaactgaacttggtgactgacgaggattggtgttgtggcgatgcaggtgacggaggaggagccgaacaagaactacttctcgctgctgacggtggtgcccaagtacgcgaacgcggcgtgggagctcgcccggagcttcgtcatcggctatgtcgacgggccggagtacggtgagggttggctgatgaggatcgccagggccgccgggctgctgctgccgggcctgccgccgcacgcgccgcaggactacgtgaacgccaccaggctcggcgccgcctcgctcgagccgctccgataggtagctcgtcggcgtcggcgccaacacatttagtagtaaactagtaacaggcttgtgattcatgattcatgaagtggaatgcaacatccacagtgtaaattcatgccttaaacacaataatatgattcataaagtggaatgcagcattcattttcagaattcttgaacaagacagtgtagattcgatgtaaattcatggcttaaacacaataatatgatgaaaatcggtccggttggcatacaacaatgtttccaagatagcatggctaacatcagtcaatccatgggtcaggactcaggacgagcaatgcattacctcacagatgtcacccaagtgatgaaacatcagatgactcaagtcacatacaagtctgatcacccttggcacgcaagctatacttggtgcaagctgttcttttgcttaatgctgaaggcttcccaaaacgtgctggaagaatacaggatgcaacaagagttttagaatgttgtccggttacatatcttctgatgatgaccgtgaaaaaagtggatatcttgcattggctcttacccacccccacccaaaaaaaaaaaaaatcctcatacacaagcccgacaacactccattggctacagtcagggtagttagataatctcatcagtatcacaacagcgaagcatctctccagcaaacaaaagaaaaggaaaaagctcatcatctatgtcaagccagtaggaataaccatgaatccatgttaggcaactttctccgtggcgggaaggaatgaaagactgtcactgtcagcatccaatttcctcaaaatgagacgagatgcttgattcagtagggccagcattatgcatactctataaacaactagaagaacaatcagcgctgcgccaataaatagtctgtctgcggtctcttcccctgactgatctggtaagcatggttccactaactggtttacatagacccacatcaatcactgaagtaacctttcttttaccatgatcctcatcaaaatgcatatcaaataacatagccaggcacagaatttggtgagtaagtatgtagtcctcatatgacgaaggtacaacctgaaggatgtgaagattcacctgcatcataagtgtagccagcataagcagtgaagcttcactgagaaatacattaaagtgagagcagttagcagtacaaacctcagcttccattgctctaagatcattgtgccattttaaagcttcagtctttcccgaaagcaattgcaatgtgaaaaaaggtggcctaacaggatattccatgctgatcgcaatctgcaatgaaaaatccacagtgagaaagtattgtgcatggacatactttaaggaaggctcacaccaaaagagtaactgaagaatttaccttggcttccagcattacttttggaccattcttcagagttttactcaagaccagggtaaactccctggaagcatagtcctcccaggatttgtctgtagcaaggttgactttttccacttcttggtcaacaaatgtctgttcctctaactcactgtcactatacatcaagagatcaagatcgtcctcatttctaccaaaactgtgtgagatgcttagtttagatggtgtggcgctctttgatatcagggataagcctctagaatggtttcgaacctccggtgacacttcagagtgtgatattttagaaacacttggcgtgttttcagcaggaaccacggccagaagctccccatcctccctggtactctcagtttcttcccaatgcgtcacagatcttcgctccatatcactgtcaacactt

SEQ ID NO: 18957 - DNA, 5910 bp, Oryza sativa
aaagatacaagatgctactaatcacaaaggaaatgcctagtactcataaaaaaaaggagacgagatggtcacaaactttgctcatcaaatatttttcatcaactaataatgtagcacgtcacagaatgacatgtgcaatgaagcaaaaactcatcagccaaagtacatttcctccatctataaggatctaccatccaaattttgttacatcccaaactacaagattgtgaagcagtgactcacgtaagagccatctgtgcaaccttccgtgagcggattctctgcaaaatagtctgtgcacgattctgctgacggtataaagcaagcccagatgacaagtccgcacttctcgatgctctgttagaatcatcaccaacagatagaggcacttctggcaagaaatctataccagctagatgttgtgcccacttgtatggccttgaatccttttcactgaagttcggaacctccccagcataaagtttagccatctgcataaaattgataaaacgactctctttaagataatataacagagaactaaccaaaaacatttggctaccaacatgagataaagccatgatagctcactgctgcctatggccacaaatataaggaaaccaaaatgacctatcaactagagattgtcacagaatgatttgtatatatattcctttaaaaaaactcaagtggtggtggtgaatggtgaatctgccttaacctaccactatgatatctcctgacatgtgggaccatcaaatagtgatatgaacaagtaggtatactgtgttaggtatcaaaacaataataagagaattttatacaaagtatttaaggggaagatatcaaattccaacagcaatatgaattcttggattaatatttgaaatggtaatgatatgattttttttcttttaattccattaaaatgcaagggcattcagctagcaatagtcaaaatcagctgattccaacctgatgaggcaactctaaaccagtgtcatctggaaataagttgcataggatatcatggtccagcccctttgaatcttcaattccaacacaaacaacgttcaactttgccaagtagtcgaatctcaggaccatgagcttacgacgctttgctccagactcttcagtgtcgtatacatggagaataactttaaggggatgaagttgatatgccactactgaattactagcttccttcacaacactttttcttgaccttgaccttcttctttgagcatcttcttcatcatcaattgcatcgtcatccactctattatcaccatttgacaaagtgccagctattgcagatacaaaagacacgctttatcagaaatatttcctagtctaccacctttacagattataacaagtggaagagaaccattagcaatctgattctaaccattatacaagtattgaagcaagcatgcattatttacatgcagcttcaatttgtaatgaggaactaaaatataacagcttccataaaagaccggggcttctatactgctatatgagaacgaactgtttatgctagacacaagtatctactaggaaattgcatctggtcatttaatatgtggctacgctacattgcttttctaaaagtagtaaaaaggatcccttacatatcatacggtacatgagaagagatagaataaatgtcattaattattgcgagtattgcacttctgtaataggaaatcaaataaactatattccaatgagatatgattatatgaaccaaccattttcctgcttagcttgctgttgagcaaacatctgagcatcctttgtgcttccagtgatctccacttcaatattctctccgaatgcttctttctgtcctaaaaactgcgtgtaaactatatatagaggagttggaagcagttcagctgcatgatgctgctttagtttcttggtatgttgcatccccagctgctgctgcactggcaatgatgctttcttcagtgatttcaaatgggttgggaggctcgaaaggaactttttctgatttgcaattgtgtccaacaaactgctcttccgctgctccaatttctcatgtagcttgcatagctctttccgctgtttcagatttcaaacttactttagatatcagaacaaatattgggacccaaacaaatcaagaccacactagcacaaagggagtaagggacttttgtcctagcaagcaaacacatattcaaacaactagaggtgataaacaaattaagcagatcaaatcatatccaaaaacatactacaaaccttgatcactagtcacacaaagaattatcagatttaagaagaattatgcaactgactaaaatcaatatacataaaaagagtttccataacaacaaagcgttctacttaagaacagtttgatatatgagcactctaaactacaaaaataacggtgaatttataaaacattttctatatatacatttgaatttttggagaaccaatcctgcaagccaagctaaatatttacgttaaatttactagcaggtcaacccagctacgatgtgattctttctttcgattattaccctgatccttcagaacaaacccccaatctaaatgctcatacaatcctgtacactctctatgatgctttaatcatttagacgaacaatgaacaaagcacaagaatttatcccatgacaagtaaatctcctatttgtgtaggaactgaatcaactgatcacggtacacaacctggactagctcgaaattgaggcgcttgagcatgaggtcgtgggacgcgtcagcagcgagcgtcttatcgcggatgtccgccggcgcggcgcggtggaactcctccgtcggcacgagctctatgcccgggtacttggtctggaagtcgaggcacgccctaatggccttcacgtagtggttcttctcgtacagaagggtgtgcagctgcagctgtcgtggagtccacgggcgccttcgcccgccttcgtctgcgccttcaccctgtcctcctccatcagtatctccctgttcgcctgcgcaaatccaaaccctcgagtgagcaaacagcagatctaacgcgaggggttcccggcgaagaggcgttgcggattcgggagcggcacggacctggcgaagcgtgatgaggaggagggacatctgggcgacgagctcccggagctcggttctgggggcgtcgtccttcttgatggcgaggatccgggcggcgacctcctccacggaggcgcgggtctccgcgaggaggtcgtggggggacttgcccttcgaggtggatacagtgctggtggtggtggttggtcgcgccggcgcctcgacatccatggcttcggccgctgctggctccgccgccatcggtccggccggcgctgggagagacgatgcccgaagcggcgagaggtggtgggaagtgaggtgaaacgattcgtggctgacctagagttgtcgtgcgggctaacggttcagcgtttcgggcccaatttgtagagagagaaagagagaattaccggttaggcccagaagggagaaccgctcggcccatctaacctttagacacttaaaggaggcccatgtggcagattttatttggaggaaataagtccactttgattaccttaaaactagtgaaccagtcttcaaaatcgtaatatcggatatctcgatccctcaactactaaaaccggtacaatttaaatcatcggaggtttgctgacgtaatgcctacgtgatggtgttgatttagtttttgtctcacgtgacgcttatgtgatattagaataaaaaaatatattgtctccatctttttttatttgacgtttgagacagctttggaaaatttaaggagtgcatgagattacccttttccccttcgttctttctcccccaatcccactgttgtgtttcttgcacgccactcgccggtggcggaccagcgctccaccctccactagctgtggcatttcttgcatgccgtgccagggtcgaaccagtgctccaccccgtcattccatgagcccgtctacatcccgacgactacgcatctaaccgatcggtagtgaagctagaaagtttccaaagccgcaaatccaactataataagtaggtcatttccaacccaatgactaggatggtatccgtaacattaaataaaactgtcacctaggatgaaaaatgatgtggaaagtgaatacatgagaaaagagaaggaaaccttgtcttatatgagacttggtttctacacaacatccaagacatcatatgagataaatagcattaaatttaaatatatatagtgatgtttgtattggaatagtagtgtctagtaccagttttttaatgatgtagagtttatggaaactatgtgtagtgttttgagttaggaataacctaatatatcaaaatttacagcgtgttcgctgcaacgaacctggggaagaggcggagccggtcgacgtggagggcacgtgcgggtagccatggaggccaacaacggtagcagggcggtgaataagtagtaccgtgattcttggtcaggctgaatcttgggtgtgtgtatttattgagtaatcagctaatcttgatcggtaagcataacacgaacaaattgcgagtgaaagccatgacttcgtgatgtttccctgcaatcatctaaaagaaaacttacaatatgatatctcacttgcggcggcctatctctagtggattcaccccaatgataagggcggagtcgagattgtgcattgtggagaagaagacgaacataaacactccgtgattgtatcagtaaactttctttgccatgtatgatcatcgatcactctctggacgtccgactatcacgagcggttcgtccgtgatctgttgagtttattatacgactacgagcgtacaacggacaggctggtccgtgatgatccagcgcaatcatgtgtaccaatcggccctactacaaaagcgcgaagctttgctttcgcaacccagagccgtgccaaattgcagctgatgtacgcacatcgtataccggaaagaactgttcgtcatgaagagcagaagacgtccgttgacgctgacggagaaccaggcgtgttgatgacttgattgcaaactcgtacggatgctgatgccgatcgatgcccctgctacacgattgttgggtcaccgcattagagcaagtctaacagtacagaatactaccagctccaattcatttataaccaatctaatagccaattcatacaatagttgcttactatactattaatatatgatcccacatgtcatacacatagtgtatcttagaatccgtgctgcagctggctacagatctgtagcccgctgcttctctctctcatcgtttatcttagagcaagttcaatagtagagagagttaactgccggctccaaaattcaccacattatttaagagataactaaacaacggtagatacagcaattggctacacccatgctttaaccaacgcatcctgtcaggtgttggtaacttctgaatgttcaagttctaattttcgattggttatcccgagcggcagtggcagagcccctaggcgctcgtgcttgagccggcgactgaattgtcgtccgctttgttctctctgctttccctctctttatcatatatgttaaaatattagataagcaggctttatacctgctcttattaaaatgtgtttatagttggctaacagcgttattgtacctgctcttactgcgtgacttgatttctccttaaaagcatcaccggccaaccgtgctggatagcatagtgccactgttgtagtatgtcactcgagagaggagcagggggagcacaagtgtcatgattccaccaattccctagactgtttaacgcctctctctccgtgaacctttttcagtagg

SEQ ID NO: 18958 - DNA, 11524 bp, Oryza sativa
  unsure (1)..(11524): unsure at all n locations
cattgtcgtgttagggatggctgcggcacgcgcatcgcgagtattttagtgcaaggggcgggcgggcgcggtagaagtcaatagatccaatccagccacgcgcgccgctcacatggcggatccgaggttagtggcgaaaccatcccgcccaagcaaaagataaagccaaaaaggagaaagagggcgggcgaatttgaacaaagctaggcaaaagcgccgcatctgactgcttcgtcgcttttctatcattgctattttggtgcgattcgccggcttacggatcgctcgctgtttcgaattcgtctctgctgcttggggtagtgtgagtgtgtgactagtgcggcgactgtgcagtggtgttcggtggttttgatttctcctgattgctgaggcgattgccctctcttggcggtttctgcagccggcggtggggcctcgcggcgcgaccgatccagatccagcgccctcgccgctgcgcgtgcacggcatcggcatcggcagccacgcctcgcgtggcacggcaccgcgaggttggtgggcgggcgatcggcttggtgtgtgctgtgttatcccagtgcccgcacatttgtcgccagctaacctcttccacacgcaggtgaggaggaagaggaggaggaggagtggagaggcgacggcgacgcgggctcggaggaggaggagggggaagcggtcagtgactccttctcccactcgctgagaggtgattaatcttcccttgtagtacggttgctgcttttgtgctctgttgagtgtgattgctgacttcggtttggaatctgttggttggtagagtgccagaagcagcggaagctcagagcggagggggctgcgttgctgctttcaccggccaagcatgagctcaccggcggaggtggtgggagcatagaactgctggtgctctcgccgaggtgcttggttgggggtaatgttggaggaatgagcaagagctccacagcgtcatcacggagcagatcaggcacattcccgagccccggtaccccaaactaccaccggcattgcgctagcaccatgcagtaccctaagggatggagctcagagcgggtgccacttggaggtggtaccaataggaggtatgggggcagtggggttgttcttcctttcaacaatgggaggaagctgccatcaaaatgggaggatgcagagaagtggatcctaagtccagtttcctgtgatgggattggaaggatgtcagccccggcgcctcaccatagacggcccaagtcaaagagtggcccacttggccacccaggcggaataccgggtgcttatgcggctgcttcgccgtttgtgccctgctttgatggtgttctggcagcggctaattttgcagcacattctcctttttctgctggggttctcatgccagagcacgtgcgcaatggtgacttcagcagtggaagaggtagaagtggggatgatggcagtagccgatcttactctgcagagaaggacccatatatcttgagatcagcaagtatacatgcgtggacagagacacttatggaagcatccgcctttgctaatatctcagaagaaactgcacaaggtttgattacggcagtcccttctccattgttatcatttatttgttggtatcttgtcatgcgttctgattctgttgctactgcagtctgcacatttgttattttgcataagatttcatgaggacgcttgatataagttttgcagcttgtgtcacttgtccagcgtggactcataatcaagtaccagcttgctgtaatcacaagcttggaatacgcgctttccaacttttctgttgatgttgggataggccaaaagagtgcatggcgtttgtgatatgttttggtatcatcaaattgaacttnccactttagtttgtagtggttagtgagcatgcatgacattatgctatttgcatatcctgtcatttttgcagtgagatactataataagaaagatgctcacatgcataacgtcatactactacctgttaatgcatctaaagttcttcaatcaatacagtgtagcacaaaggtggagatttcaatcatacaaccccttggcactcaaatccgagcatccattctgtttagactgatcttacctgttcacatttctaagcatgcaaaaacacctgatgcatatgcacttgaacatttaattctttgacatgtggactggtagattgtttgggaacatttgaatcggcttgtaacatcttgttttttccagttctaaggcctttcaagtgtctgatgtgttctgtgatcttctgtcttcagaaggctagttgtgtcgtttagatggacattataaaagactttccataaccatgtatgccatcagatagtgtacatcaggattatgttatttccatcttgcttaacaatgaaatggatataattagatttttgtcaaccaaaataaaaatgttatggcatttttatgtattggggattttccacagttaattcaacaaccttcagatgtatcttcatatatgctaattaaatttcttaacaaatttgtaccctgcgcacagatgataaattgcaaggcctgcgaggagaaactcctgccatttccagtccaataataaagaaagatgttgccacacaaatgagtcctgatgacagtatatcgtcttctccaaaagcaagacattcatgttccagtttaccatcaggacatcctattaaagaaccaaatagtaatgcacttaaacctgaagtccgagatgtccaggtagatgatcaagtaactgtgacccggtggtccaagcgacatgtaacacgagggtctgataggcggtcaacaaatattgtcgagtggaggaagaaaacaattgagactcgagctccatcttttgatgaaaaagaaagagaaagctgcgtatcaaagtaagatattttccccatgtttatcattttttttatttgtaaatttgatttatgcctagagaccagcatacagtcatgtacttcatattgtaactcataatcctatactgccaacctactgtcagtgccatagtgactatacttctctgttggtttgaattttgaaagtcttatgttctttttgttgaaacctgaaagagaagtctatgccacactccaggtctcctgctgaagctgatttggttgtatgcttgtacatatacataggcaagcggaattcgatttgactcttatatggtctgccaataagtggcaaattaaatatttactcattttccttcttaagaaacaaatactatgcaacaaatttgattttaatgcgcaaatctatttcaagatgccataggatcacaagccagtaagccacaggttcttttataaagttattttcacagcattccaatttataatataagggactagactgtgaaatggttatttttttttatacggtctaactagctaggtggcagaaaaaaatgaataaaagacaaaaccatactaatataatcaagaaccaatgttgtatggatgagatatccacttagtcatatgtaaatttagccttttttttatctataaattttctcagtccctactttttagtattcagttatgcaacctaaaccttgtgcctgtttttccctttgaacagaagaaaaatatgtttcccctacttctttctttacccttcgtgaataccagaactccggacagataatagtactacctccgtatttaaatatatgatactgttgactttatttggtctttggtgtgcaactttgatcattaattttctattagaatataatggtaatatctaacaagattataatattataaaagtacttattaatgaaaaatctacccatatgatttttatgttttcatactaaatattttgagttctattgatggtcaaagtttaaaaagtttgagcagataaagtcaatagtgtcataatttaaatacagagcaaaaaaaaagagagaaaattttgcagtgcttagtatgtaatattgacttactaattaaggccacaaactgtgacttgttctattgctgagactttatttctgtcaaggtgcaagagggaggaagcgaagatcactgcttgggaaaatctgcagaaagcaaaagcagaggcagcaattcgaaagttagaggtagtcttttgtacttctgtaccataaaaatgcatgcttgtataattgattttcctgaaggtttactttttctttgattatatggaattaagtctttttaatgtaataagttgtggttacatgttctgccttctgtactttcagatgaagcttgaaaagaagaggtcatcatcgatggatagaatcttgggcaaactacgcactgctcaaaagaaagcgcaagacatgcgtagtgcagtttctgtgagtgaagatcaatgtggagtgagagcaaccaagaaagcatcatacttgaggagaacgggcaaatcattcagttgctgtttcacctatcgtgcttgctagttgtgacatagttggtaccgtgggcgtagcaatggatgtacctttgtagaaactttttggtgagtttttgctcgtataatggtaaactaattgtggtgcaatgtactgttgtggtgttgcctgtcttattagagcatttttacttgaaaatttattaacatttcgcatgaatcttcaggacgttgcagctcatgtcagccaacaaatcagaattaatcaggaagtcagatttttccttgctgtggcagctggaggtgacggggttatttaaagagaatttgcatggtctgatcgatgaaatacctgtagtgccagtggagtggtataaatcagtcatcgagcaaaatctatattgtagttaatttcgtggattattgctcccgttattctgtgcctacaatcaatctctgtacacccaatagaagctccttcgagttcgagagctttatgctagtcaccaccagattggccaggttcagtggttctcattctgattgatatgtatctttccatgggattctgtaagcaaagcaagccttggggcttgtactgatatattgtattgaaagaggttatgagagctgcaagctacgactgcagcttgctctcttgtccagttttgctctttgaagcccgtgtggttctgtttagatgttactatatcttatgcatacaagttttttgtgtacatactacgcacattaactaaaaagtttcaccaaaagtttaaagattggattttatgtgtagatggaatattactaaaggtacattatttttaaagaattttttacgatatttgttagttggtgtgtacaagaaaagacgacttgtgtgcatacgatacgtttcctttttagacatccaggatgccaatagttatttgtgattgtctatttagaatttcagattatcctttgctcacccagaactgatgtagagttggagtttagtcaatgttggcaacatttgggggagactgcaaagtaactgctgtagcactagctatacatgagtatataaagtgatgattgcatgggcataaatacattgatgaaaaaacaaaacgaacatatacaatccatatacaatccgctggggccaaaattttgtatgcaggccattgaacgccaggttgctcgcttttttatggtacaaattgaagttgtgttgggagtaccttcatggcatagaggttctcagagtttctctttgcataagtaggagtacagcgttcttctattttgttgttctatgggttcaagttgagttgaaccagaaccttaggtcacagcctgacccctgataagttaaagtgcaatagtccggttgtatgacgttaatttataccagaacagaaccgtcctatacgagagctatttatacgttcgagcatgggacattggaacatactttcgtcttcctccagctaacggcctcgcattctctacatagcctaatctgcaggattggtttcatgaaacccattctagcttacaccacaaaccatctttacatatacaggagagttagtttcatgccggctgccgctacaccagaacaggaaaccctgcgtggccatgatgtcatggccggccggcaagctttagccatatctatatataaagaagcacttcatgcacaacggcagtacacatatccaaatctacgttgtgttcgatcgatcactgcaacatccattataatacaacatagatcgtatcatggggagcaaacggcgagtaatcttgctgccaactttgggcgtcgtcgtcctggccatcgcggcagccgtcctcttgcacgccggcgaggcggccgacgtcgccaacgggcaattcgcgagggcgagcgggacgcggttcacggtgggtggccggccgttctactcgaacggcttcaacgcgtactggctcatgtacatggcgtccgaccccggcgaccggagcaaggcggccggcgtcctccagcaggcggcgagcctccgcgcgacgctggtgagaacgtgggcgttcagcgacggcggctaccggccgctgcagaagtcccccggcgtgtacaacgaggacatgttcatggtatcgttgcgtacgtgttgtgtacaccatgcatgcgtacgtacgtaatggtgacaattttggataacaatgttgtcgtgtgattcagggactagattttgtgatagccgaagcgaagaaacgagggctgtatctgatactgagcctggtgaacaactgggacggattcggcgggaagaagcagtacgtgcagtgggctagggatcagggacacaacctgggctctgacgacgacttcttccggagcgacgtgaccaaacagttctacaaaaaccatgtcaaggcacgagctaacatccgatacgctgacagtttataacctgaaaaaaagagaggaaaaaacatatctgacagtaaaaaacgtcctcgattagtcgatttgacgttctgctcgcatgcatgcaacaggccgtcctgaccagagtgaacaagataaccggagtggcgtacaaggacgatccgaccatctttgcatgggagctcatcaacgagcctcgctgccagagcgacctctccggaaaaacacttcaggtaaacaaaactcagttttaaccctcgtttaattcgtcaccggcccgatcacgccatgtgttgcaagatgtactaatttgtgatcgtttgatcaatgtgcttgcaggcttgggtcacggagatggccgggtacgtgaaatccgtggatccgaaccacatggtggagatcgggctggaagggttctacggcgagtcgatgcacaagaacttcaacccgggctacaccgtcggcaccgacttcatcgccaacaacctcgtccccgctgtcgacttcgccacgatccactcctaccccgaccaatggtatagcacacgaatgacaaattaatccatccatccagtgtgatatggttaatttaactggtgaaaaatcatattgcggcagggtgtccggcgcgagcagcgacgagcaggtggcgttcatgaggaagtggatggccgaccacatccgcgactcggcggcggtgctccggaagccgctgctggtgacggagttcgggtggtcggcgaggtcgaacgggtacacggtggcggcgcgggacgcctacttccgcacggtgtacgacgcggtgtacgcgtcggcgcgggagggcggcgcgtgcgccggtggcctcttctggcaggtgatggcgcccgggatggagagctggaccgacggctacgaggtggtgctcgagcgcagcaagtctacggccgacgtcgtcgctcaccagtgcgccaggatcgccggactcagcccggcctagtttgccaattcacgagacagcgataatttatctacacgaagataatcaggagaggatatattgttattattatgcatagggagatattcagaggagcttaatttatttttctaatcgacaatatcgcgatgaggagactttgcgatgaggtagatgttgattttcttggagagaataatattttatacacgtatactgaattattccctccgtccctaaatatttgacgccgttgactttttaaaatatgtttgaccgttattttttgtgaaatatgtaaaattatatgtatatataaaagcatatttaacaatgaaccaaatgatagaaaaagaattaataattacttaaaatttttgaataagacgaacgattaaacaaatttaaaaaaatcaatgacgtcaaatatttatatacggaggaagtacttgttattactccactcgatgtactttgtccaaaggaaaaagtaccccgaaagtccctcaacttgtcattgagttataaaatcgttccccaaccacaaaaccagacatatgacatcctccaacttataaaaaccgtgcactgtaggtctctcagtggttttgacaccgattttattctacgtggcggctgagtcagcatgggaccccacatgtcaggatgccatgccagcaccctccctcttcccctcctttctctctctcacctctcgacgcggaacggctatcctaggaaccacgccgacgaggtgtccttctccacgacgcacgacggggaccggagcagcgacgacgtcgtggcgattgcaccccacgtcctcctccttctcggcgagggcaccggagctgctgtcgtggtgcatgcggaaccgtgggaggagaagatgtagacgcggaaccgtggcgacgccgacggcgaccgtttctccttggagcagtcgtactcgtcgagcatgtgggtcaggtcctcgtcccaggtgacggagacgagcacgtcgaggtcctcggcgacgaccgccacctccgtcctgaacatctcctccaccttcttcttcaaatctgcacgcggcgagaagggtatcgagcggggcacggcgagaatgcgggtctcgctgtcgatgtacttgagggcgtcgtcggatgggcagggcatgatgcggccgccgaagctgcagagtatcttgatgcggctgccgccatcgacgcaggctccacgtccgccgccgctgcagatgctggtcgggtggcgtacgtgggcggccgtcgccgtacagctcgcgtggcggcggtacaagcaccgcaagacgctcgcgttgctctccttcatccgcgcgcaggccgctgtcaggcggccgcccatctacgcctgtcggtggcgcgcacgtagccgctgctggcgcgcgcgtagaagcctgcgcccggcgttgaggccctcctgctctcgcgtcgtcgtcgccgccgcctcgtcgcccgtcgtcggccgctggactcccgcctcccccaccggcctcctcccaccggccagctgcccctgcccaactgatgaggagaaaagtgagaaaagaagagagagatagaggaagataggtggagaggggaggggaagaagaggctgacatctgggtcccatgtgggtttcatgttgacttagccgtcacgtaggataaaaccggtgttaaaaccatcgaaggatctggagtgcatgatttttgtaagttggaggatgccatgtatctggttttggttttgcggttgagagacgattttgtaactcgatgacaagttgagggacctgtggtgtactttttccttatccaaaaggcctaatgcaaagcagttaggcccttcccaccaaggccacactatccagcccaatgctaggtgctccctctcacgcggcccgcgtcacggctgattgcctggttggtggtggttccaccacgatccgcaccgtccacctgtcccctcccgcccgcacagatgctcccacctcgcgtcctcccatagggcagtccgtcgcgtcgccacccgtcagcatcgtgcggatgccgccacgtttcgcgtcccccgcgcacaatcctcccccccgtgtggtccccaccacgttgagtccagcatcccaaccaattgaaccaaacacgattaaaataccttatcccactcgacccaccccaccccaccccgcagatcccccacaccactgacaccccggccccactgcgaagcccccgcgagatctgatgaccggagtacgagtggtggaccaatcgctgtgtgcgcggtgcgaaaaggggaggaaggagtatactaaaactttattacccggcacgcactaatcgagattggagggtgtcacttcgtcgctctcgaggccggcgttttaaacgccccccccacacggctcctcgctgccgacacctgtccggtttcctctcctcgcctcgccgcggcgcccgcgtcctcctcaccaacgccagagctccacatcccacctctcctcaggttcccgtctctgatccctcgttgcgttacggggaagcaggcgtggtggttgctccccgtgcggagttttcgattggtttggttgggtgagtttggtgctggggtgttggggattggttggttggagtttggagatggattttccgggagggagcgggaggcagcagcagctgccgccgatgacgccgctgccgttggcgaggcaggggtcggtgtactcgctcacgttcgacgagttccagagcacgctgggcggggtcgggaaggacttcgggtcgatgaacatggacgagctcctccgcagcatctggacggccgaggagtcgcacgccgtcggcgccgccacgacgacgacggcgacgacggcgtccgtggcggcggcggagcacgcggcggtgggggcgccgcccgttcagaggcaggggtcgctgaccctcccccgcacgctcagccagaagaccgtcgacgaggtctggcgcgacatgatgtgcttcggtggcggcggcgcctccaccgcgccggccgccgcggagcccccgccgccggcgcaccggcagcagacgctcggggagatcacgctggaggagttcctcgtgcgggccggcgtggtgagggagaacatgtcggtcccgcccgtcccgccggcgccgactcctacggcggctgctgtacctcccccgccgccgccgcagcagcagacgccgatgttgttcggtcagagcaatgtgttccctccgatggtgcctccgctctcgctgggaaatgggctggtctcgggagctgtcggacacggcggtggtggtgccgcgtcgttggtttcgccggtgaggccggtctcgtccaatggcttcggcaagatggaaggcggggacctgtcgtcgctgtcgccatcgccggtgccgtacgttttcaaaggtgggctgaggggaaggaaggcaccgggcatcgagaaggttgtcgagagaagacagcggcggatgatcaagaacagggagtctgccgcgaggtcgcgccagaggaaacaggtgaaaagtcctttttgttgcaacttgcaactgtttagcatttacttgtcgaattgccttgccttctagtacttgcctgtagtgacatgtgtagcacatatattttcccttttaagcatttcttttcttttcgatgcgacaactaacaaatagtaataac

SEQ ID NO: 18959 - DNA, 12708 bp, Oryza sativa
  unsure (1)..(12708): unsure at all n locations
aggtcgcgccagaggaaacaggtgaaaagtcctttttgttgcaacttgcaactgtttagcatttacttgtcgaattgccttgccttctagtacttgcctgtagtgacatgtgtagcacatatattttcccttttaagcatttcttttcttttcgatgcgacaactaacaaatagtaataaccgtgagaaatgtttatcatcatgctgatcgttttatttgctaactaggatatgtgcctcatatttgcaaagtttatgctgtatttggttcaaacatactgaaatttaattagtataaacgctataaacatatcttttgcacgtattaagcctagcctaaaattagtatacacgctataaacataaaacaaagtggtgtttataaaacataagcatatctttctccttgctaagttgctattgatgttctaaaactttttgtcattttttatggatttaatttgtgcttcctgatatggagcaggcatatatgatggaattggaagctgaggtagcaaaacttaaggagctgaacgatgaactccagaaaaagcaggtactctccatgttctgtttacatttctagtttgagttttgttcgttataatttggaaatacttcttcatgagttgaagtacgtagtacactttggtaatctttaaactttcaaacatatggaattccaatgaagcatttgatgctggcatattattcatttgcctgtgaactgccactctttagattggggatttgatgatacgccattgatttcagagggacccttgtgtcactgtcacatggtggcaagttgctaatcatcaaactaaaaaaattgctgttttgaaatcttaaactatcagtttttgttattctcaattgtcactagtttgccacatgtccacttagtttctagcagtagtctccagagcatttgaccaagtgaggtccttaccaatagaaatattataggtgttttcatatacttcctccatccttaaaagagtatctttttagctatgaacatagacaataccactcttttagtgacagaagttgtattgacgctatactctagtgtagccccttactttatagtctactcttgaaattggaaactaattctaaactgacaagttaccatgaaatatgttccacgcttgaaagttagttctaaacaaaactgaaggcatggtagagtaatcaaagtcggttccattttaaactgtttaaatagtttggtggtggactgctggttagttgcttgccttctttgtacaggatatttcattttataaattgtaatatacgtagcttatcatgcatcttaattgcaagtctaactaaaatagtacttatgaatgttgcattgcacccacacccacaattgtgattatttcattttgcactgtcttattacattctttgaggtttgcccttgttttgtccgcctttcatggtaagtacttctgagaaggaaaacaaaagaaaggctttacatgattcaaacataagtgccttaagacctgacaattctattcccttaggatagtggactagtaggcagtagctactctattcatttgattatgctttagcatttgaacttatttttatgtattctaatgtgcaggatgaaatgttggagcagcaaaagaatgaggtaattgcttatcttggaaaaaaaatcttttgctctggataggtactatgttttgcttattaatgtcaaacaagaaacaaaacgaagctgtgcaacctaggcatgctctgttttactgatagcttacttgtttaccaaaaagttttactctgtaaaatctgatagttttaccctttacatgagtattacagcctaatctgtcaatatcatacatatgctctgctctatgattatttttcgctcgtaatgtatggtgtgaattttaacaattattgttaggaaaatgtatgctgtgtatattaacaattattgattcacttgtttgaatgtcaaacgttatgttctgattgatagctactggtcgtgagttttggctttcacactattaccttatagtatgggattttaagcaatgatgaagtaaagctttgtggggggttgagaaataatgaggcaaggactgatgtcgatgtgattgattgcattttcctacatcaggggttaggtggcagcatttaaatggcttaaactaaaaaagaaattctttgaattgatcagtcaactgccatcattgttgaattataaccatttaaatgatatttcatctataataatacagttttaactaaatgcaacattggaagggcaagcaaatattaaagtttattcaaaaaacagttatttgatgtgtgtatagtttaatgcctatgtttccatcgtagtggggtataactgtattttccacaacataacacttaaaaaagttatgacaggatagacaattgtgaaactgtcaatattgtttgttacaatcaatttaactgacaattttgactgaactttacatgaagttaacacatctctcaacactgtaaaatctgtggatacctccttaggccaatcgttgtaaactctgctgagaagactgactgttctctgtaaaaagggatatgttctcataacactgaggcggcagaatttcaaaccgcactccctccatgtcctagttgtttttccacatcttagaccactagtttgaatgtgtacagaagctaagggagtgccacaaatggtttgaaacttagaatcatcagttttttagaggctactctaaccctgaaaaaatgtggattggacaaaaactgaattactgaatgcttgctctaactaatactggtatgtagcacacatacttggtatttctatttctgagaaagagcctcttgtagactcttgccacttctactcgacataattgtattttggtaaaaaggaaaacaatggagcctctgatgttatcataaactgtacaattcatttttgaaaaagcaaatcaccactcaattctatttaatttatgttgtcctttggttgggttttaatgacttcaaaatggggttccttatttttctgtcagcatactatctgacaattgttcctggtaaatttgggagagaagtttccaagcttttcgtttcctagtttgagattttcctctggcttcaagacaccaccgcgtaaaagtctaataatgcactgttaatggtttctgcaggttctagagagaatgagccgacaagttggaccgacagcaaagagaatttgccttcggaggactctgacgggtccatggtgatcgaagctaaaggcctagttacctgtaactagaacacagtcctttcaatgtgagcagtgatcatagtagttgtaggatggtgaagctgaagacctggttacctgtaactagaacacagtcctttcaaagtgagcagtgattacagtagtagtaggatggtgaagctgccagttacctgtaactagaacacagtcctttcaaagtgagtatagtagtaggttagttcagaatcgccagatcgatctgcccttgtaggccaaccattagtccgtgggcttgtctcttgggcggacaggctgcctgagatattcactcgataggttttagttgtctgagttatatccaagcattgtatgtaacctatttaaccatggtgcctgctacctgtattgtattttgctgctgtaggaacctatgtcggtgttaccatcttgttcttaatttgtgtacttctcttgccattttggataagatgtatctgaacttatacatatgtacttttccttgccattttggacaagatgtatctgaatttacatgaacccattttggacaacgtgtatctgaatttatatgaaccatggcactgggctgtgtgtgtatactgtatagcattgtgccaaatttgtgagaaacggattgcttatcatggataacacttggacaagatgtatctgaatttatatgaaccatggcactgggctgtgtgtgtatactgtatagcattgtgccaaatttgtgagaaacgcattgcttatcatggataacaccacgagcaatgtgggggcgcctggtcatgtggccggccagtgacgcgacatgaatttgggggacgtttcgtgtagctgtccgtctccgtcgtggccatcctactccgggattgatccaactcgctgtccagacacgtgcagcacctgagggggcatctcatttcacctcatcacttcatcggaatagctctcctggagaatctggacaagcatctcacgattctttcaccaattgggtattattagcagcgtcggatagtataacaaacattctcagaggtcacgttagttagtcaggctaaaattctctcagaagtcgcggtaaaatcgtttttgcagcacaggacacacccgcgtgccacttgaagggcactgtcagagccttttctttttacattcactgactttttacgttcactgacagagctagctatagctcttcaattctatcgtgagctgtaggctgtgtttagatacaaactttggatccaaactttcaactttttccatcatatcaacctgtcatacacacacaatttttcagtcacattgtatcaattttaacccaaactttcaactttggaaggtactaaacacagccgtaatgcctgtacgtcgcggcgccaacggacgagcaccgtttgccactcaaaaagagcccgcatcaatgcacgccaattaacacaagattgacctccgggttagtaccagcaaaccttgcacggcgagacggcgttgctgtttactgcgacgccgccgtgcgcctgacgaacgtgacgggtgtgaccctgcgtgtgtgtagagtgaagtgagaaagagacgagagcccccgtaccagttagagacagacagatcgccgtgccaagacgacgacggacagggacgcccaactgtacgtgcctgcgctgcgtgcatccctcctcccccattcggcgccagccggaccacagcctgtcctgcccaccccaaccaaacaattctccgtagaatgcactgcacatcgatgacgaagacgacgatgtacagatgatgcaaagcctgcatcaaaccgggccgtctgctctgcttcacggctgacgctttctcaagaagaatttcaggctttcagattctttcgtctccatgcagattgcagagaacatttcacttttgcatggttgattgttcatcgaattttgagagcaatgagcatgagcaataatcatttttttggaaataaaattagtctacctcatggatttacattgatgattgataaagatctgaattaggggaataagcaagaaatctgctaaagtaaagaaaaaggatggctgaatgactgaatgatattatgataatgttaaatgaacttgaactgttcaagataggatagataggaggaggggagccggccggagggtggaaggcggcggcccaccaaaccctaaattcctttcattttccttttttttttcccgcatccgacgcatcgaggcaggggatattcttttcttatccttctaagttttcgttcttgcattcttctcgatgcaagagaagatgtcaatggcgtggcgtcgccgacgagttcagcaacggttgcgcacggacaacgccaccacctgcgcccactgcttcagcctcatcttcaccgtctccggcgtgtctcctgcaccacatcgatcaatcagaatcgaaatcaaaatccaaaacttttaactaataatcgaataccaaaacatcgagacgacgagacctaaatcatatttattacagaaaagaaaaatctctgttttctctgataagattcacaggtgctctgcatctaggaagtggcctctctcaatctaatcaacaccacgattgatatatatcatggaagtataatcaacaacagcacgattgatgtatcaatgaagtggatgcgacttgcgagtacgaggtaaacacgtatacatacctggagagagtatggacatggggctcccgagcggcgactcctcggacacatccgacgaggaggcgccgcacgagcaggggctcgcggcggcgcaaacctcgcccgcgccgccgccgccgccgccggcgttgccgtgaacggcgtagtagaggtccagcgcggggagcgtctccaccaggcggctcctcccggcgccgcacagcgggcacccggccgcctcgaacccgaacccgagatccatgcacccgcgcagctcgtcgaggtcgtcgtccgtgacgctcctcacccgccgcagcgccgacgacgacgacgatcccttgttcatcccgcgccgccgctcccacgcctcgtccctctccatgtccggcgaccacgagttctgcttctgcagccctagccccacccccgccgccggaaggcccctcctcttccccacgccgccgcagccgccgttcatcagatggctaaccttctccatgacggcggcgagccgtcggcccctccctctccgtcctcctccgcccgtacgccgtcgcgtcgggccgccctcctcctcctcctccggcccccgccccgcgaggcgaaggggggatgtgggagacgagagcttcgaggccctcgaagccgccgcggcgatgggatttttatcctctcctcctcccgccgccgccgccttccttttcctttgcgcggtcagctgcgtgacgtgtgccgacgtaagagggaaagaagcttttatttatatatatatatagcccttgatccaacggtggtggtttgaatcggagggcagtaattataaaggcatttaatttgggtcacggactcacgggaatgaggagcaaatgcactaaaatttcacccgtttattgccgtttaaatcgccgattttgagttcgcccgtttgaatctgtggtgggttcggttgtgatttcagtgcgatgcggtacacactagtatttgtacgacacgagtgccctgctcggctgccttacgagcgcaggtcgatgacaggtgggaccggtagtcagagaaactttatgatgatacagtaaaagataatattttttaaatatatggcaatgtaattagtgtttacaatataataatatgtgtaaaatttatacgactaaaattttttaatacaacataataattgtttatgggacaccgattctaatgcaaacaactcattcattttcaaccaattagattttttttcaaaaaaaaggggcaaaagctttgcctagtatatattgatagaacatatttatagggacaaagagcaaaagccaaaagaaaaaagtctagttagtccgcgtttcctagaatatgaactctgctagtggggttgcccctgccctcacccatgtaaccgcttctttcttgatctttgcaataatggttggtgccttggtggtatggtgtcaacgtgttggaaaatctttgcattacgttcgcaccaaaactcccaagcaatgaggatgattaacgacttcagcgtcttggtcggtctcggcaacctcagcatgaggtgataccaccaatcctctacggacgtgcggttgccccagttctacatgtcgaggtctagaccaatccagcgttggatctcctgccagattcgcttggagaacctgcagtgcgcgagaagatgcgtcgatgttttctgagtggtgtagcatagtgggcagatccactgattcacccatcctctcttctgtaatcgatccacagtccatatcctgttccgtattaataatcaggtgaagattttgcacttaggaggtacgaagggaatagttttatcagtattcaaattggataattagaagagcccatgcttgattttggttttaacatgggaaggttttttaaaaaatcatgccaagatctaatcggttttagcttgactgcttgaaatttgtgaaagtcctgcaatcgaaatagcattgccgttgcttgatcagctaaccacattaggtggtaagagttgcttgcacagaaagaagaatgatcgatcaacgtttacatgattgagtatccacaatccctcatgcatctcactatcaatcgtaatccctctcgacatggattgacaatacaaaaatatctgcagacatatttaaaatccattttcccacccagaaataaacatcagaaaatcaatctgattccgacaacacaatggaacttgtgttctcaccaggatttcatggtttgccaatcgcaattaagcattcctaatcatgtctgatccacacgttcaatgatttgtaccgaggggatgagttcatttcaaacttatttgcaagagtagcttgacaagatatctagcccatttagaatatgacacttcctctaaatacagcaattcaactttatacaaaaaactatggcaattcagcaaccaaaggcaatggaagcacagtagcatatcacagtacactgttcgatcgaaagttctaaacttgtctaaaattgtcaagaaaacgaaatccctgacgtgccttgaacaaggacatgccataatttgcacggcatacttgactttgcttaatactcagtgctagctttcaatagctgcgcgtaatgccattctctccaaaatagttggtgcttttaacttgccatttgggtcatgtttcgaacaaagaattattctgaaatttcattgatttcttttcactgaatgttctagaaagcaatgtaaaccctcctgtatttcaattgattttgtatatatgtaagttgacaaaaattcaagatgcgtgcttactgcttagtcaaattacaacattgctactaaataaatcagaagagagcttcatttgataagcgaggctacttttcttgttagtcaatgtcgtcatggaagaccgcctcttaacttgattacatcatggacggctcccaagtctcaacaaccggtataaagatggtactgatgtgcaatgatatacaggagcaacttgttcttgctcgtcgtttctgattggccaatctgtaaaacaatgagaaggatgacgacctacttcaataatgtccttttataattgcaggtattggggagatttcacggcattggcagccataaagatacgcatatgtatgctctatgatgttgttgcgtctagctgaactgccgagtggtttcgctattgcttttggttggcgattaaacaagcgttttgttttgttttctctgtgtaaaataatgaagtagccagttaggagtacaaccaaactgaacattgacccgttcctaggctgaaattggcatttgcttctaataataataacctgccagttctgaattcagaagaaaataaaagccttaattagtttaaccattatgcagtgacaacacaacttgcagttgtttttcccttcgagtccatgtcatgacagctgactagaagttacctgcattaatcgcactgcgaaatggcaacatagtttcgtgagaagaaggcaagattattcagacaaatacaatactacacctaacaatgacctcacctggaacatctttgtactctttcagaggacttgaccttgggttggaactaacaaggaaccgacactagtttttcgtcaatggtcaatgcattaagtgccattaaacatcaacctggaaggctggaacctcataaattatatctctctcccaaaatttgacagaatcagcaggtagaactcagccacagataatacaggtagcaatataatgcttcctcagtataggtctgttgctgtgggaatagggtattaacgaatcagggttgccgatgcctactggatttgccttcgccatcacggtactgctaatggagaagcatgacttaagctgcacattaatcaaatctggttatatgttggtcatttcagagctgtgcattgcagacttgcagtgcaggagtggtcatcacgaccactgggcgactgggtcctccacccgtatcaactccaacgtgtgggagccaaaagatttaaattagtggagaagccggccggccctaattggctggatcaaaactttgctcttgcatgccttcgatttgaagatattccacaccctttcggcctttcgtttttgtcgcggtctcgacggaatacctgacgatggatcggcagcgatgtcaaacggccgcagctagcagcatgtgcgggaaatcttgaccagttttagcggctgggtttgagctttctccacgaagaaattttcagacgatagatttggaggctgttcgttattattccctcttgccccagctgcatcccattatagggcggctttttttccacatcgcaactgcacccatcacgtacgcagcacgatcggatggtggttggccggataaacggggtcgctcgctggctgttcggttcggctcagtgtgtgcggaggttttctcgtacgtcttgttgcatgtcgcggcggtggtattttagatcgctgacgctcagcgtttagcgttgcgcggtatctccggcgtcggtggcggcgtttggaccgacgacgggcacccgaaaagaaaggccgaagggcgacgacgccccgcgcggcagggaacagctagtagccaggaggcccgtgattgcctacagcccagcgcccagcctgccaagaggagagcggctgggcctcctcagaccgaaccaaacccgcctgacggtgaatggcatgggctgtcccgatcgaaatcacgttgggccaacatggcgattccataaaagagccgaaatgcaccatctgcgcagatgatacgcgtggtgaaaaggaacaaagtccattttggcatccttaattatttgcccgaatctgattcacatttcttaaccataaaattaggtatatcgtctttcccagctatgaaaaccagttcgttgttgcctccccaaccggattgaacaatgattttgtcctatataacatgtttgacccggctttaatcggtggcgtcggaccctatcctatttctctacctctctcctctcaccctcaactctctcgatctctcccgtctttcctaatggtcactagggttggcgtacaaaggatgacctcattggcgggataagcgatggcacgatatgataggaagcagacaggtagggtctagggaaggagtctagatcaggacgaggtcaatgttgggattgtaggcaacgagtggtagtgccggtagaaccgtgtgagcaaatcaaactctggagagcgtggaggaagccatgcacaacggctatggcgaccaaacaaaggtagggacaacgagtagtatagtccgaagcttatatatgctaccgtcataatgttgataaaggagaaggcaaacggtggttggtaacacgggagcttgaggagtctactggcagcacaacgaggagagctctacgcaacctccagatgtatgacaaggtggaggtcacaagcatggtaggtgatgatccagttaggagtaatgcgagggaaagcgaggccaacctagcgatggacacattgacatggagtgagatgtggtgggtagagatagaggcgtcaacgaagaggaggaggagcaagagtgaggtgtggaggtagaggagcgggatgggagtcatttggaaagataacaagcgacaaccatgtgcgcaaagggttacattagcgatagattttatgtgtggtgcagccgtaggcagtgaggagcctgatggtggcgtgggagcttgacgagggcgtcagcatacgagaccttgacaaggctcgaggagatggaggaggaaggtgggagggagattgacaccctcctcgctgttcactgctctttgctgccaaatcaattcaagggagctctgaaggcacgttgtcgtttacattcacatgctgactggaaggggcgaagaggaaatcaacttgtgccaccagcctttgatcttggaggtcgctcaagggctcgtcggttatggtgcgagagaggatgaggaggagagtaggagggggagggggagtggcaaggaaaaatacgagagatgatcacttacacgtagatttatttttaatgattgggctgtcatatagatatcctgttaagaaaccactttaaaatatatgctacagagaattgtttttttaaaaatatgttacagaccaggctacgttcgttgcatcaggttcccaacatcatctccctcgtttttcgcgtacacgcttttcaaactactaaacggtgcgtttttttaaaaaagtttctatacgaaaattgcttaaaaaatcaaattaatttattttttaaaaaaattacctaatacttaattagtacgcgctgatggaccgttccgtttttgtgcagaggggatgggttaccaaccccacaatcgaacacagccctagtttgaaggcgaatcaaaattgacctttccccggtgagtccggttcaggtgcagggaaccctgcacatagtaatatacaggccaaatcaaatcgcgacacctgtacacaaggtaggtccacccaatcaaccaagtaacaatgtaaacggaggtttaaccacgatcccacaaaatcaggtaacagaaccattcacccgtttagtcctcgttaaacctccgttgcatgcgtaattaagtagggccaccctgaacaggtgtnnnnnnnnnnnnnnnnnnnnnnnnnnnnnnnnnnnnnnnnnnnnnnnnnnnnnnnnnnnnnnnnnnn

SEQ ID NO: 18960 - DNA, 1999 bp, Oryza sativa
  unsure (1)..(1999): unsure at all n locations
nnnnnnnnnnnnnnnnnnnnnnnnnnnnnnnnnnnnnnnnnnnnnnnnnnnnnnnnnnnnnnnnnnntcccttagaaaaactagctcagaaagccttattcactccacaagctgttcctgttgcacacaggtcaccaaagagttcgcaagaagcagcatgcttatagcttatgaaaacaacatgcttaggtaaatgaccaaaagaatctgatggcttctcatggacaagattaggctagtgagagctctccagcagggatattccttttcaccaatttctcccatgattcgttggtttcttctatgaccttcagagcatattcctaggagagagaattatacaatcagaatgcaaaaatatcctctatgtttaaatataactgaaggagtccaggcttaccttgcttgtgggtttgttgcccagaccaaatctgtttgcaggcttaccgtctggtatcttgtagtccctgaaccagtctctgatggcagtcaatgttccctgaataggtaatgtaaaatgtcggacaaagcaattgtaaaatatagagggggtgaaaactaactgcattagcaacatttttaaccctgcccatgtaacatattttaaatgcaaaactaatcaaaacttccaagcgaaaaaacctaataacctcagcaaaaaaaaagcttcagggtaatgcagtagtcatttagaaaaggatgtgcgcaactaggaatctaggataataattatggcaagagtaacacatctgtctttttctcatgttatgaataaaaggtaagtttgctaaaatatgttttgcttttaaaaaatgcttagccaaggtcagaattcaaaacagaaaacatttgtcataatctaagggaaaaaaagcctacattctatcaacgagataggcaatgccaatcagtggagaacaaggacaaacactaaaaataaaggcaggcatcagtcataccggaaaatgcttctcaacatcatccacatcattcacaagagatgctttaggatcatccaaagaaatagccacaattttccagtcaagctcaccctcatcaatcattgctaaagctgccaacggttttaccttaagaacatctccaatgttagcacgtctttcaccaatctcaacaacatcaactggaaagaaggccatcagcaagattggtcagagtggctgaagatgatatatgagccatatctaccaaatacaatgacaccgaaatgtttattaccaggatcattatccccaaatgctccttcgacatcggtgtttgcaagagttgggtcctcccatgtttggggaaataatccataattccaattaatgttgtacctgatataccagataattccatgatgggtcatgcacaaagttcataaacagggtcagcaaggacaagatgcacaatgttcatcaacaaggccagtaacagcataaaatcaattgcttgccaacaagcaagtttcacactgcaaggttgataccagctataaggcggaaaaggaacctgtccacaaaatatgtacactaatccttttcaaaaggactgaaatggaagtaacagaacagcctagcattgttttgattaagaaaaattatacagaaccatgactgcaaggttgaacttgaaagcagacgaaattcaaaccttcttgtagcacagttttgatgacaagagcaggtcagctaaatctattatatgataaagagaaggctaacaagagtcaccgcattcgctccaaggtcctagaaaattaccatattaactgaataaaaagagtaagatctacgcagttgtttatcatggtttgtccaaattataaagtgtagattgattgatatagttgtatacaaaataaaattgaatgtatagaaacagaaacaacagttatacataaaatccaactctgctttcgaataaactttagcctagctctgtgcaaaactgtgtggaaatccagctagttcaattaacatcacatctttgtaaagat

SEQ ID NO: 18961 - DNA, 6245 bp, Oryza sativa
aattaacatcacatctttgtaaagatctgctatatctaagatggccacattataccttgtgtgattccaccgccaaacatgggagaacaaaatgttcttttatggaatcccaaaagtgcacaaggtggtggcagctacagtctgatattgacaaaattcaagcagcccatctttttcacactgaagtaaggtcccacgaaagagcaccacataaaaaacacaatctcctacattatttccccagcccacaacaaatattgtaaagcatgaatttctggtatgaaaagagttgctattctatccttaaagaccaacctatcaacaattgatacaacaattgaaacagaccaattaaactctctaatacaacttcccccattcttaatgaaatttggtcgaccgaatctttcggccgacccggcaaaaaaaaaaaactcactaatacactaaaattattaataaaagaagatgcgacatcctaaacaaacaggataggattaaataaacaaaactcatgcaacaacattaaggatttctagaattctcaaacacgaacaagcatggacacaaaagaaaatgttacatttgcaaactaatcatggcatccacttgtggagtgaagatctcagaaggaattcccagttaaattaaacggccgttatatcctcgatttgcaagtcgctcgtccaattttaacacaaaagacgcaatattttcagcagaaacgaacataaacttagacattcagaatacgaatttcctcagtttctagtccttacgggtagtatcggaggttgcccttcttggtgtcctgcttgatgggggtgaatgactcgtcggtggcgacctccatcttggcgctgctctccttggggatctccacgacgaagtggaacaccccgtcgcctgcgcgcaggggcacgtcgtgccacggcgacaccttgcggcccccgccgtcgacgaggaacacgcggtagtcgagcgtctcgggcaggccctgctccttgggccggagctcggcggtcctgaggagcgcggtggtggcgagcacccggcgctggaaccgcacggccgtggggaggcgggccgtgcgccggagcccgacccccgccagccgcgtgaagcgggtggccgccgtagccgacgccgtcgccgccgtcgccatcgtcgagagctcgccgggggatcgtcggagttggtgcggagtgaacagcggcggcggcggcgggagactggaaagtgggagctagtctctccggatgacgaggcgatgggtacttgcggctcgcgtggtagctagcctgaccaggtgggcccacccccgtgatgtggtcgcagtcgcagacaagtgcggatagatcgcgagtggtgtttgggccgggccagatcacccggttctcttcgtgaaggataaggcccggaccatgtgtgaattactccggcccacctcttgacacgatcactaccaattctggcgatccaaatggggctcccggtggcgatgtacaccgttcgatcgaaaataaacgaccagatggagggtttccctcgggccattgtggagtttttgcagaaaagccctcgtatgatctcgtattaccgttgtgttggcggacggtacagatcggcttggaaggagaaaaagataactctttgcatattagtcctcgtactttgtagaatttaccgttccaactgggaatatgggagaaatttcagtatttatcatccaatacgatgacctttaaggagctgccactcaatacgttggcctttcaaaatttaccaccaggcacgcgaaattctttatttggagccactccgtccgcctgccccgccgtccatccgcgcgactgtctccgagctaggtggcgtcgtcgcccaggcacggtcatcgtcacctcgcatcccgcccccgccgccgtccccatccccaagctcgttcggcaccgtcgccaccgccgttcccaacctccatcgccaccattcccatccccaagctcgttcagcgctgttgctatgctcgcgccctatcgccgccgtccctgagctcgtctgccactgtcgtcgagctcgcattccgttccgccgttgccgccatgcctgagctcgcgtccggtcgccgccgtagtcacccccaagctcgcgttctgttgccgccgtcgtcgccccagagctcacgttccgctgtcgccgccgtcgcccccgagctttccgctgttgccgccatgcccaagctctcatccgatcattgtcgccgtcgcccctgagttcgtgttctgctgttgaaccgccatgtccgcaaactccgtccccgtctaccatctagacgtcgacaaaaccatgtgctctttcgtccctgtcgaaggtgcaatgtctctcgctggcaaccgcgacgggagtgagctcagggatgatggtcaagccttgagacgacggccgacgagctcggagacgaagacaaagacggacgacgcggacaagcagacggaatggcacgaaatgaagaatttcgcgtgtctggtggtagatcttgaaaggccaacgtattgggtggcaattctttaaaggttatcgtattggatggttaatactgaaatttctcgggaatatggggatcggagaagccgcaactcgcagccaaagccttgccggcgacggcgatgcaggagatgcaagcgccgccgccgccgccgattcttcttttggcgcctcaggtacccaaaaatataatcctgtttttttttctactgcttatccaaattgctcctctgttgcttaattacctacttgtattcgtgcaatcgtgcttgccttctctgggatctaaattattactagccctattctagttcttatgatgttttcgaggttggatttgaactgatttagaagaattattatagaatagaatgatgcctccatagaatgggtagatttccaaccatggtggaagatggaggaactaatgtacctcactcagatggcaaaacatcgtggatttgtggctacttgctaaagcagaagggcgttttggtgtcactgtcagtgtcaccagagccaattggaatggacccctagctggcaaggacgcatcgtgttcttcatgtgtccatcaatgtccggccaccgtaagatcggatcttgtgagttggtgattgcctttcgctgtttcgcaagcatgtagagagcttggatgtgcgccgcagagggaggcttgtctgaaacttgtgtagggcatggtcagcatgtaggtcttccctatgaagaagatggtaagcagctaggccagtctattccatgtcccaattactatgccaaacgacttccagatgatagaggggaagcacatgatgagaccttttctgtgtctgtttgacatggcatgattggtttcttgggaaatgcttgatatggttaccagcaatcatttatcatcctattttcagctgaacagttagcaacaaaaccaactttttaagcgcagtaggtggactggcaaaatcagtctttagtttgatatgtgcttgatcagaacatgtgaacgacttattaagtacttttcttaggctgcgttcgtttggagaataaagggagtgagtttgtttcatattccgcgcgcacacttcccgaactactaaaccttttgttttttgtaaaaattttctataggaaagttgctttaaaaaatcatattaatctattttttaagtttaaaatagttaataatcaattaatcacacgctaagggctcacctcgttttgcgtatcttcccaatcttctctatctcattctcctcaaacacagccttagagaggtttcagctggaacatgaatacatgatttgtgatttatttatttttattttttttggcagtttgattggtgtttccctaaagaagcttctgcattatactactgaatcgcttggaatatctttatgatttcaaataatgaggctccttgatctctccacctgaaattctgtagaactggatttccttgacgaaaaagggccccatctgctggcctcagtggcctggggacaaaacttgacgctgaaaatctttatgcctaaactgtaatattgattaatgaatattacagcccatagtcttttttttttcttttttgaagattgtcatagtctcaactaaaaatacaacaatgatattctgaacttattcacatgcaacttcgtaccatttttttgtaagtaatacagaactgatgcttaattatgatgatggcatcttatctagactgtactgtacaattacaatgatgaaacagacagataatagtagatgacatcatgggctaagtctcaatttatgattttttgagattctatactagtggatagcttcactcccataatattgttctagtactttgttcaaaaagatgaaatactataaatattaccttttttaatctttttgcagtatggtttccactatcaaccgactcttgaagaattttggcaaagtgcattagtctcggtgctggttgactctgaagtcaggaaattgtttttcggagcaatcagcgaagaaaatttggagtagtatttttcttaactctaatgcctaatcagtaagagaatataaattgcgacaacagagtatcaactataactaaataagccactaaattgaactattgcttttttttaaaaaaaaataaacagttgggatgtattagtaaatttcaaagtgtgcagccttctgaactgaaaatattagagagctgatttcaggtaaagaaccaaacctgatgtactttatcattcatttataaattacaataatgaattaagcagcgtatctgcttagataagctaattgtatgtccaacggataagatgcagcaaagaaggatgaatccttttctcctttccaacaaaaggggcattttcgtgaaggcaaagcaaacgcagatattctagaacgcatgatagaagtggccaagaactcgaaatgtgcaagaatgtacgcaatagcttaatctaatatagcatctcaaaagcctcaaatcattgctgcaaatgacatcaccttctgcatgtaagcattggatttcaattgaatatttgttggctctctgttaacctcatgtgacaaggttagcattaacccttttcttttgcaagaatgaaggttaacaacagcattacctccattaaacattctaatatacaatgccggccaacagaaaccatcccatgcatatttaacaattcatagtgtttctgttcttcagttgtggttgttaacttgttattgttgtttcagtggcgttcgcaaaaaaaaattgttgtttcagtgatgtccatgtattggaactgcagctgcataaagaagagagaagacactgtcgttctacagggagcatcacacaacgatggcaacttggctatatcagtagctgactaataaactactcagctctaatggcttcatcagcccactgctttggatgaaactagctgcatgcgcaccatggcactaacttggcttgggtatgtaattatttccctttcccttaatttctcctggatattgacctgaccttcagagagagagataaacatttcagtgcgtctgattcatggccgaatcagctcatcagaggtgcagcggaggtcgttgtggaatgtatgatgatgtgccacgcacggcaggaggatcggattgctgggaagatacgcccatgtccatattcatctccttttgcttttgtcaggcgccgcgtctcgccggctggccgccgcggccaaaaaaaggagagcatatgctcatcactggatcaaactatgtctaatgactccacaaagtggcagtgagtcagagctaggcagctccctagttcttgttgttcaagtgaagataatcttggttttgaatacctgtttggaagtcagttttgaggataaacttggaagattggagtcttttaccatcgactcacacaaattttaaattgcatcatccatttgtaccctttttcaattggaagatggtaacaaaaagatcaggggtcaagtttgtattatctatttgtacctttttttccaattcaagtttttacaatgtatttgggctgtctccctctatcagatcctcaagtgtggaaagtatatatattaacaagcagtccatcttatatagagtactggattatggaatttttttaaagcaattatctcattttcagacaatgaatatatgaatatatttct

SEQ ID NO: 18962 - DNA, 3044 bp, Oryza sativa
  unsure (1)..(3044): unsure at all n locations
ccagtgtatataccactggacatggcaactttcatgttgtaaatttttatagtagtgggtgtacaagttcatcttggcttgtgcctaccaggcagcagcaaccagtagcagctagcctaggttgcgatcgaattggatgacaggctgaaagacagagagaaccgaagccgcgagcgcaagagggattagatagaattctgacgcagagctcatcgatcgaccgatcagaaggttctttgtgcctagcttttcgtgcagatatgcagaaacacgtacgtagtggacgctggaggccactcactaatcgtgtgtcaacctaattaaacactcccgtccctttaaccacctcgtaatcttgtactgtaccacttacggattcctcattgagtcattggtttttattaccaaaccggatgctacgtaattaaccaggtgcttttgtgatgactagggtaagcaaccaaattactttccaggaaaggatacattcagttgcatgcagctgatgagagagagagagacaaagacgacaatattttataatatctattaagaaaattatgagtgaaattgtttacatactacctctgtttttaatagataacgatctttttgtcacacgtttaaccattcgttttattaaaaaaattatgtaattataatttattttgttatgagttgtttttatcactcagagtattttaatcatgatttatttattatatatttgtataaaattttttaataagataaatggttaaacatgtgttaaaaattaatggcgtcatctaattaaaaaacagagaaaatatattattctaacgacttaaaagccgatgtaaaaaataaactacgataaaaaaataaaattagctctatattttaatatttaatatttcaactttggttgcagtcgatatgctgctgtaaacacggtagagctcaaaacactagtaagaaaagtataactttcggactctacgagatcaacagatgaagttaaaggcttaaagcctagcggtactattttccgtgggtcgcgaggtgagaagagaggcgatggatgcatgcacgcacgcacgcacggatggatggatgcaaatcctgtttggagcgcaccatgccggcatggaagcacttggcacatcagcaagcactagctgctatgctagcttgcatgggccggccggagagacgccctgattgcttccattaggtttggtgcccctctcatgcgctgagatcatcacactcgcgatccaatgcaaatctcagagccctgattgcttgttgcttgatcgatcgtatctttgggttaaaatgagggagaagagaaagggggttagaggggagctgtgcatgaatgatgtatgcaccatggatagttactcgctcctatgtgtcggaactacatatcttcaaaaaaaaatacgtgcctttttatttatggttttgatagggttcacttgttgaaacagggtgcaggtctatcgtggtttcctaagtgatgtgtcttgcactcttttaattaaaaagaatgaccgagcgaggagtgaagatagctcgatcgattagggtctatatagtggaacctatccacgtgaattcaaatctcaaacttaaacttgcatacaatgctcgtattttttataattaatctaatctcgtaaagtatgcatggctacatacacacatgattatgttcagtggtaaagtggtgttcttgcgttatgagaggcaaggcctctaatcttgtttagatgtggaagagtgtggttggtgtccgtgagtatgttgtgcgcatatggttacgcttgagaaaaatgaccaagatataagtagtctaatggctaagatcattaatttgatgtaatatgacaagcaaaacatcatgctatatgctcacaaaatagaaaacataagtctttcatgtggcgagtctcctgcatctaacgactctcgaggatctcttcatgcaccatctctactatcccctttctcctttgcggcattctcaatggcgtcgagaggcaagcaaatatgttagaaaggtatatgtctcttgtccttatggagtaactatgattttagggttttttaaaacaaagtggatgaggtttaaatctattagacaatttaggtgtctttcgtctacggtttagatacgtttagagtatcttggtttttgttatctctctttgttgatgccttatttgtttgtgtgaaccttgatgaaaatctaggtgtctgctggtgatccaactagcgacacttgattcaaggttcgagttgtagactcctttggtgatactggtttattgacctgtcaaaagaatgaagatggcgaccaatgctcgttcatatgcttttgcacgtaccggggttggtcaacgttatggatgtgctcgtctacttacatgtcttttggcaatctaagatgctctatttgctaggttttatattttctgatgttgtaaaacacggttgtaatcttttctcttatttgatatatttggcatggtttctactactataaaacgtagtcgccctccttcctccccttacgttgcacacacgaccgccctacccttaaaactaggaaaaaaatggnnnnnnnnnnnnnnnnnnnnnnnnnnnnnnnnnnnnnnnnnnnnnnnnagaaaatcagagaaaaatggttggttaaaacaaatggttggataccatgagcatgcgtaatccatccctgcatgagcccattgcaatgtacggatagtcgggcatagcatagaataaaaatccatgttgtatacccctcaagtcgttttgactttggttaaagtcaactacttcaagtttgatcaattttgtagaaaaaagtagtaacatttttaacccaagacaaatatattataaaaatatattcaattattgtagcgcccgttccgtcgtggcacatagcgggaaaactatctcttaaaaaccctatttgcgaaatctgtttctttgnnnnnnnnnnnnnnnnnnnnnnnnnnnnnnnnnnnnnnnnnnnnnnnnnnnnnnnn

SEQ ID NO: 18963 - DNA, 3259 bp, Oryza sativa
  unsure (1)..(3259): unsure at all n locations
nnnnnnnnnnnnnnnnnnnnnnnnnnnnnnnnnnnnnntgtctagtgtccgtgccatctcagatctcaaatccccgatctatcgtcgagttcaatcccgaatccaaatccttcccaaatcaatccctccgcaaaagtctgtttcgcctccctcaggttcgatgggccgaatctctctcggcccatctccccctccctccccggctatctctctctctctctcgctctcgctatctctctctccctcttctccgctctgcccgcgcgccgcgcgcgcgtgcgcgtgagccgcgccgagccgagccctccctctccgctcccacgctgccacttcccgcgcgccgttgttcgcgtgcgcgcgcccgcgcggtcgccgcccgtgccgcgcctgcgccgtctgcgtcatccagccccgcgtgcccgagcagcgccgctcaaatcaccgcgccgcccgttgcttcccgcgcgcacgtgccgtggtggccgaccgcctggtcgccgccgccgtcagcctctgccgcgcctgtccgcgcctgccacccgtgtcgtcgccccgctccaaaccgccccgccgtcatcgccgtcatcatcgcccggcccccgccactccgcgcgcaagctgccaagggacggaggcagagcccctcctccctctgccgcgtcgcccccgctcccctcctccttttcccaaagaggcaagggggcaagccccctttctctccctccttttcccctttttcctcccgccggcgtcatcctccgcctctgtcgccgttttggccgcgagcgccgagcgccagctcgcgccttgaccgctcaaggtcggtttccaaaccgacatcgtcgtcctataaaccaaggcgccctcccatcgattcctcctcccgtttcgctcgccgccaccacgccattgccgcccctttgtctcgcctccgccgttcatcgccaagcaccgggagagccggtgcgttcgtggacgcggaaggggactccgggcgctcgtcttcttcctcttccccggcccgaggccggagagatcactcccgcgccgtcggcctctcgtcactgcgcccgcccgcacggtagtgcctccctccgttcttcctcctcgttccatctcctccccttagactcgggtagtagcacgagtagcctccccgtagttagccggcgccgccccgaccgttgccgtcgctcgccgtgtgctcgccgccgtcgccgcccgagctcggaagcgcctctcgtcgccggcctccctcgatgcgtttcctcctaatccggcgcaagggacggattcccgtagccgcgtggatgctctcgccgccgggaatcggcccctcgtgacctcatcgccgttttccccttttctctccgccggttgccgccgccgcaattcgccgccgacaagctccctccggcgaatccgagccgttggctcgtctcccctcgtcctgtgcagccacccggtgtgctcgctttcgccggtatcgccgtggttcgctccgccgctcaccgctgtcgtccgccgtccgttccggctggcatcgtcgtctacctcccgccggcccgcgtggcagccacgtaggcgccacgtcggcgctagctcggccaagaccgggtcgagccgaccccgatcaggcccttcccgtgcgcgcggtccaccgcgagccgtgaggctgcacgtgggcccgccacatccgcgtcctccgcgaaccgcgcgcgtgcaccgcgtccctcccccaaaccctagcacgcgccgcgtgcgtgttccgcacggtgaaccgtgtcaccgacaagcgggtcccactcgggaccacgcgaggtgagcccggtccaccggctccctctctcctcccctcccgcgcgcgcgctctgagccgccttcttgggccggccggcccattaagctcggccgagccgccctttctctcgggccgcgccctagccgcccgagagaagtctaatttccctccccctttcccttttcttttcttttctttttcaaaaaggatttaattaaatcctttttcctttagaccaaaaatccaaaaatcttagaaattcgatatcttcccaaccgtaaatccgtttgactccgttcaacttccaaaattcctcaaatctcgagatctatctaatggcacgcttagaggtcattaatagggctttattttcgccgtttgttgagtcgtcccgttttgcgtgtagtttcggagcccgaagacccgcagtgcgaggatttcgaggatcaagctcaagatctcgagcaaggcaagccacctttgaacatattgagcctatatttgaacttaattatattgctcgcaaaatattatgcattgataggattgcacttaatctgtttgcaccgtctgcaaggcagaccggtgggcctacccaacttgttgcatctgatccttccattgttaattgttatatcatgttcccttgtaaccatctagctgcgcctcgatattcgtgcactctgtgcgagtatcgacggtcgccttcaaacttaaaatctgagtaacttcttgggtaaaacttgggttttacagaagacttggaaaacccgacacctgggtcggtgcttgcgaactaaatgaatttctaaaaccgcggaccggggaacgtaccgggtgtacggtttcccgctcttgcacttaaggaccgtttccttggaatttcatccgaacataagacaagtacgaccacatgggtggaatgggacacccctgactgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcagctttcgaaatgccttgtcatgaaagcttggaggtctctcgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgccttgtgaaattgctgttgtggaaatgggatcgatgtttggaaaatctgcagctgatgggatcagctaggcccgggtggccgtttgaaagttgttggcccgggtggccgtttgaaagttgttggccgggtgccaaccttgaatcaattcaaaagactgat

SEQ ID NO: 18964 - DNA, 14299 bp, Oryza sativa
aaagttgttggcccgggtggccgtttgaaagttgttggccgggtgccaaccttgaatcaattcaaaagactgatactttgcacatactccgaccggacgagacgcactgtctcatccgtgtcgtttgagaagcactcacttagttgatttcagaaaagagttcaaataaaatcaattgcaaaaacaacagcctttccttgaagcctgcattaaacacttatttcccatggcttgctgagtactcctgtactcacccttgctctatataaatatctcccccccagttgctgaagaagatgaagcggatcccgctgacgaggagttcttccaggagcaagccggctacgatgagttttagagtttcggcctagttcccaagtcacgcctgtgatgtttggtccaagtcttggcttccacttcccttttgcaatgcagttgtgagctcgggatctgtccgcagcccaacatgactgtactcctactctataataaagagacctctgttgctgtgatattctgtcttcctgtgataccagcactgtttcctgggactggtatcgattaacaggttaatttggagcgtcacgggctagttccggtcgggactagttcggggcgtgacaattattgatttaatgagactaatttggtgttgtaaatattactatatttatctataaacttaatcaatcttaaagtagtttgaccttgaccaaattcaaaatgagtaattataatatgaaacagaggaagtagtaagtaagacctgatacataaaggccaagctgagcataagtgtatggttaaaccaaaatttgtggcttaaattatcatgaatatattgtccattctccttgtaatgttacacggttacacccatatataaatatatatgcctttatattacactgtcgcacatctcccagaagtgatagcatagtgtaactctttatataaacgaaatgaagataacaattatatatggtttttctgagaatcttcagttaattaattagcactccaagttaaactgaagataagagtagctagcagcaaccaactagctagtcagcattgatgccacatcttatcagtcgaataacccattgacagtattctccctactggtctctagtctctacacatccatgtacaatgcatgcatgcatgcacatcgattgttgtcggtacacaagcactagctctgctagacaggggttaacacaagtagtaaaagcctaggagctgcagatcagagaagttccagctgactcccacaaaccttgacttggacggctctgatcatgcatcctcttctcctcaggtagccaaaaagagacatgacaaagttgcaaaacccatcggcagtatgtgctcactgcattttcccggcaaagcagagagaaaattaaaaagacgacgcagacatatagccctttctttctctctctcctttagccggaagtggaatattaaacaagctggaaacatacaagccagcactgctcgcaacaacaacattcagaagagagagaagtatagagagagagaggggagcatgagtcagatccatgatccatcaatggcaccacacagtccacacttgggcatctgggcgagacgagacgactaatccaacttcgatagcaacggttgctgctagctgctgtgctgaacagtgcagcgtcgtgcagctatatgcctatatatatccctcaaaactcattgcctctcctcatcacagccacaacacctagctagctgcagcttgtgtgcgagctactcctgcagctagctactagctacagccaaagattaccagcaacagaaattaactgtgtgagacgtcgatcagatcgttcgagagaatgggtgtaggaagggttatgaacgatgcgaagccgtacctggcgatgatactgctgcaggtggggttcgccgggatgtacgtggtggccgtcgcctcgctcaagcgcggcatgagccacttcgtcctcgtcgtctaccgtaacctcttcgccaccgccgtcatggcgcccttcgccctctggttcgagaggtaattaattaactagtactagagcgctgttagctaattagttagctcatcaactaatataatctctttctctaagtcaagctagatttaattaattaaacttcctttcatcgttaattagaacgcatgcatgcaaaagcatagaccatgcattgtttgtggtttgtacaacacacgcatgagcttacatgtttgcctgaagtctgaactctgaacaagcatgaataatgaaaatagctagtcttgcgtgtttttctattttcacaagagatgggagtagtccatttctagctatagctagcactgctgttcgttcgttcgttcgttcataagccgggtgacgtagcgttttaattagtccctttcagagttgatggtgcatgatatgcatgctccacgataggcacttctccagatcctaatatgaaaaagcagcttgtcaattccattatgtatctgcaaatttaacatatgccgatcgaaattcgaaaagtatatatttatgcgcgcgtatgctttcttttcccagctagcttttaatcccttgaatgtcacgcgttaaatcagcttatgcacatatatattccaactagaatctatagatcccagacaagaacagcagcggtacagaaagcagaaaatgacaccttacatattaaccgtaccataatcaaccgaattttatcaccatcaatttagtgacggcctagctatatatgtgttcacttagctagttgaatcatgttcttagggccctcctagagttgcaactagcaactgctgcatgagcattttcttcagtaatctcagcttaataacctaattaactgagctaattaattaatcagtggttggctttaataactgattatttgctcctacttgatacaggcgagtaagaccaaggttgaccctcatcatcttcctgaagatcatggggctcgccatacttgagtaagttaattacaagtcaaataatactaatacgattataccgtacatgcaattcagctctagtcctgacacgtgtacgtacttgtcaggcctgtgcttgatcagaacctgtactacatgggggccaacctgacatccgccggcttcgcctccgctctcatcaacgtcctccccgccgtcaccttcgtcatggccctcgtcctcaggtaatcaataattagcatataattagcatgtggattaatcgtttaatcagcatggaatgcgagagattaatggtgaatcggttgattaattaattaattaggatggagaaggtgaagctgaagagcgtgcacagccaggcgaagatcgccgggacactgttcacggtggccggagcggtgctgatggtgctgtaccacggcccggtggtgcagttcccgtggaccaaggggcagcaccacgacggcggctccggcgccggcggcgcggcgggcggcgggttcctccagggcaccatcttcatcgtcgtcgcctgcgtgtgctggtcgggcttcttcgtcctccagtccaacaccctgcagagttacccggccgagctgtcgctcaccacgctcatctgcctcatgggctccgtcctcagcggcaccgtcgccctcgtcgccgagcgccacaacacccacgcctggctcatcggcttcgacacccgcctcttcacctgcgtctacgccgtaagctcgatctcttgctcgatcgatcagccatggcggtgttcgccgccggcgagctgtcgcgcgctgacacgatgaggtgaatggatatgcagggtatcgtgtgctccggcgtggcgtactacgtgcaggggatcgtgtcgaggcagaggggcccagtgttcgtgacagcattcaacccgctctgcatgatcatcaccgccatcatgggctccatcattctcaaggaagaaatcaaccttggaaggtactactctacctcgtacacgaccccattatactatatatagtaattaatcatgattagagtgaataattaattaacggtcgattggttaattaattaattgatttgtttgtttgtttgttaattaattattgcagcgtgatcggcgcggtgatcatcgtgatagggctgtacgcgctgatctggggcaagggcgccgacaaagtcgagcagacagacgccggcgcggcggcggcgggcagcaacaagggcggcggcgagctgccattgacggcggtgcccaacggccacggcagcaagcacggcaacggcggccatgtctacgacgtcgagacgccgccggcggcgaacgggcactactagcctaagcacatgcagcagcagtccgtcatcctcggcagtccattgtaagctagttgtggttcgatcgaccatcgatcgatcgagagcgtgacacgatttcttcttcttcgtcgtcttcttcttcttcttcttttccttcttgatttctcctaagaattcttgtgaggtattaaaattttcacataatgcaatgtaatggataaggccaggacgtgtccggaagtgcttgcttaagtaatgaatcacatattattctctctagctctgctgtcttacgtggccggagctgcaattaatttacttgtcaattaactatagtgcaaatgcctttgcttaatgcatgtgttgtcaacgagacagtactgctaatctgctatactgccatctccgttatttgctcttggcgtgtgtctccactaattacaggctttttgcgactaattaattgactcgaaatggaatccaaatgtacatgcaagctggtatagctttgatcgatgcaacggcatgcattgattgatctgtgcatgtcgtgatctctgcctgccgttttagctagctttaatatgtttggctttggtactgaatgacattttctaatcaaagtcattaggtgctgaatgacatcgattgatttaacaatagatcaacaggcctaaacattctcttctcatctctacttttgcacagtgagtgactgactattgctatctctggtatataggaacagaacatgtcctctgaaactggtgaaatcctagctagacatagttcaactggtttggattggcccctttaaacagtcaccttctgtactcaacttcttcatcaatcttatcttaattatctctatggaatcaaacacgtaaacctagctacctagctaggagcagatagtttagctatctcttgctaattgtctgaaaaaacagagaataactaatttggattttgattggacatcatatggatatgagctgcattggggccggatcgacatgacgacgtaagatgatcattttgtagatgagcgacaggccgtgttgggtgtacacgcatgctgacgtgcgtgcgtcgcatataccatatgatggaaatggcagatcgatcggtagtcactaacatcagcactaattaaaaaaatccccgggatcacgggagatatttgggatttctttacggtaaagagcaggggatatgaaccaaattctgccgtatcttttagtgctcgttcattgtcttattaatgacaatttgtttatctttattaactaaagttagtgtgtgtgtacaactgaatcaaagtgtgcgcgtagtacgtgttctattagtttgtgcgatgatataagttagttcacagtacagtgtgactgtggagtctagaacctataagtctgtgataattcgagagaaattatatagttttctgtaggaaaaaagtataattcctgtaaatttcaatatttttacaatgcctattgtaacgcaccaatatttactggtatgacgaggtgtgacgatagaattcccaggcttatttagagagccgatgcgaagctggtttataagaatttagaaaatataagtttgtcaattcctactctccagtttcgtaaaaaaaccatttaaaggtaggctatatctagatttgaacgcatgagtttctttttgtgggacaaagatagcttctactatctcattgtctagattctaagttaaatgcatgtttacttgcttgtcattttaccctaccaaattttaataggatagtaaactaaacacaaccttaccattatcactccaccaaaatttgataattctagatgtttcctctcataaaaacatcatcaatatttgacaaggcaccaaatatatctaacgctattctttttcgataatgctaaaatataccaaaatttaacattactctatccatttcatattataagactttctactattgcccacatttatatagatgttaacctataagtcttataacctgaaatggagggagtatcaaactttaataaggctaaaaatgacaaccaaagagaacaaccactgtgtgagaatctgcagccgctgaaactcaaccttactccatccatctaaaaaacaagctagtactggatatatctctattcgttgtattataatgtgtcatatttagtcctaaattcgtttttttacggagggagtatttcatttgtcttcaccatggaagaaccggtcccacttaccatagacccaccacagtagtacactacagtagtgagtagtactgtcagaccctgtttagatgggactaaaacttttaagtccctattacatcggatgtttggacactaattataaatgttaaacatagtctattaataaaacccatacataatcttaaactaattcgcgagacgaatctgttgagcctaattaatccatgattagcctatgtgatactacaataaacattctctaattatggattaattaggcttaaaaaatttgtcagataaattagctttcatttatgtacgtaagtagtctatatttaatactctaaattagtgtttaaatacagagactaagagcacccgcaatggtaaagtagggtgctctctataaaacatgtacatctcagcaatagactagattaatagtaaaccacctcaatagtatgtctacataggtatctatagctctctcatgcattgcttcgtttttctctatagactatctctaagctagtagatagctttgctctctctcttcatttaatatcttccaagtagaaaaatatgctgacatggatctcttgtagatagcttatagataaccattgtgggtgccctaaagtttaagtccctaaatccaaataccacccgacaaagcccacctcacgggcacccctaaacagaagttaataatttcaaaatatttcctaaagccggcgctttccttacgctctctcccactccgccactgttccagcttcccctccccgaaaggcggcggagatcccaaggtcgtttggggatgccaccggtggcggatacatctccggcgctaaccctcgctgtcgcggccgcggtgatagcggccgcgtgcttcctcctctgcgcggaggcggtgtggctggacttgccccagtcggggaccaagtgcgtgtccgaggagatccagtccaacgtggtggtgctcgcggactacgccctcatgtacgagtcccacccctcctcccaccccaccatcgccgtcaaggtaattccccacatttctagccgtctctcgcttcggattctatgatgcagtgaggcgcttccgttgttttggaatttttggatgggctccgatctaggttgcggtagttttggacgaattaggtcaactccatggtagaacgatagatggatgattattccgtgaaacggagcggtggcgtgaagtttttggttttgctgcgggtttagagatgcttagcgcacattatattgtgctggaataatcgttgaactggttgagtccttgagtgcgagggattatgtgttattggtgcagctgtgctcgcgaaagacagaaaaagtttgtgcctagtgttcaccggattgcgatgggagctgaaacttggaatcatatattctttgtgtaacctgctaggaatttgttgttctctaggatctagtgctctgtctagattccatttgcatcgcagggaatgatgatgatagtattctagaataactggctgatgcgtcaagtggattggtatgattcgcattgatgacgcagggtatgcttacatatgatccacaaaccgcgtcgattccttctgtctaaattgcggtggtttctgtccaggatgtcactcgtaacagaatacaaggtgattcatcttacagaatcacacacttgcttttctagcgacttctgtaagaaactccatgggttgtgggaagtaaaaggtgatcaataagaatcgcatcgatgcgaaataatgagaagacaacgatgcaatcatgttattatgtgatgtgaaattaatactgtaatgacttggtaccatatgtgtatctttttattcggaatcatttgcatgaatatgacagtgtgttgccatgctttttgcgttcgaacaaacaaggggacatactgaataaatagactaacgtgtagacatatggttgataaattgcgagtgccgtataagattgaataagtagatagacttaggtgagataatggtaatgtcatataaattattaattgtagaacccacttaagtgagcaggtgatatctcaactctttcttaatattattttccttgaaaatgcacaagaggaacttcatgggactaaaatttccaattccaaggcaaatggatggagtagattgtaagggttactagggttaaatggccatgcaactcgctatatactagtttctttagtctttactccaatttatgtccactgattgtaattttatttatgtgaagtataatattaattcattaggagatctattttcatccatgaattagtactggctagattagacactaagcatactatttgtgtttgctccattttgaacagtccttatgttttttcttttcgcagctttcgaatcaagaatatggttttttttttttactgtgcgagtatcaatctgcagttactgcagtccactaatggagtaaacgatgctactccaatcctctcaagcttagcatttcttcgagaagcttagcaatttgcttttacatgatttgttgaatgaattactatctacttgtgctgttatagttctgcaaatgcttatgcttggtgcaggttacatcaccatatgggaacaccttacatcacaatgaaaatgctacggttggtcagttcgcattcacaacttcagaagcaggaaactatcttgcatgcttctggatagatagcgcagagaaagggtcaggaatatctattaatcttgattggaagattggaattgcagcaaaggattgggatgttatcgctaagaaggaaaaaattgaggtaggagtaggcttagccaaactgctgacggtccatatgaccatatttcactgatgtccagtttaattcactgcttctctaattgctgcaatctaattccttttgtagggtgtagaactagagcttagaaaacttgaagtggcagtacaatccatccatcagaacatgatatatctcaaagcaaggtaagttttacttccacatgattgacttactgtggttgaggctttaaaacgaatattggtggtactaatagagggttcagtagattgccaatggaacttggaagtggtaatgaaacaatcatattgtcttcaattctcagcactagatacattcaaccacaaagagcgagcattgtttacaaaacttacgatctgcagtccagatctgctttctactttgagaaactttatatttcaagatctgttgcgattgaacccagtcattgcccttatatggttaagaaatcatagtgttatatgagattatgtgaacttgaagacatttattaccgccctacaggattttaaattagcggcaaatctaatgatttatttgatttgttcatacagggaagcagagatgcgaacagtgagcgagaaaacaaacgctagggtagcctggttcagtattttgtcactaagcgtctgcattgtggtttcaattttgcaattgtggcaccttcaagggtacttccagaagaagaagctcatctaggttagctcgcttgagctgtaccgtgactccaaaattgcaaatgttgttacattggggaaaacagttttgtcatgttagttcgaacttcacgctagcgaggagctgcttgtactttatgtaatttaaccatggttcagtttagatgtgttgtgcattatgattgcaaataggtgataacttaaatctccctggaatatttgatgccttcaggacatagattacaagaaattcatcgtcttataatgggatgcaaaaattgtggcttatgtggtagtgggcggtggtttttcttccatttgctttagctattacagatgtcatgtaagtgtcatagtatggtccgatccttgtaccagtaaaccggcttagatggaaacaccgatatgagaaggccaattatctagcatgtctttgtcctgaacctacagtttctgtatgggacaaatacacgttaacggatgaatcacgcacaatgatgcaaagtcaaaacaaccggagcaacatcgtcagaaatctgatcacagaaagaggctaaggccctctttatttagactttagactgattggcctagacttttaagtcagcttattggcttatatgatttataagccagtggatttaatgtcctaagtttaatggtagagttatacatctatctcatataagccaaaaaaaaagcttctccaacctagtttttggcttaatagtgttagagtggcttatggtttaaaaaagccaaatgaaaaagctgcttgtttgttttggcttagacttttcgacttataagttggcttataagcctaaacaaagagggcataagctggctaacttgctattaaaattttcatacgttcttaaactaaaccagaaaaccaatgacagccggcctaagctgttaacgacttaagcattcacatcccaaaattcccaagtcctaacacgtatccatccctattctagtattctgataactctcaagctcttgatgatatcaccatgtccgcgtcgccgttgcgacgacggcgagcaccatctccagctttccagctgctcctcgacgccacgcagccgcagatgccctcagctctgatgatttctacgctggcgagcctgagaaaaaccagtggcagatgcgctcaccatgggcaaggccggtgacgccgagcaagcggtgcacagcactgcgccggcggccggccacggctccgccgtccgccggtacgccgccacgattggcggggctgtcgatgccaagtgtgtccttgtgctgttcctctccatcggcgtcttcgtgctggtcctcttcatgcttcttcctctccatgaccatgcatcagaaaccatccctgatgatgaccctggggtacttcctggtaagaacactttccttctgcagcaactttcagcactgattaaccgtctgatcatataaattgacaagctacatgatttaattatgtttgtaaagtcagatgcattatccccaaaatccagacagtagaatcaaaagatttcgtaaccaaatgatctcaaatagtggtagattagaagataccagctactcatgctagctaagctttcagcaaatatgaagataaagtgtgtcaagcttacctttatcctcttatgcatctctcaaaagaaaacgcctatcattcctccaggtgaaattcaggctagcttcttcttgttaaagaaacgtcaacagctcattccacatgtcagaaggctacaaaaggacatatacagagaaatagggatccccaatactacggtatgccattattccactttgacaaaagaatttgtcttgcactcaagctatactgaaatgatcgctgaaaattttgcaggtttcggtttctatgcatacatccaaatataaggattccacttatgtaaaatttggtattctaccgaacccaagaaattcctccataagtgcacaatccattattgccctgagaaaaaacttgatacaacttacgcttgagcagtcgaatttatctttgacatcatctgtctttggagatccacattgcttggagatcttggggttcccaggagggatcacggtgcctccaccacctgatggcaatatatgcccaacagctcttttcaatgtcacactcaacatgactatacaacaactaagggtgcacctcaaggagctagagagtgagcttagaattatattgcagctgacaccatatgaggtccatacatcttatctcatctgatatagtcagttactccctccctttcacaatgtaagactttctaccattatccacatacatatagatgttaatgaatctaaacacatatgtatgtctagattcattaacatctaaatgaatgtgggcaatgctagaaagtcttacactgtgaaatggaggaagtatttgacagcaagtgacaacattttattttgtgcaggacttaattgtagagataacaaatgaaaatggttcgacgatcaacctgcccgttacagtccacattttaattgccccaaactatcctagcaattatctagaaacctacagactgaaacaactagcccaaatcatcattaaattaattccaaaaaaccttgacctaaacccaatatttggcatgattgagaatttgtggctgtcaccatgtctacaaagttatattccatcatgtgctcctaatccagctccagctccagcaccatcactatccccatccaatcctgaacatccacagccaactaccaccaagccttatggaagtttttcatgcccggctttggaaagaagaaaaactgtctctgtacatcgcaggttatcgacgatatctcccatgatggtaccaccagaaataccgacgaggtttgatagttggagtgtacacactgacaggaaaaatcgctctccacttgcaaaaccaatgtcccttgtgccagcatccccatcaaaataagtaagttgcttatagaattaccaagctagtccttaagtgttcttatattgtttagcaagattgatgcacgtttttgttacatcttagagttataactatgaaacatgcattaatgtaaattagagcaaacaaacaagagtaaattagtttacatgacagcaagacagggattcagatgttaggttttcattttatcatctgaatattattatttctatgataaatgtttatcttagttataaagagttgaacacaagtttcagtattcgaacctcaagttgatttattttatctgttatccatgcactctacaggccagtgccttcaggtcagataactgttgttactgtcttctgcagttgattctacacttgttccttcaatgtgattttgtcagttacatccaaggttgcatgaagtgcttctgagcgaaagtcctacactaatgcagagtaatgctcaagaaatcttaaccaagtgtatatatgaaatggttaagttctctttttgaccaaaaacactgtaggggaaatggttaagttctttagcagtaagatggaaaacctccagctacgggtggttaaccataagtttctttaatgcgttcagagatttttcatccaaacagcttgtgcatttgcatgagttatatagattgctcttgtcccaaagaaccattctgtgagtatatgggtaacatcttgtgctcagatgctcgcttatctgtatttttatagcgatacggatgattatcaattatataagcaagcacaacttattctgaaccgaatagagtatccagaaaaattagtgtataatttctcaaatccatagagattaataaagattacaacaagtaaagatcacatatgccatccattatccatcggcattctcatagctgctgactcaaaactggaagaaaaaaaacaccttctgaaagaaactgtgaaaatatcttactgatcaaaggcagaaaacactttcttctgcacgagctccacgcttagacgaggcgataatctgggaagcttttcctgcaaaacgatcattgatatgagctatgatgacacaaactctagactcaaaacacctaaactgaaggccaggagcgagcgcgattgggaggacgacaccacacctcgctgccgtcgggaagaaccttggcgagcaccgggatctcgtactggtacatctgctcccaatccggattcgtcgtgatgtccctctcctgatcgaaacacaaa

SEQ ID NO: 18965 - DNA, 883 bp, Oryza sativa
atatttggctgaaaggtttatgagactctacgagtactgtaaagtcatggactcatggtaggagtatatttctccgagcagatgcctcgcgtcgtcgtcggcggcggcgaccagttcaatagcgtaacgttcacaacgactggcggagacagtggcaagaatatgcaggtgaatattcgtgaccggcacgggcagcattattccgcccgcccatccgctccacccgacgggacgggaccagtcaccagcctgacctctttgggcccgacagcattccaggtccacggttattcgaatcctgcctgattctctccagaataggcccacattcacatgccgatcctatgggccttgctgcccgcatggcccaaccgacacagttacttcccgcgagcgccaatgtcctcctcttcctcctggccggcaagcaagccgcgcgcttttgcaccacgcacaagtcacccgcgcccaacactgcacgcgcccttctctactacgtacgccgtcgcctcaccacgccacacgccgccgcgaccgcggaatcgctttcgtccacctcgcaaagccatcccttcccacccgtgcactcgcttaatttccccgcgcgcgcgccgacccaatcaaccgtcgagctctccctctccatggcgcaatagcgcgcgtgcccttaaaaccggcgccgtgcccatgcaagatgcataccccacgcaagattttcccgtacagaattcgagcgatccaagtggttatagcttagctgtgtgatcgatcgatccacgccatgtcgtcgacgatgccggcgcagggcggcgtgcggcaccaccggacgtgccgcatgtactggtgctaccagtgcggccgcgccatccgcatcatcgggtac

SEQ ID NO: 18966 - DNA, 502 bp, Oryza sativa
atttgccacgtataccaacaatacaaaagaggtagtgacagctggtcttctgtaaccctctacgtagacaagcctgaaatccaggagggtcaaaaggccaagatcaaagaggagatagcgaccaaaaatgaccagcctcatttttcaagcagactaacgtcacctcgtttagacatcgctcgattagtcgattgcgatgtgcagagagacgtttcattaaaaagacgccttcaaatctcacactttgctaggaatatctctccctataatttacaaatacgacaggtagtccaatactaccccctaccggtttcattgacaaccacgataaaccgataaaaacacgatggaacttagacaaattttatcaaaaaattgaacatttgtttggataattttgaaatatggatcaacttcacaacacatcaacaccaataaacccgagaaccgagcggttatcgtcgcattttggaactcttgtccctctctcagcatgtacatg

SEQ ID NO: 18967 - DNA, 616 bp, Oryza sativa
caaagatgcctttgtagattgtgtacaaagtttaaaattccacaacttgatcttgctgaattacctgtattgatccatctgtagctatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcgtctcgcaatttacatgcaaattatacaattagttttttttcgtccatatttaatgtttcatatatatatctaaacatttgatgtgtctaaacatttaatgtaacagaatttttagaagtttgaagagaactgaacacagcctaaataaagccttattttgcaacagatgtgcgtccgtctagttactcgtctactacttttgtttggttttctttcctgaccagctgagctcagcaccccgtaatactgagaatactgtagtatt

SEQ ID NO: 18968 - DNA, 3932 bp, Oryza sativa
  unsure (1)..(3932): unsure at all n locations
tccaccagggaaccgtgaggcccccctttgtgagttcggccgggggcagcgggtgagatttgaggatttggtgagcgaaactgtgtggtcttgagggggttagatcccccaaagatgatgagacaaaaggggtttatatagattcgggcagctgagatgcgtagtaccctactcctgtgtttgggattatggatgagtgttacaaagattccttccctccagagagctctttcgccctacttctcatagagttcaggttttcttagagtcgtccgtttttttctcggtgggcaaggttctccttttatagttcaaggggataccatataggcccaacaacctaacttcctcgggaagtattaccatttttgcattaaatgcatgtcttgttccttaacttggaagccgcatacatgtcgcctcggtcgtggggcctaccacaccatgccgcctgacacggggggcgcctatgtcattcaccatttaatgggtgaagacttttgggctcctattacatcgggaaacgggagcctagctttgaacagagcaggaggaccgactccggctgggataagaggatgagaacctctcaccatcattatttgatgggacatgtcaggctgcacgccacctgacacacgagcagcgaacaggcgcactagctagttccatcggtcattcgaccggttgagtacactgcacgccgcattaaatggcgcgaccgctcgggtcgccataaatgcgggtaggtggacacctgtacgtggtgacctagagagggggtcgggggagccctacccctagtcacgggagggggccgccgacgcccgaccttgggcccgatcctttctcaggggagggccacgtggcgcctgtgtcagacttttacctctagtctcggcgagggagtggccgccaccctatctcgggcctgactccccttgggggagggccatgtggcattgggggggcggcctcctccgactagtctttgggaaggagtggccgccaccccacctcgggcctgactccccttgggggagggccacgtggcatttgggggcagcctcctctgactagtttttgggaaggagtggccgccaccccacctcgggcctgactccccttgggggagggccacgtggcattggggggcggcctcctccgactagtctttgggaaggagtggccgccaccccacctcgggcctgactccccttgggggagggccacgtggcattggggtgtagcctcctctctctaaacatgatacccccgggcccatatcaccgacagtagcccctggcgttagctctggccaaaacctttgacaggtggtcagggttgacgccaatctgctagtcagttgacatgcgggcccgatcttctgtcctatcattctgggagttgggcggtgggagtttagtcacgttcatacgtcgcctttacttcccactttcctcccggtctccgaggcgctgcaggctcgggagtttagcccgtaccttaggtcgtgaacttattttctgtatatactcagcaaatgttgttagactctctcgggcccgtgaccttacgccgcgtacctcgcttgcccctgcctcttgttaacctctgttcatgttctacttcatttattcaaacgattatttttgcgtgagcgtggggactgaactttccattgtcaacaatctttacccgctatcaagccaggctgggcgccgtacccagccggcggggccaaagctagctgctacggaagagccagcacagggggccccgggcgtcgacggcgaccagagctcgacgtagggctaggatagagctaggaatcatagcccccatacttctagcaaagaatcgtttgaatggatgaggtgaatacaaactttttgttaccaagggaggcaagccagcgcgcgacacgtgggtaccgcgggaccgcgaggaagagatgggcgagagataaacataagcaataataattctatgcaaacgatcatctttgcgcgagtgcgaggactaaattttccatagccaacaatcttcacccacgatcaagccaagctgcgcgctgtagccagccgacggggccaaagccagccgctacggaagagccagcacagggggtcccagacgtcgacggcgcccagagctcgacgcagggctaggatagagctaggaatcgtagcccccacacttttagcaaagaatcgtttgtatgaatgaagcaaacacaaaccttgcttgcatgtcgtgacctttcaaacctttagcttgaagagggcctccctccatgggtccctaaccactttgggaagcctgcgaccacttagcaaacgaggttaggttcccacaagcctgtgtccccacgctacacattctgtttgatctttcttttcggtggcctccttccaatatctctcccttctacacagacgactactttcgcccgagtgtgagagccgaaaaactctagagccagcgatccccgtccacagtcgagccaggccgggcaccatagccaaccggcgggaccaaagctagccgctacggaagagccagcacagggggtcccgggcttcgacggcacccggcgctcaacttaaggctagaatagggctagaaaacttagcccctacacctagcgaggaaacgttcatgtagatgggagaggaggttgggcttttaccactgagggagcaaacaaatgcgcaacacgcgagcgtcacagggccatgagaaaagaacgggggaaaaataaatataagactccaagctgtattaagctgatgaattgaaaaattgaaaatacttgaaacttgaaaggactattagttgagccgggccaggcaccgtagccagccgacgagaccaaagctagccactgcggaagagccagcacagggggtcccgggcttcgacggcacccagagatcaactataagagtcctcccaggagtagaccgaggtaggcagcaggttcatgagttaaccccgcgcttggcccctgagggccatggggaagaagctcgccatgacctgatcatcaccccccgccgcctctatgatcgtcgtgcggatctggagggactcggaggggttgacgccgtcgtcatacttctcagtgaggctgggccggaacttttgggggccatcggacattccgaagacttgcctcaaaggcctggtagccaagcttaactggtagggatgtgggggccttgccccctgcctgaggtggcgcgacactcctgaggatgctgcgccttcccccttagcggcggcgcgacactcaccacgccggcgctcgaaagaacctcaaaaatcacgaacgcgccccctacctggcgcgccagatgtcggagaatgaactcctccaccagggaaccgtgaggcccccctttgtgagttcggccgggggcagcgggtgagatttgaggatttggtgagcgaaactgtgtggtcttgagggggttagatcccccaaagatgatgagacaaaaggggtttatatagattcgggcagctgagatgcgtagtaccctactcctgtgtttgggattatggatgagtgttacaaagattccttccctccagagagctctttcgccctacttctcctagagttcaggttttcttagagtcgtccgtttttttctcggtgggcaaggttctccttttatagttcaaggggataccatataggcccaacaacctaacttcctcgggaagtattaccatttttgcattaaatgcatgtcttgttccttaacttggaagccgcatacatgtcgcctcggtcgtggggcctaccacaccatgccgcctgacacggggggcgcctatgtcattcaccatttaatnnnnnnnnnnnnnnnnnnnnnnnnnnnnnnnnnnnnnnnnnnnnnnnnnnnnnnnnnnnnnnnnnn

SEQ ID NO: 18969 - DNA, 5965 bp, Oryza sativa
  unsure (1)..(5965): unsure at all n locations
gtcagccttctccctctagtctcggctagggagtggccgccaccgtacctcgggcctgactctccttgggggagggccatgtggcattgggggggcggccttctccgactagtctttgggaaggagtggccgccaccccacctcgggcctgactccccttgggggagggccacgtggcattggggggcagcctcctctaactagtgtttaggaaggagtggccgccaccccacctcgggcctgactccccttgggggatggccacgtggcattggggggcggcctcctccgactagtctttgggaaggagtggccgccaccccacctcgggcctgactccccttgggggagggccacgtggcattggggggcggcctcctctgactagtttttgggaaggagtggccgccaccccacctcgggcctgactccccttggaggagggccatgtggcattggggggcagcctcctctctctaaacatgatacccccgggcccatatcaccgataaggatgaagttaatatctaggtttttatacttttgtacgaagttaatagtagtcactagtaacgacattaattgttataaagaagctgtcatatttagtcatgtcagtgagatatcagctaggagtaccaagattaatgtttcccaggaaagaactttaaaatcctgctgcaacgggtacgtaggacatccagtaccaatagtagtgaagcgattgtcaccttaatttagagtctatttgaggaatttaaaattttaaaaagcagctgattggtaaccattttctgagaatctgaagaagctggtatccaagtttctaacttctagtttattttttaatttttacaactataatttcgcagaatctgatcgaaatgttggactgtttagtggagcttttgattttaggagaagctatagcagccagaagcagctccacgaaacaagccgtacacacactcgacttcttaaagcgctttattaaaaatcactttatttaggaatgtaaatagttggaaactgtatctatcattactatttctttggaaaattctcgattagttgagaatttatatatttatcaatttacttatttagtggtgactgcaatccatggcagaaagaaactagaaaactcacactgaaaaaaactagaaaactcaaattttaattatatatacacttgtctaaaattagaaattgtagaaacggtaccacctctataaaaataatgttaggttcattgagaaattttcatcaacgatttcacccgtaactttattattactcccactagtatactccctcggtccctcgttactcctgggggcagtggaccaagtcccaagccatttgagccatagcgcggggtggaagtaaaaaaacccaccctgtagtaattttttagtggaccagattatcctgtagagtacaaaagctagccgagcttttatccccaaggtgtatggagaggcattttcatctctcagggacatccctatcacctaaatagtcactaaaaaaaatatttgataacatagatcaatatatcactcacaaacatttaagaccacattcgacttcttcaagttgaaaaaaaaaacaaagtaaactgaaaatagttaacttacattatggattaattgcaatttcagttcgaaatttcggacccttccagcaagtgattatctcagccaaaattttaagttttcctaaaaattttgcgaatttggtcaaaatttaatcaaattcagttaaattatgctaaaatttcaaaaaaaaaaaaatcggtccaacaagtgccgaaaatctaatgagcgaaattttggacaaaatcgaaattgaaaatcctgacatacattagcaattacttttttttatttttctacagaataaattacacccacggtacaataacttgacaggtggatatgatgtagtgcaagaatttgagaattgaatgtctgaatgcaacaacttggtaagtgggtgcgttctagctagtattagaacttgacaatttagtattttggtgcatcaaacttggctaagcatgtgctaggtaaggtttttttcatgatgtcaatatgccatcacatggcaattctatggatattaccttataatattgaatttattctttaagaattacattgcacatccaatttacatcaccggttcggattttcgtttgcttcaccttctcaaatctcaaccgaaatacaatattttctacattgtaaagtttaattggcttttagttattagttattagaatagaaaatttaatatgtttatacaaatccgcgctagtatattgtcaaaataagtacttaaaaatttaatgtgtataacaagaaatgctcgaaataattaagttgtcgcatcacttcttaacttattgtaccaaaatcgctcccttgtacccgtacactcacatggagttcttagactaaattgcacccacctgccaggttattgctagaatactcatttctcaagtttttacaccaaattacacccaccttaagttgatgcacaatgaatacaatttacgcttttgttagaacttgtaaaagttgaatttgagtttgctttctgtagtgatatactcctttcatccacaagagttatatatattacctttatcaccaagatcaggaaaactcatcttgtatgtaataaagtttaaggagtatatgcatgaatacaatcaatgtattaaaatggttcctcaggtttcaattaaacatttaattttttctctctatttaagtcttagatacatgaaaactacaaatatgactaacttatttgaaaaaaattatagaataaatctaacatttgtggaaggatggagtatttcatatcaatctactttttaaaaaaaattaatagctatttgtggaacaatggatatccacgggagaaataaaaacactttttgctagggtgcatcgatccatcccctactctatcggttcacacataaatgctagtagtaacaagtttaatttagaaagcatgcacacttaatgacgttagctgtctagctgatactacctccatcccaaaatatttgacgccggtgactttttttaaaatgtttgaccgttcgtcttatttaaaaaatttaagtaattgttaattctttttctatcatttgatttattgttaaatatatttttatgtatacatatagttttacacatatcacaaaagtttttgaataaaacgaacggtcaaacatatttaaaaaagtcaacggtgtcaaacatttagggaaggagggagtatatgtttatatttttgtcatctgaaacactgtaacctttatactccatccgtttcaaaatgtttgacaccgttgactttttaagtacgtgtttgaccattcgtcttattaaaaaaatttaagtaattatttattcttttcatatcatttgattcattgttaaatatactttaatgtacacatatagttttacatattttacaatttttttttaataagacgaacggtcaaacatgtgctaaaaagtcaacagtgtcaaacattttgaaacggagggaatatatattttttgaaatatcataagaaaacaattaagtatcattatagagactgttgatgctgtaaacaacgtacggaggagggagtacgtaccgcagatgaaggcaggcatgcatggctgcgcccctgaaccatacatgcagaaactgataaactggccaagcaatcaattatccccgcattatgtttgatatacgatcgaaagcccagcccaggcaccccctgacttatattaatcgatcgccgcatgcacccatgtcagcaagtttcacagtttgacactcctcatttcgtcgtcggtcgcagccatcggccggtcatggtcacacgaacagactgcctaacattatacagggaaattgatttcatccgataccctctcgtttcgtatatgccacctgaatattcactaaaagaatacaaaagaagttagcaacatatattaatatgaaatatatcactccacaaatatgcaggtttaaattcagcttctacaagttgtaacaaaaataacaaatatagttgtgaatgtgcaataattattttcactttaatttgttatttttgttgcaacttgtagaagttaaatttggtcttgcgtgtttgtataatgatatatttcttattaatctatattatcaatttttttaattttttataactatttagatgatatgcaaacaacgaggatgccctctcgagtgatgaaaatccacatcccattatacaagactgtggtatttcctctgagtgtatatatgatgctattagaaaaaagaatagaatactagtacactaagaatcttttgtttcagtttgaacgacgtagtacctctgtaactatataatttcgtgccagatcgaaactatgtgatattggaaacgttatttcagttgatccttttattagcgggagtcgttgaaaatctatcccatcactctttcatattttccccccttctttttaatttacttctaaaacctcatggttgcatgcccatgggtagagactctactagtgagataatccaattcaattacttagagaaaaaaacggggtcacacggtcacaggcagccaccccgcttgcatccttccctctacctacctacctcacctcaacaccttacctcgtcttcctcctccatcttctcccctcacgactcctccaacgccctcctccccacgccacttcaccccctccctatatatacccacatccatctcctccatctcaccaaaccaacacaccaacctagctaactcactcactcactccttcttcttgcgacctagctatcgagctagagcttccaaaaccctagctagctagctgagacagttagtttcatctcgaactagttgttgatatgggcagcttggacaccaaccccacggccttctccgccttccccgccggcgagggtgaaaccttccagccgctcaacgccgatgatgtccggtcctacctccacaaggcggtggacttcatctcggactactacaagtccgtggagtccatgccggtgctgcccaatgtcaagccggggtacctgcaggacgagctcagggcctcgccgccgacgtactcggcgccgttcgacgtcaccatgaaggagctccggagctccgtcgtccccgggatgacgcactgggcgagccccaacttcttcgcgtttttcccctccacgaatagtgcggccgccattgccggcgacctcatcgcgtcggcgatgaacacggtcgggttcacgtggcaggcgtcgccggcggccaccgagatggaggtgctcgcgctggactggctcgcgcagatgctcaacctgccgacgagcttcatgaaccgcaccggcgaggggcgtggcaccggcggtggggttattctggggacgaccagcgaggcgatgctcgtcacgctcgttgccgcgcgcgacgccgcgctgcggcggagcggcagcgacggcgtggcgggactccaccggctcgccgtgtacgccgccgaccagacgcactccacgttcttcaaggcgtgccgcctcgccgggtttgatccggcgaacatccggtcgatccccaccggggccgagaccgactacggcctcgacccggcgaggctgctggaggcgatgcaggccgacgccgacgccgggctggtgcccacctacgtgtgcgccacggtgggcaccacgtcgtccaacgccgtcgacccggtgggcgccgtggccgacgtcgcggcgaggttcgccgcgtgggtgcacgtcgacgcggcgtacgccggcagcgcgtgcatctgcccggagttcaggcaccacctcgacggcgtggagcgcgtggactccaagcannnnnnnnnnnnnnnnnnnnnnnnnnnnnnnnnnnnnn

SEQ ID NO: 18970 - DNA, 42553 bp, Oryza sativa
atcagcatgagccccacaaatggctgatgacctgcctcgactgcacctgcctctacgtgcgcgacacccacggcctcaccggctccctcgagaccaacccggagtacctcaagaacacgccagcgactccggcgaggtcaccgacctcaaggacatgcaggtcggcgtcggccgccgcttccgggggctcaagctctggatggtcatgcgcacctacggcgtcgccaagctgcaggagcacatccggagcgacgtcgccatggccaaggtgttcgaggacctcgtccgcggcgacgacaggttcgaggtcgtcgtgccgaggaacttcgctctcgtctgcttcaggatcagggccggcgccggcgccgccgccgcgacggaggaggacgccgacgaggcgaaccgcgagctgatggagcggctgaacaagaccggcaaggcgtacgtggcgcacacggtggtcggcggcaggttcgtgctgcgcttcgcggtgggctcgtcgctgcaggaagagcatcacgtgcggagcgcgtgggagctcatcaagaagacgaccaccgagatgatgaactaagtaaagagaagattacaaataaatacacatatttagaacacatatacgtttttgatttttttttttggggttttagatgcgaatctgttgattcattttgtgagctatttatacctatggatatatggatcaaaataaattattatttggttgtaatttttttaaaagatgaactgatactataccttacacaagaaatacaatatgataaaaatttatttattactttcccagaatattatttttttttgtgttcattaatgtgtatatatcggcattgtgctagctagctaggtaaacatccggtgactgattttttactgaactatataccgatcagtcacacaatttttagccgtcagatcgtgatcctaggtgtctcattgctccttacaactctaccttgtcagtaatcgctattaattaccccctctatatctcacttcaatggagcatgccggtgaatgagactctcgtctcttcgttttttccctagtagccgagggcgcacacgggaaaaggcaccggtgttggttattcttgccaccgaaagatgacgagagttgctagattcaatcgtattcttgctagcatgatcctcgatcttcacctgcttcatggtgtttgtagatttgtatccaaattaatcatctggctgatgctattcattttactaataggaacccacatatatatatatgtacggcggagatgcgtgtgtttttcaaacccgatgacttttctagtgccaatggttcaacatatactaataacgactaggttataccctgctctttgctacgaaattaattatggatgaatacacattaaatattatagaaatgatgaaaattgaaattaatccggtgagaactgggtgaaccggatgtcttttttcgctaaaaaccggtgaaccagactagtctgaaccagaccgtttttacatttctgccaacacgtgggctggcattgtaaggtccatcatgcacaaaaggcccatatatggtttgttcataatataaggatagttaaccatttgggaagggattcgaaactagcctggtgggtaccgtgaggtgtcccaacttgctatttactccctccgttttatattataagtcgctttcactttgattctactaaagtttatgttaagtttgatcaagtttgtaggaaaatatagcaacattttcaacacaaaacagacatattatcaaaatatattcaatactacatttattaaaactgatttgatgttgtagagatgttactatttttttttaacttagtctaacctaaaaaagtttgactaggataagagtcaaagtgacttatgatatgaaacagagtacttaactagctcaccatatcttagggaaaatgtatagggtaaatacatgctatgattagaagacgttttcacatctatagtccttacaagtcgaaagcatgtgaccaaagcaacaaaaaagaatatgttaagactagctatacacatcttcgatcttattggtaaaaaaaatgcaagattgagtgaaataattaattctaaaattaacttataaaattcaaacaagcacgccctttatagcttacaatacaattactttttacgtgactctcaaattgctgaataattaagacatgcatgtgcaacttattaattaattcagagctgcggttcttgccgggcatttccgaagatcaattcaaagattagtagtactacgtacgtgaactcatgcctactacgttcataagttggattatcacggcgtgtgtgtaaattcgttggatccagtagctattttccaatctcatgtgtactctttcctcgttaattaactgatatatacagatcacatatttaaaaacaagacgtacactggccacaaaatcccaaattaatcaaaggtggtgggggggtccattatatatattccttgtacatatatgcatataatcaatgagtgaatgaatgaattagctagccacaaagaaaacgacatatatatgattcgcatctaatcaataattgaaaacatgtagtattatttttaatcaattgtgacgccacggacaggttccgagatcgaccggtctagaataggacacggactaattgtgccatgtgcaattatctcgctaattagccagccccagcagctgacttgctgcgttcgtttggagttgttccaactcccccatctcgtttttcatgtgcatgtttttcaaactgctcaacgatgcgtttttttaaaagtttatatacgaaaatcgctaaaaaaatcatattaatatattttttaaaaaagctaaaacttaattaatcagtaaacgctgcttagttttacgtgccaggagctagcaactaattaagacgcaattaatattcttcgcagggtgtggtaggtagattagttgacaaacgtaatcgactacgtgatcaaaactaatttagtttgggatatgaattcgaccgatatcagctagctctcctagctagtgagagatcaaaagcaaaatgaattgcacttcctgcacgaaaccaaacacgaatatacgtacgtactttttgtgcgatgctttagtttgctcttcttggaccacacatcttctcccttctcagctttcatactacgtactgtgtcagtgtaaacgttttcagaatttatatgatttgctgttcacaagagaactcgatgatgcgatttggcatttacaagtgtgcgagttatataattaatttgccatcgaacaagcatttcttttcgtttttgccattgttgtttttttacattaattattctaattagtttaactttgttgattaacctgtatgggaagacccctactgtactccataaaaaataacatgcactaaaacaagccgagatcgatttagcttttttttttattttcactgacactgaaatagcagtagattgattaatgagccaatttcagtaaaccccatgatctatgaccgaagttgcgtaaaaccccaggtattatgaccagtgaaacataagagaatcttttgtggttcctaagtttaacaaattttaaagaaaaagtttaacaaatttaaaaccccatccctatacatacttggcaaatatttacttaatttttttaaaaaacatagaatgtacatgaaacttttagttgttgatttgttgattaaggttgtcagtttaacttttcactactttgaaaaatattatctcagatatactgaaatcaaataaaatttgaaccgggtgggattttttgaaacatttagaccataaaacatgtgcttatatgccacaaatcataatatatgtgattttttgaaattttgaccataaaacgacatagggatttataaaatttgctcttaattaattgaattatttgaaaatggcattgaaatagtagtagatattgcaaacctcccaaggcgtggtttttcggcatcgtaaaaaaaatgaaagattgataacggaggttaactatactaatggtaaaaatggtaaaataacacttgtatgatagtacatattattgtacctagaagttgtatatttttatcgatgacaaatcgtagaatctagcgcttgtcagtggcaaattattgtgcatgcatatatagttcttgcataaataggtcgtatataagcttctatttgcaatatatatacatatgagaaaattcagagagttcctttttaaagtacttgtagcaccaaaaataactcggtacctcgagatacttattattacatggagataccaagtttaacattagaaaatatggaatctcatggtatacctttttcttaaagatgataaaattattgtatacataaatcgtcattctcaatctttttcgctattgtaaagatgatgaatatataatgaatgtgtttatggatagacaatggattcacctgcggataatactagatccacctttattatctagtgttatattctctccgtcctaaaatataacaacttttagccattaggatttatcttaaaatataacaacttctccatcaacattttctttccaaccaatcacaaccctctatcattcatttttaccacctacctccactactcatccaatcgtaaccctcgaacactcatttctacctactttcttaataaccgtgtccaactctaaaacttcttactccctccgtcctattttaagtgcagccatggttttccgcgcccaactttgatcgtccatcttatttgaaaaaagttaaaaaaaatttaaaaacataagtcacgagtaaagtactattcatgttttatcatctcataacaaaaaaaatactaattataaaaaaaattcaaataagacggacgatcaaagttggacgcggaaactcgtggttacacttaaaatgggacggaggaagtatattctgggacggaaggagtagattgtatggtcagtcaactagtcttctatgctcaactataatttgtgtacttttactatacaaagtcaactctagcataattaatactcctgcaagctagcacaattatatatgcagcattcatctgtgttaattgtactacatgaattgatgctatagctagctaccaactaacttttgcaaggagtacagtggttctgctagctaggagagtatacgtgtatggatcatggacagttatcagttccatcaggatggagaagtaaattactaattgaaatgtgctttgactttcgatccaccgcatgcccatctgttactttcttgtttcagtattaacacgttatatctaaagccacacaagtcattgacgatatgatcgatcgatctacatgaaccttaatttgttgaagtttatatgtatggtgcctggtttggaggttaacgtaattgtcatgcttgcaaaggcatgaagttgatttatcaagaaggatcgtatgtgatgggtgtaaatataatggtctttaatttatagggagcgaaattaaaacatatatatacacctagttatatagacgcagagatcctctatagtactgctaatgcagtagtagaggctgacctgtgggtcaggcaatccccataagtcctatataggagtatatcctttctttttaaacttgagttaatttatttaatttgtggatatatgaaaccaatagccaaaggccttgcatgcattctctaggaaaacaatattccagacctgactatgtacggagactcaaccgtggtaggagtaccatgtataaccacatttaattaaataaataaataaatttgttggaatgatattgatcgctgcaataaatgcagaaggtagattgtctatgagttcgtttcatgctgggcatatttacaataaacaatgtagcaacgccatattgcaacaagtttaaagagtggttatataattaattaatatgacatctatacctttaaaagaaatttaagtatttcggtatctgtaagacgtctcaatgtcatggtcggtgaatctgacaatggagtattcccttcattttttttaaaaaaagctaattaacctaactagggatgagatattaatttcccattctttaagttttttttaatggatgaagaattagtatggaggagctagcgatcaaaattaaagcgacgatgggacaatgcaatgagaagcggtgtgttgtatgagtgggatgacaagaagcagtgattgttgtgatggcgcatcttatagtggggcatacaatagctaacaataatgggtgtggattttcgtccctcgagagaacatccttgttgtttgcatgtcatctaaataattattaaaaaattttaaaaaaattaacaacatagattaatataaaatatatcactttacaaacatgcaagaccaaatttaacttttacaagttgcaacaaaaagaacaaattaaactgaaaatagttatcatatgttcgcagctatatttgttatttttgttacaacttgtagaagttgaatttaaacttgcatgtttttggattgatatatttcatattaatatatgttaccaatttttttaaaaaaaatttatgactatttagttgttatgcacgaaacgaggggatatctcctcaaagtatgatctatcactttcccaacaataattagctaggctctgttcgctgctggaggttcccaaccaggaagagtgcgtacggaaaatggagcggtccattagcgtgtgattaattaagtattagttattttttaaaaaaataaatcaatatgattttttaagcaacttttatagagaaacagtttttaaaaaatgaaccgtttaacagtttgggaaacgtacgtataaaaaacgaggcgaggggggttgggaaggagctcttacgaacgagctggacatgacatggtgcagcttgcacaacatggcacttcaaggatcgatactgtgagaggcagagacagaagtactagcgcagcagtactacgtgaggcatctctcggatttttaatttatggccgagtttatttccgaactttttctttaaatttttaactttttcatcacatcaaaacttttctacacataaacttctaacttttccatcacatcattttaatttcaaccaaacttttaattttgacgggaactaaacacaccctataaagttattgaatttttaagatatgtttagcctttcggcttattaaaaaaattattttaattaatttgattcatcgtcaaatattcttataactatgatttaaacttttatattcgcacaaaagttttaaataagatgaaaggatccaacgtttgtaaataaaccaaatacgtcgtatattaaaaataggttgtaattggtatggcaggaggactgcaccttacgttaaggcccatcgatctaccatttgcggcggacatacggtttagaaaacatgaattctcagaagactctgaagttttttatataacagaaaatttattgaatcctcggactctatcacatgacacacgaactgtattgcaaagatacagtatatatatatatctccgtcttaaaataaataagtgtaattctgtatacaaattttgttctaaaataagtatattcctgtcatactagtacttgttacactaaccatatccaattcaaatttctctctatcttaccctcaactatcctcctacttaatctctacacctctcgtttaataattaatatgggtcacttaggtgatcttttcttccttttatttttctctttcacttttaaaagtacacttatatatgttgaaacaaagaaagtgtacttcctctgtctcacaaagactttatttttcagcttttggatataacatttaactcctcttatttaaaacttttctgtgattcaatatttttattgttattagatgataaaacataaataatactttatgcatgactaatttttttaaaaagattcagataagacaaatggttaaacgttgaatacagaaatccaaaaacagagtcttcatgaacggagaggagcctagtcatatagtactccataaaacttgagataagtagtgacatatactgtttagcagcttagtcctattccctccgtcctataaaaaaataggactaaatgtgacacattctaatatacgacgaatctaaaaaaaatatatttttaaatttatattagaatgattttttatgtgaccgatgaagtaatgcgtagggccacgagatcacgacatacatgccggtatcagggaatctaattactacaacgaactatagtagtattacgtagtacgtccgtgctgtttcgaggacctacaatttataatgggctgtcggccgttacagctgagctacctacctatagctagctgagctcgattcatccatccatcctctctccacaatactactgctacgtacgagttcgttttaaaatacatcaactagatgcttggacggagattttattaatgcatgattaattaagttttaattattataaatttattttatttttaaaactaacttctttatataaagttttcacataaaactcaccgtttagtggtatagacaaatttactacaggacattataactttgtggttttagctgtaggataccgcgaagtgacttttgggggaagacactctcaaatgttgatatttgctagtggacaccgctcattaaaataataattttcggttgaatagaagagataaatcgcgtgaaatataaaaatacccttgggcccacatgttagcactcctatctttcttcttttctctctcttcaaacatgcagggcgaggcagcgtgtggaggcccgttgctggcgcgacggccgtgcaggtggcactacgaggtgtgttggcgaacgaaggcccagcgcagggtaaccgcgaagcggacggcgtcgcgcctagcgacctcggtggtggcggggacatcgaacacgatgaggaacgccatctccggcgtccgctccaccgcgtccatgaaagttggtgtactagttcaccctcgagaacgccatcgccgtgtagccgccgttcgtgaggcaccaccacagcgacgtggcggcagagacgttcgcggtccaggcgagcaccgctgcgagcacaacatcgtcagcggcggcgaggagcgcggtgggggtgatgaaagcgcacacgagaatcgggtagggcgtctgatggaggccacggggcggacggaggaagacgagcgcgtagacggagaaggggagcatgaagaggagcgcatcgtggccgagcgagaaggccatgccgccggtgacccgtcactctggcgggcactcaacctgctccacaaccaccttgcgcacttaatgtcgtgggacgcgctgacggaggcactcgcgcgtctccacgacgacgtccgccgccgcacctgcacgacatttgtgccatctgcacgtccgccgtgccactgcacctcgccgtgccacccgcacggccgccgtgagccccagccagacgcaccccgcacggcgtcaccgcgagccaccgtcgccgccactacgcctcgccatgccgcccgcacagccttcacgcccgtgccggtcgtccgcacgctgcctctcctctcagagtgacgctggaaggaggaagatagagagagaaaagaagagagataggagagctgacatgtgagcccaagagtatttttgacattaatttcacgcgatttctctttcttcaaccggaaattgtccaccagtaaataggcaacatttgagagcgtcttcctccaaaaattacttcgtgcggtgtcctagaactaaaccatgaagtcgcgatgtcctgtagcaaaatttggcttgaaaatatgtgctaacaaaaatcgaggaagaacctaccccttcatcacaaacgaaatggagcctgaggactgaataacacgtcgtagtaatacaaatctatccctttaattagttgtaagttgctagtatatttcaagatggagttaatagtatattgcatcgatatattataataagcttaattagtagtggcatgcatgtaagctatggctcgataaacttgcagacgttcctcgacgtcctcgtgatgcaattaataattgttttgtctgcttctcgatcgatcaatttaaatatttggtagccatgcatgcgttgcaaaaaattggatcaacttgcatttggatcatcatacatttatatgctgttctagtcacagctagccctaccaagatatatatagtcagaatgaatacactgatggtaccaagctagcaagcaaagcgcgcagctctctgtatcgtaccttagctgagccatcaatttatcaaactcattcgtacatgttaatacaggcaagtagcacctagatatactccctccgtcccataaaaaagaatctaggatcggatgtgatatattctagaacgatgaatcatggcatgtgtatgtccagattcgtaatactataatgtttcacatctgatactatattgatttttgtgggacggagggagtgcgtattatctagcacaaataatgcatgattgtgacgccatatatattaattatctagatgattaccttatacttgaacaatgaatgtgggaaatgctagaatgacttatattgtgaaacggaggacgtactgggttttgatatctgtcggttcgctgattttttttactagctaaaaaacttttgacaggattttttttaaaagaacttttcaactttgaaatataactataagataattgtagtaaaattaacgccgttgtgtcgcgtcgtaagtttaactccctcacgtacgccacacgtgtgctcgattttttttttaattctcctcacgtacacgaatctcaacacatctcaatatggatcggacgatcaaaaattcaaaagtttctaactcatgttctccattgatggtagaatagtgttatgtctttttccttatttgctagtcaattaaacttgctaaatgaacaacattattagactaaacttgcagaaattgaatttagattacataatatattttcccatattaattagtaaaatctatactaaattatttttaataaatttaagtaagttactagaatatttgtcttatctgaacagcatgattgacatgcaagttgtcgaacattgattggcaagtgaaactaaatatatggccctatatcatcgacaatttaaaattttccgcttctcaaccataagtccataacttaaattcacacttgtacaactgtaaatgtatagtgttttttttttcagggaacagtacatatatagctcaacacaccaacaaccagcttactcaaaagtttgatatacaattaaggccaaacaaatcacctgttcctttttacccgtactacacatgacttatgacatgtttcttgctggtatacaagtaacaaaaaagaaaaagaaccttacccaaaaaaaagaagaagatgaaagcccaacatttatatgatggaccatagtaattttgaatgcacagtatgaatataatcacacacacacactgcctacgtggagagagtatttattattccacgcacctctcgttgtcgccattaattacttctaccaactgcgaccagtaaacaattaatcaatccatgtatcgaacggacacgacacagcaaataacagtggctttacactgtcgccgtcgagctcgatctacttgtcttctccggcgtcggcgacgatctcggtggtcgtcttcttgatgagctcccacgcgcttcgcacgtgccgctcctcctgcagcgacgaccccaccgcgaagcgcagcacgaacctgccgccgaccaccgtgtgcgccacgtaagcctttccggtcttgttcagccgctccatcagctcgcggttcgccttctcggcctccgcctcgccggcggcgatggcggcgccggatttcctcggcctgatcctgaagcagacgagcgcgaagttcctcggcaccacgacctcgaaccggtcgtcgccgcggacgaggtcctcgaacgtcttggccatggcgacgtcgctccggatgtgctcctgcagcttgccggcgccgtaggtgcgcatgaccatccagagcttgagcccccggaagcggcggccgacgccgacctgcatgtccttgaggtcggtgacctcgccggagtcgctggcgtggttcttgaggtactccgggttggtctcgagggagccggtgaggcggtgggtgtcgcggacgtagaggcaggtgcagtcgaggcaggtcatcagccacttgtgggggctcatgctgatggagtcgacacgctccacgccgtcgaggtggtgccggaactccgggcagatgcacgcgctgccggcgtacgccgcgtcgacgtgcacccacgccgcgaacctcgccgcgacgtcggccacggcgcccaccgggtcgacggcgttggacgacgtggttcccaccgtggcgcacacgtaggtgggcaccagcccggcgtcggcgtcggcctgcatcgcctccagcagcctcgccgggtcgaggccgtagtcggtctcggccccggtggggatcgaccggatgttcgccggatcgaacccggcgaggcggcacgccttgaagaacgtggagtgcgtctggtcggcggcgtacaccgtcagccgcgtgatgcccgccacgccattggacccgctccgccgcagcgcggcgtcgcgcgcggcgacgagcgtgacgagcatcgcctcgctggtggtccccagaatgacgcccccgccggtgccgcgcccaccggcgacggtgcggttcatgaaactcgccggcaacccgagcagctgcgcgagccaatccagcgcgagcacctccagctcggtcgccgccggcgccgcctgccacgtgaatccgacggtgttcatcgccgacgcgatgagctcaccggcgatcgcggcggcgctattcgtcgccggaaagaacgcgaagaaattcgggctcgcccagtgggtcatcccggggacaaccgcctccctgagctccttcatagcaatatcgaacggcgccgacgacgacggcggcgccgactgcagcagccgcaggaggtagcccggctcgacgccagggagcaccgggagcgactccaccgacttgtagtagtcgtagacgaagtcgacggccttgtggaggtaggagcggacgtcgtcggcgtcgagcgggcggaagggctcgacgtcggcggcgaacgcggcgtaggcggcggccgggttggcgtccaagctccccatgtgtcagtggaggatgacggtgaagctagcttagctttagcttagttggttagttcgagatgtggttgagctgagctaagctagctgatggagtggagatggtggtgggaggtgggaggggatagatggggtttatatagctgtgaaggaggaagaggaagggcgagaagcggcgtggcgaggcgggcgtttaagcggtgagagctgtggttggtaagtgagagggagagggagagaggggaggatgtcatggcgtggggcatgcatgtgtgcagcactgacgcgacagatgtaacgtacaacaaccggtgtgtttggttcacggtaaaattggaagtttaggtgaaattagaaccatgtgatggaaaagttggaagtttatgtgtgcagaaaagtttcgatgtaatggaaaagttgaaaatttgaagaaaaattttggaactaaactcggccgaaccacagcggctcgtggagctagaaaatttttcgaatacgaatctaaaatcgaatgtgacatattccagtattatgaataagtacgaatgcatgcttagattcgtagtactaactagaattaactagaatgtacttgtttgatttttttatgggatggagcgagtacgacgtcgtgcgattggtgggctaatatatattttgagtgagtttgttttgtacgctcttttttttacgtttttcgcacgcacatttttaaactatattgaacagtttgattttttttagcaagttctatatgaaaaatgcttgaaataatcatactaattcgatagcttagcacgtggtaactctacatcagcaataatatgctgattctattaataagcatgtgcgactagagatggtttttggagtgaaattaagtaggggtgggttttgtaacaaaataacttatagatattggaatgccaacctccaagtgacttatgtggtggtttttatagttttctatatatattactattgtcctaaatagcttctattaagcaaaatctattccctgtgtatgtgtaatgtacgaacaatgtgtactacaattactcctcgcatcgcatggatgcatcccttgatcaaggtagcgtgcattgtgaaaaaaaaaacttatctaattacaacacaagtgcatgcatgtgcaccctacatctactgccattagattagtttttaagacatccggccagtaggctaaattaaggtgcacaactgcacatgcatatatggcaagtcaacatatgcatgttcatatacgtacgtgttctagacgtgttgtacttaacatatgcatgtgctattgtgtccgtttgatgaatggtatagtctttttttttttttggttttgagaaaggaatatattgaagttgttcatggattggggagcatgcataagcatgtgtgagattaattgcatggattcatgagtgaatgactgatctgtctgcctttgcaatgaaatcaatagataatctgtctaccttttttttagtttttttaatatgtttcagttaccatgttcaggaaacgaggcaatggaccctcaggatattaaaacgcctgtatttaggggacatcaattctccatcatggtcaacggcgaagattcgatcaaccgctacggtaaagcatttctcactgcataggaaacaagtggcatatgtacatatgtactgtgtactgcttggttggtgaatgaagttaatttagatatatggtcccttcgatcccaaacatatgttgctctataggagtagtagtaactcctaaatatcatgtaaattgtttttactgtgtatgcattttttgaactatacactccctcggtttcaggttataatactaaattagtttcaccaaatcaataattgaatatattttcataataaatttgtcataggttgaaaatgttactacttttttccacaaactttatcaaacttaaagtagtttgactttgaccaaagtcaaaatatcttataatctgaaacagagagagtattacttttctattttccctaaataaatggttcacattaatgtatcagattgtaataaggttatgtttggatagagggaaaacaaagcatgtgaataaaaaatgtaggaaaagaaaacagaatgtaccctatattaaaattacaatattacatgtctaaaatggattaactggaaatcaaaagaaagtacatatatatattgattgcagtggtgaaaaatatggatggagggaaacatatcctatatatgcacacatgtggacacttcgtgcgccaactaattacaaattaatgtcaccggaaattatagaagaaaatatatataccttcattactattacatattacactttatgatagcttaaaactatcataatttttttatggaagttcttccttggttgcagcatgtgaaacgtgtgctttatatataattaattgattttcattaaatttccattttgatcaatctatatacttgatctcggattagaaaaaacaactagtaggactgtaaacaactggctcgttggtcgatcgctactcaagcacagccactagaataagcaaagcatcttggatcaaatataatttttcccttgtgtttaatttgctcaaggaaaatgaactggtcacatcaaagtataagtggcactctacagataaattcatggattaatttcttcttccagaataggaggacttttcccacacttttgttattatgaaatcagcatgagaagaggccaggaaacggtcaggaattgtttttcctttgggttaatcactagggagttattgtatgaaaattgagaggcaaaaattcattcacgtgcgatcgttaactgtcaggaaatagtttatgacaataatgtcctatttaatttcattgtaatatatggtttactcctaagttaattaatatgttaatttgtattctatccgaagagctgaactttttgtgaaacttaaattaccagcgtttatgtatattagctagttcatgcatataggattcgtataaacagtataaacatataatgcacagtttctatgtcttgccctactatacgagaatgcgcgtgtagatgactatacgtacaccaacctttcaattgtcagtactacaaaaaacattttagcatgcatgtaaacaaaatagatttttgcaggtggccaatcagaccgcctacgacttaaaagtcttaaaaaataatacattgtcatgagccgatagccagccacctgcaaaaattaattttgtgatgttcgtgggcgggtaagtcctgccatccgcctgtgtaaatattttcagtgctataaaaatccatagttgatgtcactccttggccagcaatggctttccgctaccaatcacagcctaatcgatccccatccagtccatagaaattcagaaacatcaattcccatcacagcctcaatcaatccccatccaacacatagaaattcctatatcaatagagcatcacaatttagcccattcacaaatctccaattgaatccattcacaaaatttccaaatgaatcaatccacggaacgcatagtcagcaccagaacaactaggggcagagaatggaggcaataacaatactgaacggtgctcactgccacccttaatttgctacctccagccggccggcctcctcccatctagcccccaccaaagctgtagtcaccgtcgacacaccgtccctttgcccctcggtggagagtgagggagggagagagggggaggtagctaagagagagtgattgagacataggctgtgtgccgctgtagctctcctcagctgtactgacattaacactgctcccacgttaattttgcaagcgaacctctttatatttacaagccacaacctataaaaatgagggtttttttttgtgggcggtcatatttttccaggagagattgtctagatcgcttggaaaaacgaaatataggtgttgggaaaaaaatgttctctagtagtgtgtgcttgtttttgaggaggctctcacatacttttatatatactcctccatcttaaaatgtatgacatcatttatttttcgtataacgttgataattatcatcttattcaagaattacataaaaattacttacttgttgtgacctttttattatctttcttatcttaacttatgcttttactgctaaacttttaaataagatgaatggttaaacattatataaaaagttaagagtgtcatatattttaagacgaaggaagtatatactccggatatactagagagagctaccgatcgagagatcgatgagaagatcagatataggaggactaacgaaaccggaggcatcagaagttcaaaacatggcgcgttcccatgggtcgtccgtcctacgtatatatatttcagtcagttaatttttttacatgtttgatttgcagcggccagcagcagcagaagatgcacgaaacctggtgagaaatctctctgaaagtccaaagtcttcacctaccaacaacactgattcagctgcatgactcgacttgcagtgcaacgtaagatatcgagcgaatcaacagatcgacaggttgactgcctgactgactcagagaaaggagaagatcagttttaccatggttataatctataattaaccaattaatccactagttaattaacctagtcattatcgatcatatcacgcgtggtgcacacgtacacatacctcaatagcaagaaaaccaagctaaagctacccctccatttgaaaaatatttttcaagcaatttatgctagcttgatcttaaccaaattaagaagcacttccaaatgtaattagttataatacaattagaaatgaaacttatgcacatttatatatatagacacatgacaacaaatatttgaatggtatatatgtaaacgtaattcaacttaattaattatcgaatttctgcctgggtttgagtcccaaactcgatcgatacggtgtctgctcgtgctagatgatcgagtctacgccttcaatcttatttagacgtgtgttaggtgtgtgtgaaatgttaaaatataattcaacttaattaattcatgtacatacaactaaattgatggcatactagacggcttacaagttattaactaatttacagtttttaccattgaattgatcaagcaacgatcggttctacgtactgtactacatatatttacagatgaatgcatataaaggaaaccactgtaactttaggtgaatgtgaactatctagtccaatattgacctagttaatctcatttatttatttgctgatcccaagctagggcatatacttgtcacacaagaatataacccttattgaggtatcacacacacaagttcatgcatactactctgttaaaaagaaaaaaaagagacaaatcctagctacgaatctggacacacatatgtccaagttcataggtaggattacgttttttttttggatgaaaggggtatgcatctgggacaacgttgcccttttttttaaaaaaaaaagagaggaagttttcaaaaaaataggacaacgttggcacagttgcggcgtttgactcttttgacatgggacataagtatatagatgcataaggccaaatcgttctcatattatttatctcttggtgtactgttaccacaattcctaataagaatctgatcttgcgtgagtagctggtcaaaggcttagatttgatggagaagtgtacaattagtactaccacatcttagaggaatgaactgtactttctgtcatttttttcttgctatgaaaagtgaaatggtctacggtaataacttatgttcaattccattgaaaaattttttagcacgcatgcatgccggctagagctagagatttcctggtagttgcaacttgaaagcatatgccccgaattgcaggacactcgtgctcttggaaaccgtctgctagctagtgtatgcggcgtgtcaacaaatgcatatactcttgatcaaagagtgtattgactaattgacttatgcacatgtcccgatgtgttttgaagaccatgtcgatattctctagacattgttttttttatttaaaactgttgctactagctagagggggtatatatgtgtgtgagtttctccaagaaaacatgtttgatttttcttttctttgttcagaaaaaaaatcttgtatatatatggccattatcgattattagcagctagtgcagttatttgctgatatatagaaagatagtgacagatgaatgactaaaagctagtatgtctagtatatagcagcttgtttgtgttctagttggctaggtagtgataggatatgttccaaacatatggatgcgactacatacatcttttgacaagtaactgctatttagtccacattttacatgaccagaagtatgtcatttagtaatattaggttgagtttggcatgcagctaagtgcttagatactacttctcacagaactatattgtctgctcttgtatattgttccaccacgagtattgcatgcttcaattcagtgttcaatagcctgttcatttgtctgctatatatcacgtgcattgtcatattagcactaatatatttctttcccatggatcgaacttaatgtttacaaaagcaattttacttccttttctcttctaaaaatgattaacattaactcatgattctattttaaaatagtcaatttaccggcagactttatggtaacaatattttgttgattttttttttcagatagactactgccttctatttgatgttgtgatgtaatgtttccttaactaaactcatcaacaatatgatttcgctgaagatatatatggtcatgactatagtaaatcgatcacttaaataatcaacgttgatctctggacctgtttggtttagtatggtagtcaaaagtgatttacagagaaccagttcaaagaaaccgtgatcgagaccagcgtgtggacagaacgtattattagatcgatcttagatttgcaagagttattattaactaataacaagatggtgaaagtagtttacattaaggactgaataaatttagaccttataaaatgcatgtgtagaaacatcatcagccagctaacctaataaatactcgcctctctaaaatatagatacttcttgaacttaaaaatttgtttcaaaatatttcgaaactgttacatgcctgactaaccacacccctcatttaatattcgccaaatttaaacaataaaaatattttcaatgtttgaactcttgaaaagcaaaaaaaaatattgatacttgagaaattgtcattaattaattatatactccctagaaacggttggcttagttaattaattaattcgtgtcacgtcacggacagcgacaaaccgatcaaaatcaccacaatttcgagtcgagacagctttcaaaatatattatataactccacgtgaaccaattaataattgacagcgtcgaattttgtcttgcagtcgcaatcaaattagaaattgttttttttgttgactcatctctatggccttgttcaacagataagttaaccaaatatacgtgtttaattagctttcaggggttaatgaccgatttgactggctgcatctgtacgaccttacaaaactagaaaacgtccagatgcatccgtctactagtatttatacaagcccttggactcagttagctaattcaatgttaattaatactagatgtttgtatttctgctaaattatgccatcaccaaaattgactactccatctcattggcgacagagtagaacttaaatttcctgacggttggaatgcatgctgtcatgaattgtttaatcagttatgtaaatttagatatcgtcattttatacacagtagatgaattaaacattaaaaaattaagctgaacaaaagcgttgacatatggagtgcgtagttgttgattcaagcttgtcacggattatatattcctgactaatcgaagcgtgaatataatactgttgctaattgaagtttcaacggcgagagtatatggtaagattaatttttttatgcatgcctcctcttcgaccagggagaggggaggtgctcgtcgatcgatgagaccaaggtgtcgaggaagcagcagccactactacaaaaacacacatacaaattggcacaatagatgctggaagagctaaaaccgatacctatagtgttttccccacctccacaggctggaaatacaaacaatcgacacctttaagtaattataagtgaaccggcacctatccagcaagccgagccgatcgagaaagaaaagccgggggcgcgaccgatcaaggggataaacacgtccttatatctttttcatctgctcttcttggcgacttagcatcgaagacgctgttgacgagccatgctgcatcactgtcgtcacgcgcactcctcaacctcgcttgtcgctattgctctgctggccgctgccctgcttctccaaggttgtttcaaaaagaaggcggagaagagagaatgagttaggatagagggaagaagagaaagaagatgacatgtgggcctcattttatttttttatttttttaataagagggctgccacgtggatggtagccaaatcagtcgaggaagggagccaggatgagtaaaataacttctcgaacaggctggtgaagggatcgaaaggagaaattgtgagtaaaaggctcccaaatcgattgagatttccattaccaaatcgaagcttctattgctacttaagacagacacttaattaggtgtgattttttcttcttgtgttgcaacagattttcttatagatcataaaaaagccactttatattgtagtaagtcaataggctcataacaaataaatatcactgtttaaatattgtccactatttggatccactctggatggctaaggttataaataccaattaatcgagagatcaataaactggtaaacagtaggtacgtaaagttgattactacttactctcgaactaatatatggattcaagattttgattgaaaaaacaattacatgaaactgacttgataccattgccaactgattttaatataattaaaatgtttttttattatactacttcttttaacatacccagattcaacaaccgaatctaccttccttctcccgtcctctgatcaaaccctagccaaattcactatcgtgcagcgattggggaacccagcaaagctaatgaccgagatcttcgaccttaattaagttcacctccaagttgctcaatgtgcgaggagatcgaagagcactcaaggtgaagaaggcgatcgagaagggaaacgagttaaataatttctttggatttaaagaatataattcgtttgaattaaatattttaaaaaagttttcaggtggggtcgacagataaaaactcatatccttaattctctcaacacattcattcttttaagttttaacctcatatatcttcggtcctatatagatctctactcactgagctgcacggcgagcggcggcgtgaatgcccacttgtatctctactctagcaacgaattaagcagcaaaatataaaccttgcgatgaagacgacctctcacgcagatggcattctatttccttgacttctctgctctggcaatggattgatgtgatttttgttattccttttctgggattattggtcagtgtacttctgatacttgtataaggcagtgatgattacctgattggttttttaattgatattttatctttttatttgtcagttgtgcgcgattaggattttggatcgatctccgatctctgagggcgctgctcggtcagacttatggacaaaaaaaaatgaaaagttactaaattttaaatagtcattaagataagataagataacatgcggacttgtataaggcaggcaacattaaggcagagaattaccaatctgacttgtataatatcagccacaatcttacaaaagctgcatcaaccatactaacaatatatatatagaaccagttcatgtgtttcacaacgtttgttatgaccatccgatgcctgacatgcaaactttctgctacattaccgaatcagcataaacaggcttccttgaaatgagcgaccaagctacactaactccaagcttacagaagcccatgtctagctcaccattgcttaaaccggctttcaatgctgtgaaaaccatctctgcttccacaacactgtcatcaactttccatgccctgacatgaactttcagctcgcccttatcttcaacagaaacaacacaccgtgaaagcacaatcttgccatcatcaccagtaacaactactttctgatcacctctagaatcaagcaggagaattctctcatcatcaacactggcaatgttcttttcacgggccaaatccttccaacgaacaccagtggtaaaggcagcaaattgaccatgaaaaccatcaggccatgacccacaaatgactcgcacgaatattgtggcctccacagatgacacgatgtagccaagtctgaactccagtgtgcttagcttgcttgtgtaagaaccagaattaagcagcatacgtgaataacgcttaccatgacataagagtggcacagctaggtagctcaagtgtttgtcctcagattcagttgtacccttcactttcagttcaacatcgatgatcacaggttccggcattgacaacacaatagcacgggtaaaagaagtagtaaatttcgttcctacaaatcatgaaactggagtaaaagaaggcataaacatgagcagcataatccgtactacagaaatcacatgagcataaaggccatggtaattttcaggaagcaattaattatatcagatcaccatgcatataacatcttcatgatatatagctgtgttaagcagcacagaaggaggcaattaaacagatcaatggaatgttaagtaaaaaagaggccagaaattaacctgttcagtgagggtttggcagttgtcccttgtgcggtggaagagaacattgcgattacgatcaacactatcgcgcatggtaactataccaaacacatcaagcggccactgtaagcccccacttgtcgctgcaaccttgacagagaagatctgtagagcatccaaggcataggcagtgaaattatctagcgcaggcttatgagtaaaacgcattgggggggatccttgctgcatgttcgaagttgtataagaatatattgaagtgagttaaagatcaaatccaattgcagcagcagcagcagcagcagcagtaacaacactagtgaatataactaactagcaagtccatgcactactagaaaacaaacaattaatagtattctggacagacacttgaaattttatagtttgattttgatgttgatttttgtggtttttcatcatggtttattttttagagccaaaatttgaattttgtgggttttctttcgtggtttattctatagtactccatctgtttctaaatatttgataccgttgactttttagcacatgtttgaccgttcgtcttattaaaaacttttatgaaatatgtgaaactatatatatacatataagtatatataacaataaatcaaataataggaaaagaatcaataattacttaaaattttttaataagacgaacggtcaaacatatttaaaaaaagttaatggcgtcaaatatttagaagcagaggaagtatttgctagataagcgtatgcataagagaatcaacagacatggagagaacacaattcatggtctggatatatcttgtagcaccaagccaccaattgtatggtgacacaaaatattacttaatttgaatgagactagctagtttacttaggaaggagggaggagatgaatatgattaatggaatggaaaacaaatgaactcactcactggcgtcttggaatgaaccatgatgagcggaatgcacatcgttccagaatttgcgatactggatagcctcccagttggattcatcctcgtcctgcgaccgcatcgtctctaggtatgccttgtcctgctcctcgatgctcttcctcaccctcgcctcccactcctccgcggtttccatcctcttcctgggtctcgacgccttcgatgcggcgtactcctccgcggtcttgccgatggattcgggaatccctcgctcttctcgatgtcggccatggtccaaaccctctccaccaccggcggcggcttgggctcttgcttctcctcctcctctaggtcggcttcttcttcctcgtcgggttggggcttgctcgtcgtcgtaggcgattccgcctccgtgtccatctccatctcgtgagggcgaagcttcggaaaccctagctctgttccgccgcccgccgctgctctttttttttttgttttttttttttttgagaataaaagtcggtaattttcattcaggagtaggtcagatttacatgcacatggagggttagcagcccacacatgaggcccaaaccgactgggtcgtgtatgatgcgagtcggcccaaactgattaagcctagcccacgctgcgcagcccaaaggagaaaaattggcccaccgttggtaacgcaaccggctgtagaataagtttatctgaggtctctttaacttgtcaacgaatccggttttcatcattcaaccagaaaaatacatcaggtcccttcactctcaaaaccgatacaaaataagtcctagttctcacgatggccacagtggtcgcggcggcggaggaggatcgccgcgacgccggagctccggggtcagctcaacagaggggagtctaaaatgggggagctgtatactagcgaggggctaatgcaaaatggtggtttggaactcaggtgatacatacattatatccaaaactataggtaacactaccctggtcaagtttaaaacaccggcaacttccattaacaaacgagcgtccactactaattcatccacagcggcaggcataagatgttctgttgctagtaacagagttcaatcatcggtgacaatccacacacaacaatctcaatattccaagttgaacacaggctttaggcctaccgatggggctttttagtaacacaacatcaataattagaataatggtatggtctgatattaaaagttttaacaattaagctaaagctaagacactaattccgtgactttaaataacacatccatatatatgcagtataattgtaatatcggccacaaatcttacaaaagctgcatcaaccatgctaacaattaatcaccagttcacgtttcacaaccattccgatgcctgaccatgcatattttccagtactacagaaccgatttagcaagaactggattctccgaaatgagcgaccaagctacactaacttcaagcagacagaagccaatgtctagctcaccattgctcaagccagcttctaatggtgtgaaaaccttcacttgttccacgacattgttatgatcaacgagctcccatgccctgacaagaaccttcagctttccaaccttctcaacagaaacaacacgccgtgaaagctcaatcgtgccatcaccactgacagttactacgttctgatcacctctagaatcaagcaggactattttctcaagttcaattccagctaggatgtcttcagaggccaaatgcctgaatctgacaccagtggtatatgcagcaaactgaccatgaaaaccatcaggccatgacccacgaatgacacgcacagatattgtggcctccacagatgacacgatgtagccaagtctgaactccagtgtgcttagcttgcttgtgtaagaaccagatttaagcacgtgtgagtaatacttaccagcacataagagtggcacagctagtaagctcaagcgcttgtcctcagattcagtggtgcccttcactttcatttcaacatcgatgatcagaggatccggcattgacaacacaacagcacgggtgggccctaccagcactaaatttcgttcctgcattgtatggaattaatgccacaaatgaataatcatggaactggagtaaaagaagacactaatatgagcagcataataaacagaaatcacacgtagcataaaggacatggtaattttcaggaagcaattatatctgatcaccatgcgtaacaggctattttccagagtgtcaataaatgaggccattgacagaattgaaaacgacaaggagaaactgtaggtacaaagactgcatgttatatgcatgcttgcacggttatgaaattaaattaggaagggcggacagctgcatgttggaggtaattaaacagatcaatggaatgttaagtaaagaaaaaggtcagaaacctgttcagtgagggtttggcagttgtcccttgtgcggtggaagacaacattgcgattacgatcaacactgtcacggatggaaactataccgaacacatcaagcggccactgtaaacctccactcgtcgctgctaccttgacagagaagatctgtagagtatccaaggcactggcagagtagtaacccagcgcaggcttatgagtgaaatgcattgggggatccttgctgcacgcaccgagttgtataagaattgaaatgagttaaaagattgaattaatccaattgcagcagtagcagcagcaatagcaataacaaaagtagtgaacataactaacaacaacaagtccatgtactagtagaaaacaaacaattaacagtattccggatccggacagacaaccccaccgcttccttatgtctataaaccatttgaatttttagaatttaattctgatattgattacgtggttcttcatcgtagtttattttatactccatccgtcccaaaatataagcatttttagcttccaatctagacaactgtttgtctagattcatagccaaaaattactatattttgtgacggagttagtagccaaaaattaaagttcaatatttaatttggattttgaaattgtttttttttcatcgtagtaattgcttgataagcataaacataaacagcgaaacgttgcacatcacatgaagagaaaacaattcatgataagcatatactctcttcgtctaagaaaaaacttaacgtagaagtaggaggacgaatttgaactcctacgagagtcacatcctcttctaggttgaattttttctcaatggaaaaacgaaaaaacctcactgacttcctcgaatgaaccacggctgccggaccatgtatcgttccaggaattgcgatacgcgatatagtcccagttggattcatcgtcgtcctgcgaccgcatcatctcttcgtatgctttgtcctgctcctcgatgttcttcctcaccctcgcctcccactcctccggggtctctatcctcctgggtctcgacgcgaaggccgccttcgatgcggcgtactcctccgcggtcttgccgatgaatctcaggaatccctcgctcttctcgaagtcggcgctggtccaaaccctctgcaccgacgccggcttgggctcttgtttctcctcctcctctagctcggcttcttcttcttcgtcctcgtcgtcgtcggcctggagccgccgcttcccgagcacccttcctcgactccgccgccgcgccgtcgcccccgacgacgaaaccttaccagtcgccgccatcttgccatcgctcttccggtcaacctccgccatctccatctcgccggccaccgcaacgctcacaacctcacctggggtctgggtggtgctcgccgccggcgagcttcgaaaaccctatatgatgcgaccgcgtgcttaaaagtcggcccagccacggtgcgaagcccaaaggtgaacgttgggcccaaagctgctcaccggatgttgggcccaccgagcaattaaacctctggaacagaaaaaagttattcctaagggtaaatttgataacgccatttataaatttgtcatgtgaaaaaaaatcccatcactgttcattaaatctgctgaaactcaaattgtgccattgccatcaggatttctgtcaacacctccgtattgaggagagaaaaatgaaaatattgcactttcatccacattatctccttcctctctcctcccttattatctgaagaagcatcccaacaactaatccaaatttgatcctccatatgcctatatagatggtaaaaaaaaaaccctccttcatattccttcccacttcaactgatcatccatattatattctccatatcacacctttctatattttagtaatatttaccaactaccgtgcacttatattatatttgaacgactatatttcatattttatctccttttctctgttattctctatcttctatgctcttttctctaatacaagtctgcagagcagtcgaggtggcccgtaggagcagaggtgcgcagacagcgacgacggatgctgaggtgggcaggcggcgcaagcggccgacgggcgtggaagtggccaagatggccggcgggagcggagccgcataggcaaaggcggtggatgctaaggcgggtgggcggggaagcggcggcggtgagcgacgggcgtgggtgtcgcgcaggagacaacgccggatgctgaggtgggtaggcggcgcatgtgggtggtgggatcggaagtggcagcgatgacgacagccggtaggcgcggcagcgacatcggcggccggtgggcgacgatgacgatggaggggaggttgatccagaacttcggatggggacgagagcgcggacgttgagatatggcgttgatgagagagaatcactatatttggccgaactctcttcgatttggcgtatcgtctatttttggaggcctcgatgccatatctactggagcaccgttttctcctccagtgcgctatgttttggatggagtaccggatgaggggtccgctggggatgctcttaggcggcacacatgagggggtggcttcaatccaactttgaactagaaagaagagcaccgacacactgggtgatgactcttagaatcctgtgtcgatcgtgcatgctcgaattcattgccggtaacctagcctcttgtcatgatagcctcgatgagatgatccgctctctactcatcaggaatgccgaagaagatgacaatattcttcggtgagatatggatggaatgggtttaggaagaagataacaaaaatcttggcgacaatggtatggttatacaactttacaaaattctagtagcatgcagtaggttttacgaatagttatgatatttttttaatatgataaatttgtaatggcatggccaaatttgcataattttaaagtaaccaaagttatattccctcaaaaaattttatctctgatgaggacttaggagtaagcatgcattaaaataatgtattcatattgacgggaccgaccgaggatcgctgtaattttgaatctatgtggcgaccactggtgatctggcaacaattactagtcggcatatcttagaagtttactactactccttaaagtcttaaaattttgatgaaataattatgcaactgtcgaatatttatgactgaagtatttatattggatataacgtgagaatacttttgtttaatttgtttaacatcccttattccaaaatattagaaatcttctgctctaaattatataaaatcatacaacttaaatcctgtggtagtatcagcagctggtttagctggcgccacatcctagtaaaaaaattatggtggggcctaatgtcaacaccatgcacacgaggtcaacgggagggggcgttggctcgtcgtctttgtcagaaacggacggcagctcgtcgacgatgatgccgccaccacccgagttcgacgcggggaacggcatgaatgccagtgccgaggtagatggagtaggaggttctggagctggcgccgatgccctctccactggcgctgacaaccatgacgccgtcaacctcggctcggcgagacgttaggcatgcatgcgggtcgacaccagtcgcggtcatagcctcaccgtccatcatcttcttcatcttcacccgcggaccaactcgaagaggccaactaagaacatcgattcctgcatcaccaatccacacaagctttgcagcttcctggagaggggagggagatctcctctcttctcttgttctgtttcttggactggtccactgtttttgggtggcagtgccattgatctggtgaatatgcagaggctggtctcttgatctgatgatggcgagcacgacatcgacgacgaccgcggtgagcggcgcgtgcacgagggtcaatacctgcggacagaggcggtcaagtgtggtgcggtgcgatggcagcgggggcgttcgccgccgctttcaccgtgaagactcgggtggggttggtggtggctgtgtgtagccgtgcacaaggcgtggttccgggtgcgaaaaagagaagaggaacatgtgagtcccaccatatattatttattgttttttatgttagctgattaggatgccacgtcagctaaaccagctatcgatactttcatgggtgggtcctatgttgcacggttggttttgtatagttcagggatgtcaattaaacaaaactcgactacagttgagggacagaaagtggacttcttcccgacttgtagatgaccactcatggtccaccgacttaagttggttgggccttggcactgttttttgggcctaaccggaccgggcacagactcattgcttatctatctacccctaatcatccgacttgcaccggcggcagaagaggcggagcggaggggatctagggtttccgagggtcgccggcggcgaggaccaccaccgcctaggtgagtcgagttttgcggtggccgtgccctcgcgagaccgacatggaggccgagcggaggagcgaccgcgaaggggactacggtggctggatggcggcgggctcgtcgtcgggggcgatggtgcggcgggagacgaggaggtcggaggtggggttggagaagtcatcgtcgttgccgccgcctttgcccaaggaggcagtcaagattgacaagaagaagacgaagaagaggagtgactacagtatcgaggatattctgaagattcttgatatgagcgaggaggagttggctgtagtgaaggaggagtgggctgaaatggaggcgaaggaaaaggaagaggcaccaaaggtgaaggaaaccatggtggagtgggaggcgagggtcaagaagaggattgaggaggagaacaaagcatatcgagagatgatgcggtcgcaggacgacgatgaatcctcctgggacgctatccagtatcgcaaatcctggaacgctagatggtccggcacccgtggttccttcgaggacaccagtgagtttgttttgttttccattcatcgatcctctgttcctcctgcctttgtagtattaacctagcttcagattgaccaagcatttttatagccattgctgttgtctgttacttcctcaatttcatattatataaattgttgctttgatttttttcctagtcaaatatttttaagtttgaccatatttagagaaaaacatagtggtaatatctccaacacaaaacatacatatcatcaaaatatattaaatgttagttttgacaaaactaatttaatgttcttgattatgtaattttttttataaatttggtcaaatttaaagaactttgactaaaagaaaagtcaaagccttataatatagtatgaaatggaggagtacttcctagtatcatgcaagaattgtttgttttctccatcgacaatagttctaattgctactccatattttgttttctccattcacaacatggttgttaaggctaaaaggcgtcctaaggcgaccccggactgccatagcggtaaggcgtaaggcgaggcgacgccttaggcactccataccaattagatgacaaataaaataatctaatatgatagcaaatcaaagatgcattttaagagcagtacaacacacacacacatatatatatatagatggttgtaataattacttaaccagatatcaatttattaactaaaagagcaccatcttataaatacagagtgagggtgcatgggggaagagcaaacagggtaaatatgtgctaagtactaactacaatacagagtgagggtgcatgggggaagagcaaacagggtaaatatgtgctaagtactaactacaatacagagtgagggtgcatgggggaagagcaaacagggtaaatatgtgctaagtactaactactaatagggagtcagggatgtaggggaggggcaggcaataaaacagagcagtagagggaggagtatagtatatgagatgtagaggagagggaggaaaaccacaacatagcagcaaatgaggaagcagagtagataggatgtagaagaggggggaggaaacaccaaaacaagcagcagaggaaggataagaacagggtagaggaaggagcaaagcaggatcacgtagagcagagaaagaaacagaggaaagtagagggtggaggaaagaggagaaagaagagcgtgcctgcttagtttttgtgtcaatggtgaggaccaggatcatcgcgcaggtgcagaggaccaggatgatggtgcagccacaggatagccgcaggcaacaactgggatcgccgccagggatggagatgtcgcgagggatggatcaccacagcctcagactccagcgaccctctttctgttgttttctccttgatttggtgggatatggcgcgtggggaccttttcaccccaataattggcgcttctgttagttctgtttcgcgcccagggcccatggcgccaatttttttgggcccttcaaccatgccctcaacttcctgtggcgtcgcctttagccattgtagcgcctaaggatgcaatatcgacaccgtagcgacaccttgggcataaagcggacgccataagcaatatggtaaggcgggccagacgccctgactcctggcagcgccttaccgctatagcgacgctatggcgacgccttgacaaccatgattgacaatactgacaattgctactttgttagttgttatgattttataaactgcagttatctgcctgaggtgtgcaatagcgcacttgctagttgtttattgtcactgttgttgttactgcttttattgctactgctgctgcaaaaattgggttaggtcttttaactcatttccaccattttacaactttgtgcagcgagaataccccccatgcgtttcacccacaagcctgcactggattacagtgccgctgccacgcctactctgcaggtcttcttcgtcaaggttgcagtggcaaagggggccttacagtggccacttgatgtgtttggtattgttgccatgcgcgatgttcttgaccgtaatcgcaacattgtcttccaccgcacaagggacaactgccagaccctcactgaagaggtatgtgtccttttctttatgaaacattcagtggcttgcttgtctcctgctgtgctgccatatgctcttcctaattttcataaccgtgcaggcatgagtactgttaattaccatgtagtctttacacccgtagtttagtttctccacaaccattgaattgtgtaacaactttatggaaaagagctcgtcaggcttggtgatcagatatcattgcttcctgaaaattactatggttcacatgcttttagatttacatgccttttgcatgcagtggaaatgtggaatcatgtacatagacagctcaacatatgtgtaaacaagcaatgagaaggcatatgataatgtctgtgtttcatcagagaaatagccatttcctagtacaacacaagtcaggctaaaaaaactaataattaattcaaactctcacacttgtgtttgagtcaactattactgaatcagtacattgaatgaagtttcttaaattaactgttaccttcataatatcatttggataaaatatctagtattaagtgatcctagggaagatggctggttctcttttcaactgtctcacactgtccctacaaattctgggtactttatcatgtacttaccacaatgcattgatatacctctttagtccacaatgcatatattctgaactgttgttctataatgactgtttgatagtttttggtgctttattgttctgaattcagccctaagaatgtttcagcttcgattgcaaggtgttgttctgagtaaagccactttattgactctcgaatattgattgtttgcacataacaaacatcttgttcgttttgccactagtacattgtgctaatatgtttctctcagattttgtgttatgcatgccacatttatgctatgtggtttttgttcgttatactgtgttgtatggattatgctcctcatatatacctcttctttcactccagttttctgattgttcatttgtggttttgcgttaatgcaggaccggaatttggtactggtaggccctacccgtgctgttgcgctgtggatgccggaacctgtgatcatcgatgtggaactaaaagtgaagggcactactgaatctgaggataaaggcttgagcaatctagctgtgccgctcttatgcgatgatacgagttattcgtacactagcaagctaagcacactggagtttagacttggctatattacgtcctctgttgaggccacaatattcatacgagtcattcaggggtcatggcctgatggtttgagtgctcaatttgctgcctttaccactggtttctatggcaagggtatggcctgtcgagacagcaatatgagtattgatgatgagagaattgtcctgcttgattctagaggtgagaaagtagttgttactagtgatggcaatatcaagctttcacggcgtgttgtttctgttgagagtaacacagagctgaaagtttctgtcaaggcatggaaagctgacaacaatgtcgtcgaaaatgagaatgttttcacagcattagaagctggtgtaagctatgctacacttgacattgccttttgtaagctggaaatcagtgttgcctggtcactcatttcgcagtatcctgtttctgccaactcggtactgtagccactggttccgaaaggttcattatagatattagtaatatacccgtgctaacgctatgataatatttagtaatacaacatatcttttaccaatcaaatattaaataagatatatttatgatttaaaaggtagagaggtctccaccaacgtcgcaccaagctgacacgcacaaagctaacaagattacacccaaacggcacaacgtcacaggttggattcaattcaaccaaacatacctatgaaattggacttggatttctaccatgttcgccggctgcctatgccacctgcgtggttcggatgagagagcggatggataggcagatagcgcgggctggaccgtcgattggacaccttcggtcatcgatctgtacagaaaactaattactacatctgttccaaaatataagcatttttagctacaaatctgaacaactatgtatccagatttatagctaaaagttgttatattttgggacggatgtagtatatgaaaatgagatagactcaattttttgacaagtgcatattttatacatatgaaaaaagcatttcgttaatacggatggagtcatccatatatacagagaactaactatatcttgtttcaaccaagtagaagctttttttttaacaaggatgtactactttttaataatagaaatgctatctaacaggatcccatcccaaccgtgatggatgggatagggcagcaaccaaccaatccatcgattctatctccttctaccgtatccattctaccacatctctctcaaagcatgcttactgctgcatgagctccggcgcggcatggggtgtagatggcggaggacgcggtcactagcgacaagctctggcgtggccgccggcgtcgagctcccggcgtggcatggctgtggatggaggacgcagcccctccggcgacgagctccggcgtggtgcggcgcgtggacagcggaggacatggccgccggcgacgagcctggtgaggggcgtggcggcagaggacgcgaccgccagcaacaagcctggtgtggggcgtggcagcaaaggacaaggccatcggcaacaagctccgacgtggggcgtggacgacggaggatgcagccgtcggcgacgacctccgacatgaggcgtggacaacgaaggacgcggctgccggcgatgacccccgacatagggcgtggagggtggggccactggcaatgacgcatcggtgctcagctcctgatacctagtaggaatcacctgatatctggtaggtatcatctgatacctcatgagtatcacctaatacgtggtaggaatcgtatgatacttgataggtatcatttgataccggttaggtttcaggacatgatacctcagagaggtatcaaaacatgatacctaatcggtattatcacgttcgaaaacaagattccgttgtatagcagccctcttaaataatccattgaaatgctaagtacttcatccgtcccataatataatagcctagtaacctcatgtactaggttgtatattatggacggagggtgcagtaaagataaagaaattgcactttggtccatatttctttacccttctttcaatttggactagggtaaagcaatcttttcattttggaccacctaaatttacatgttgtttcacctcccaagttgttgggaggtcaagctcaagcttgagttggagtatgacaaaaatggaactcgatgtaggctgagcatggctcaaagctgaagattgtgcctgcgggaagttgatcaggctgaacgcgacatcgaggctaacagcaatgtagtgtggcaccaacagagcttgaggttgaaacgacaaaggttaaggtcaagcgtgggcactggctaggctcgaggtcgaggttctgtgcggtgcctgtgcctgcgaggtccgaggttagacattacttggctttggtgatattgagaagggatggggtggagagaagagagagggagctagaggtggaagaagagacccaaaaggaaaaaacgtataatttatgtagtacaaagcgagaaaaggttgttctaactcctgcccctagtttaagttgaaactatggtaaaaaagatggaccaatatgcaatattttttcttaaaaaacaaaattcttgtagtgctagtgtactacccaacagccacgtaggcactaaatgacacgaaggccaagcaaaaaaagtcatataggagaggtactttgcacagatttgatagttgtggagaggtactcaatttgcattgattttgatagttgcagagaggtattcaatttgcactgatttactcggtttgtggttgggggacacgaataaaacttgacccatagttgagggacgctaatgaactttactaaaggtaaggtccaatttctgttttgcgcttcgcacggtggatgggcctattttatttgggctgattttagtttagagaatttttacccaaaccagtcgccacgttttcctccaccaccgccaccgcccgcatctgcagcctagccgccgccacccgcgtctgccgccgccgtcgctgcatctgcctccaccgctgccgtcgcccacgtctgtagccgagccgtcgctgccgcccgcgtctgctcccttcctctgccttcctttgtctgtgtcaagaggacggagaagatacttatgtagatgacatgtggggttcactcgcaaggggagaagctttttcaaaagccacttgagtgtaaccaaacaagcttttggcttcttcacagctacttttccaaagctacttttaaaaaagtcacagcccacagctggttttttaaaagccatagcccaaccaaacacaccctaagttcacttggtggcactcaaaagtgattgaaatctaatccgtgaccctaaactataaaaccggaaatattgaacccccaactcttaaaaccggtacaatttgactctctcagcggttttggatggcggtcttgctgatgtggtgtctacatggcatcccagtcataaaaaagttaaaaaaataaagtgggcccacctatcatcttcctctctctactaacctatctcacttctcatccggtcatgacgagcagcgccgggatgatgatgatgggcggtgatggggctctcctcacaccccggctctttccaccccgtcgctggtggcggagtggtcggatatgcggcttcctcgccggaagtcgttgatgggccgcggcagcaaaagggggttgaggcgggtggatagcttgccaaggtcgcccatggtgctggcgtcgagggcgtcgctggccaagaccaagtcggtagtcgacacgcaggagctcggtgctatggacaggatgtcggctactcatcgccgctgcaaggacgtcaggatgagggggcggcgcaggcggcgtgccccgcgcgcggaggcggtcctcgaggggcctcgagcacggcgcagaggcgagcggccacggccgaggcgacggtccatgtggtgggcccgtggcatggccgcctcgcgcatcctgatccggggtggcggtggtgctcggcaatggcccagccatctgctgccgcacctgcgtcgcctaggagcacgtttgcacccagccatctaggctcctgtcctcccgactgccaccgccactgccgccgctccggctcttgcgcacccgtcgccgctgccgttccatcgcccatcctctcccgcgcgaacaactcctccgccttggtcctcgtgatggagttgagtatccgcaacaccatggcgtcgtcgtcgctaccctcctcgtcggcgctgaacggcgcgagtggacggaacgacagccggaggtggcctcgaccccgctggtgcagttgaaggagatgtggtccagcgactcgcgagtcgtcggagaccacgcaggtaactgcgagggcgaggatgacgagcagcaacgcgggccgccgccgccgttcccctcatcctcccactaccgccagcctccatggccgagctgccgaccgccgccccctattccgctgtgccttgatgccaccagctgccgccgctgccaacaaagagagagaatataggagggtgtcaatgataagcgggccccactttattattttaatttatttgacgactgggatactacgtaagcatcacgtatccggttttgtgatttagcgttacggattagatttcgatttcgattacttttaaagatcacgaagtgcacttattcctaccactttttaataatacacatggtttttctgctaggatccatgtcgccgagttttttccagtccgatctggtagttttacacatagtttatctgttttattttaataatacacatggtttttctgctacgatccaggtcaccgagttttttccggtccgatctggtagtttttgtccgggtcactagtgaacggtttttttttcgatgtgggcttttggttgtgctgccagttggttgttttttctggtccaaattggttttatacgtgtctaacacagatggcagatgaaaattaaggtttaatttttataatagataaagatgaatattaggtaactctatttgggattcaatcctttcgtgtgcaccaagaaaaaaataatcggaaacagcgatggaaaaaacgggcccacaaaaaaccgcaacacataaaatcgtgacccacccagaaaaaaatcggacaaagaaaaccgggcccaaataaaaactggagaaaaaaccaagacggaaaaccggaaaaaaaaccgcattgcggaagtaaaaaacgacggacaaaaaatttttacggaatccttacatattttttaattaggtatagatatatatatatacaccatgttcagtactagtactctttttttaagaacttgtttaatactccgtattgtaagacttttatctcagtactccctccgtctctaaatatttgacgccgttgactttttagcacatgtttaaccattcgtcttattaaaaacttttgtgaaatatgtaaaactatatgtatacataaaaatatatttaacaataaatcaaatgataggaaaagaattaatgattacttaaattttttaaataagatgaacggctaaacatatttaaaaaaatcaacggcctcagtcagacaaagagggagcatatgggaatggagggggtactgtgagatagtaaccagccaaaaagttagtattccatgtgttactttttggctggtgtatagtgctgcaaaaggtactaaacctgaaattacaaacattaaatttatcacgatgcaagtatgcaatctggcaggttcttctactctcgatagaaacagatatgctctaactttgtgcagtctatagttgtaccactgacacgtgggtctcaatttggtatggtctatatgtcagtggcacaaactgcacaaagtcagtgactctcatcccctttggatcttcatattgctcgcacttcggggttacatcacgtccttgtcactgtccctgttatctacatatttcatctgtcctattttaagtgcaactgcaagttttcacgatattctgttttatttgaaatttctttgtggttagtatttttattgttattagatgataaaatatgaatagtactttaggcgtgacttatactttttaattattttataatattttaaataaggcgaacggtcaaacattagacatagaaactcacgactacacttaaaatgagacggagagattatatagtctcgaagagggggaatcagtgtcatgagcttgacttgggcctggcgaagggcagcccgacccgagagatggggagagagggccgtcggctcattactttttattaattatttttgtctgactaagatgttgatcccattgagatttttttaataaaaaactcttctagtgccatccaagcgccacgtagccattaaatgggatgaaaaccaagttaacatataatgtaggatgctttgtacctaatcctatcttactataaacttatcctcgactaacttcttaagcttaacatgcaaagatgcc

SEQ ID NO: 18971 - DNA, 6881 bp, Oryza sativa
  unsure (1)..(6881): unsure at all n locations
ataggccgaattcgagctcggtacccctctataactgcacttgtattcaactgtggttttgttgtttagcaataagatcttatgcgtgacatgtgcgaaaatttctttatagtaattttttctcttcatgcacaaatctcaaggcaatccgatggctacaaatctaaaagtttcgaggacaaaaacttgtgaaagttttctagcaattccgttttgacaattttatgaaacctcaacattttggtaattttaattatgaaaattaaatactattttttaaaaaaatataaactacctccattttttaatatttgatgttattgactttttaagaaaggtttgataattcatcttattcaattctttttataaatataacattttacgataaattaagtcccaataaaataaatgataattacataattttttttgaataaaacgaatgattaaacgtatatagaaaagtttatggtgtcatacattagaaaacgaagggagtatataataacttcgagcaagcactgcacgtgacaaaaacaataaacaaaccctaaaaaaatactgtagtactacttagttaatatgccggcggtgaaagttagggtgtgtttagtttacgccaaaactagaagtttggttgaaattaaaacgatgtgatggaaaagttggaagtttatgtgtgtagaaaaattttgatatgatggaaaagttggaagtttgaagaaaaagtttggaactaacaaggccttagttgagagaactactccgattgtaatatgatgatatggatgcatcattgaaacattgatgttgatgaaaattactggtaatgtttggcaaccgtcaatgagatgaaacgacagactttcgtggagctgaaaaattcgatgaggtgatctgagtgaatgtctggcaacgcgttccccgggtcaatggcctcttccctccctcagatgcctattttttcttgtctctgttcaatattctgctcatgctagtgagagaaagataaagagattatactagtaataatacagagagagacattgactcgtagcagactcatgccctcactatcctttgtttgcacctctgaatctgaatgtttttctgttccatgatttttgcaccatcttcaagtattagtagtacttattttcgtatgtttgcaattgcatgtgccgttcttcgtagactgggccgaaatttgttttacttgtaatgccaagttaattaaccctcctcgtggaacaattcctacttgatatattaaaacagctcagtcataagcaaggacattaccattgaccacagaaaatcttccctcagaaacattttaatcccatgagtaccttgttatctgaagttaggagacgacttagcttctctcaacatttttaattagcagagttcatctgttcctccgagattcttgccatggcacatctattgtaattgaaggacaaaccatttcaaggtaggaatttactgctcaaaacaaaatccaaggtatggaattcgaacaggaccatgcagagtgctgaacattttaattgccttgttatctgaagttagcagacgacttatctgaacatttttaattagcagagttcatctgtccctccgacattcctgccattgcacctgctgtaataacttcaggagaagccatttcaaggtacaatttattgctcagaaaaaaattcagagcaaggaatttgagtaggcccttgtttaggcctggtttagttcctaactttttctttaaactttcaatttttttatcacatcaaaactttcctacacacgtaaacttccaattttttttaaaactttcaattttgacgtggaactaaacacagccttagttcccaactttttcttcaaacttctaactttttcatcacatcgaaactttcctacacacgtaaactttcaatttttttctttaaactttgaattttagtcaaacttctaattttaacatgaaactaaacacaccctaggagtcctaaaacttgtgagctatcacgagcagactccatttctacattccatttgaggagaagccatatcaatgtctgtctcactacattccagtagagaaggcagccaaagcagccacgcccgtgtttaaaactgatgaagatgaatatagatgaatattaaattgacttacgtaaaaaaaactattagcacattattaattaagttgtaattcttacaaatttaacaaacgaatatatttgatattttaaagtaacttttatatataaagttttcacacgaaacacactgtttagtaatttaaaaaacatgctaacagaaaaatcgagataaaatatgtatctcaacgagaaaagagctgagggcctgaggcatcttcttggctccgggaagaagaacacggctcgtgactcgtgattgaccggatcagtgtcaccatgcttgtcgctagcaaccttagcatagagacgatcagtgatgatatatgtatgcgaaaatgcaaagacaaaagagagaaaaagaatagtccctatcacattggatgtttggatactaattataaatattaaacatagactattaataaaaccatccataatcttaaactaattcgcgagacgaatctattgagcctaattaatacatgattagcctatgtgatgctacagtaaacattctctaattatgaattaattaggcttaaaaaatttgtctcgtaaattagctttcatttatgtaattagttttgtaagtagtctatatttaatactctaaattagtatctaaatataggaactaaagttaattgccctcgatccaaacaccacctgagcagcagctgacaagagctcgctcgaaatgtatgcgaaattgtccctgtcgatccgacgtgcctcgcaagctctgccattgacttctccagcgctcttgtagcacaccaccactgtaccctgccccttcttctgcagcgttttgttccatcttgattattggattctactgccaggccctacatatttcctccttagaatcttttaagatttttaagatttttcttctttgtagaaaattccagtgtttgattggttggtccacggttgataagctctataataatgatgaagtaaccaaaacaaaattggtagtaaaaatatgtattcttatattatcattagcggtttaaaactcaatgaaaaacaaactaagacaaacaaaaacctaaattttaaaataagttattaaatataaatgttagctacggttgataagcaacaagctgatagggagagtgatgttcctcggagctcagtggtgttcacctggttagattatctaatcctaacttgatttataccatgttagttggtagtcagtcaacaattagattatgtattgaacttatggtaaattttgttctggttcgaacttatgggttttctttctttcatcctacgaaactctgtaccttactactccgtgaatattttagcagtagccgtgaatgttcttaccattataattaaatatattattattgtaattagtacgtgacatttaatttaagaggtggttaattaatggataatgagcttgatggatgtccaaagattagtaaagcacactagcactctgcttaaccatttcaaccaatatccactaaaagtgacagtactttgcctaaggcactaacttaaaatatttgagaatattttacttttaattgagatatcctttttaagtcaacagagtcaactgccttgaaaaagtcattagtaaaaggcaaaagcgcgtgtccaagtcaatccatacatatccatcatctttaattttgtgcttagtgttagaccatagttttaggccatcgttatagctcatatcaaccctacctaggtagctagtaatccattctcccattaattaatttctatgtgcaaaatttatacccagaagtagttattgttcctagagtttactaaagataatgacctcattcatctaatgatgattataaaccttattaccaatgaaaaaaataataatttgtaagtaaatcatatatgcttgtgtccttaacaatccaaaattctgaaaatcaattgtaagaaataaagtttgatgaaaaaataaaattaactttaaaatacagttttaaaatgtaaattttgatgatggtttataagttgtagccttataggacgaatgatgggagtataaatcatcaggacaatcaaccatagcatccaactaactaaaacaacgggaggttctactactaaactagccactaataatgcaatcatgacaaaccagcaaaggaataaacttattactaccagattcatcaaaccaaaccttggacgagtttaccttcatcccatgataagcggtaaccatgagatttgttgtggtttcaaaactaaaaaattaccacacgtaatatataactgtaataaccacacaataatcacacggtttcgcaaatgagtaagtagtcccttcatctcagtatataaataatttgaattagatgagatatatcctagtattataaatggacaaagttagtactataatttatcacatacaactaaagtcatttatattttggcacgaagagtacctgtattagggttttttcgggaagcttaaaattctgagaagttagctagtgagaaagaagctgaaaaactcagcttatgacttctagtttatttttcagattctacagttatatattctcatcctctaaataaaaagactataggagcttccgtcaagtagcgagcttccgtcaagtagcgattaaacaggccctatgaagattagcgagggaaggagtgtggtgggccccaccaagcaggagaggggggtgtggggcccaccatgcagggccactcactccaccaccacaataagagaagacgaattgacaattccaccgccgcccgcactttgctttgcttccggtctccggtctcctcctccaaactccggtcggtctccggcgcggcgcagccgagcccccaccatacgacgcggggaggcagacgacggggcgccgctgctgctgcccggggagccaccgccggtcgccgccgcagcagcagcagcagcgtgttcagaggagaagggggcagcaggtaccttggggctctgccgcatgccgctgtgggggacaggctcgtccgcggcgtccgcggcggcggagggcagcgcggccggaggggatggggcggcccgctcgtcgtccggcggcgccgcggtgatccggtcgatgctccccacccgccgccgcctccgcctcgacccgccatccaagctcttcttcccttgtacgttcttcttcttcttcttcttgctctggtttcatggcggttgctctgtccaaggatttggttagtttcaatcctttgttacagttttggttggattaattggagagtctcctttgctgcgcgactgcaattgtgttcttgatttgcttggctcggacttagtcagaggcgctgtgtctttgtttctcttcgcatactgatttgtggttaagaatagtctctgctttgtggcgacataaaattctcacttgttcttctgtttccgctaagaaaattggcttcttgtttttttttctctttcaaaaacctgcgaaactcgaaaaaaaattgaaacgaattgcctatgattagtatgttgctcgtaaacggaatagattgaatcagcacggttgatggatacagactctttgcttgtgtctgattttgccggaattgatactgattgctacagatgagcctgggaagcaagtccggagtgctgtcaagatcaagaacatcagcaagtctcatgtagcatttaaggtaaattaacacaactcctctctgatggcttcttcatcaaactagatgctataccagtggttttgcaaatgatagtagttaccagtaactcagtaagtagtagcctagcagtccagctgctgttatttttaaaggtgcagctcagattaatgatgaaatcaatactctcaacaactcatatttgaaggtgagctatattttaggatttaatcaatactctcaacaactcatattgaaggtgagctatattttaggatcatctgttaatttaaagatgctcatatttttaacagatggctatgtattgatctccaccataaaaatctattggttcagtccccacttacacagtagctactaataaatcactaatttgatgcattccttttgttctagttccaaacaacagcaccgaagagttgcttcatgaggcctccaggtggtatacttgctccaggagagagcatcatagctacaggtaatgcagagtggacgttcacctttgatgtgcattcctgttttttttttccttcgccttcctcactccttgcttatgtaatggtagtgttcaagtttgtggagcatcctgagaataatgagaagccattagatcagaagtgcaaggttaagttcaagattgtcagtctgaaggtcaaaggacctatggagtatgtcccagaactggtatgttttcttttaatctttagcttgttcaaaagttttaattttgatgcttaatgcgttctcagttttgaaagacaaggacttatagaattacatcccacaccctcactagtaattcattcatattacctgaagttttagtgaccttgatattaatatcaattttttttcacctgtaacacaaaataatacagttcgtttgttatgaacctccacatattttgtccattttagcagtgcatggtctaaagtgttacccttatgttacagtttgannnnnnnnnnnnnnnnnnnnnnnnnnnnnnnnnnnnnnnnnnnnnnnnnnnnnnn

SEQ ID NO: 18972 - DNA, 3538 bp, Oryza sativa
acgttcttcttcttcttcttcttgctctggtttcatggcggttgctctgtccaaggatttggttagtttcaatcctttgttacagtttgggtggattaattggagagtctcctttgctgcgcgactgcaattgtgttcttgatttgcttggctcggacttagtcagaggcgctgtgtctttgtttctcttcgcatactgatttgtggttaagaatagtctctgctttgtggcgacataaaattctcacttgttcttctgtttccgctaagaaaattggcttcttgtttttttttctctttcaaaaacctgcgaaactcgaaaaaaaattgaaacgaattgcctatgattagtatgttgctcgtaaacggaatagattgaatcagcacggttgatggatacagactctttgcttgtgtctgattttgccggaattgatactgattgctacagatgagcctgggaagcaagtccggagtgctgtcaagatcaagaacatcagcaagtctcatgtagcatttaaggtaaattaacacaactcctctctgatggcttcttcatcaaactagatgctataccagtggttttgcaaatgatagtagttaccagtaactcagtaagtagtagcctagcagtccagctgctgttaattttaaaggtgcagctcagattaatgatgaaatcaatactctcaacaactcatattgaaggtgagctatattttaggatttaatcaatactctcaacaactcatattgaaggtgagctatattttaggatcatctgttaatttaaagatgctcatatttttaacagatggctatgtattgatctccaccataaaaatctattggttcagtccccacttacacagtagctactaataaatcactaatttgatgcattccttttgttctagttccaaacaacagcaccgaagagttgcttcatgaggcctccaggtggtatacttgctccaggagagagcatcatagctacaggtaatgcagagtggacgttcacctttgatgtgcattcctgttttttttttccttcgccttcctcactccttgcttatgtaatggtagtgttcaagtttgtggagcatcctgagaataatgagaagccattagatcagaagtgcaaggttaagttcaagattgtcagtctgaaggtcaaaggacctatggagtatgtcccagaactggtatgttttcttttaatctttagcttgttcaaaagttttaattttgatgcttaatgcgttctcagttttgaaagacaaggacttatagaattacatcccacaccctcactagtaattcattcatattacctgaagttttagtgaccttgatattaatatcaattttttttcacctgtaacacaaaataatacagttcgtttgttatgaacctccacatattttgtccattttagcagtgcatggtctaaagtgttacccttatgttacagtttgatgagcagaaaaaccaggtagcagttgagcaaattctgcgtgttgtattcttggacgctgagcgtcaaaccccagtaagtttcagcaattgcttttactcttaatgcaacacagttgtgaataatagaaagtttaccacaaatttgcactttctgcagcaaatggacaagctcaagcgccagcttgctgaagcagaggcagcacttgaagcacgcaagaaacctccagaggacaccggcccccgcattgttggtgaaggccttgtaattgatgaatgggtaagatcagggcacagaattcttaatgacagttgtctggtcttttactattgtgttagtggctgtctcatgtgaccatataacatttccttatttccccttatttcagaaggagcgaagagagagataccttgctcgtcagcagattgaaggggttgattcagcgtagacacggcaccatgaactgtaaaccattggttgcttgaacatatcgttttatcgtcgccacacatccttctgtccatggttttttcagtttttacaaaggttctgcttggaacaagagtgaggctttgtgtaattaggatttgagcttcatgctgcacttcattcctgggtctacatgtagatagccagtcactgcttgataataatattttctatgctagatcatgtacttggggttgtggacttagacgtgtggatgcgatacatttcttaggtgatgttcccatcaatattgaatgtaatgttgtctgaacgtgctcttcaaagtgataaaatgaaagctctcctatcatgttactctatttcttagatctacatgcttctgttgcacatattgtagctaagtttccttctaaataatatattaactagccagcctagtgccaattatccagggaatcatctatgaaaagttattcaagggtagtaccatcttggaatttattttttgtaatattgtgtgtgagttatgtactgacaggtcttttgaggagatgaaacattctgggctcagcatctggttctcatgttcttttgttcttttatttgcctgtgtgacctgtactgatataattgttcttgttcctttgttcatatgatctgtactaataaaactgttgagctggaagaattaggtacaaatacacctatacctaaccaactaaaccattaggggaataataatggaatatagttaatagtttagtcctttggggtttggacaacctgttgctttctttgaattcatacttgatgatttgttaagaatttatttccatttcatagccagatagatgcaatcagacatgcttgacttttaaagctgaaaaggtgcaacttgcagcttcttatcttctatttaggattctttcattgtcattgagacaaagatgtattctctagaatatatattttttatgtaatgtcacccggtcaccccttccttttcttcttctcactttttctttctttctttatttcttcttttttttttcgtgaagagtggtaatcctttggcctaactcaaaaactaaatatttggccctagtagatgcaggtgatgattctatttggattgctcaatgtattattttacattatggaatgtctgaaaattcagctagaggtcgtatacctttctattcttttggtcgagttgctttcagattggattattacctcatgaaaaataagcagcacgaattaacaatgtagcagatggacattatcagcattgttttttttttctttaacatgggatgtgaattgtaagtaaagtgtatcctccctgattttcttcaacatgttgcaccaaactatataaggcctgcatcttcttccctaactttggatgcatctcttgaatttgccataaaaactgtacctcttgcccttagtttgagggaactgtctgccccactattggttctttatgtctcagcatgcccagaaacccatcaataaggtaatgaatagtgagaacgacctaaacggttgcacctaaattagcattttccaggaaaatgttttgaactcagagattgttcatgtta

SEQ ID NO: 18973 - DNA, 5075 bp, Oryza sativa
  unsure (1)..(5075): unsure at all n locations
accccctaaattagcattttccaggaagatgttttgaactcagagattgttcatgttaaattcaagaactatgaactgcaaagacaaactattggtctacatcttaattaggcaacaatttttccaactaaccatacataacaggggtacagaccacaagcacatgctactgaaacatgttcaatcatagaactacagttctccaaaaacagaatgagcatcaactacagccagcataactgtttggcatgttgccacttaatgatgaatattggcagttcatataccatcatttcaacataaaccaaacgagacatttcagataatccactgggctgctgccatggaaagataacagaactcatttaaacaagatttgacagtaacaaaaagaggtcaggtccaaagtggttttcttttgcttatcttttaaggtaaagaaactactaaagaatctgcaggtttgctcatgccgcaaaagtacaacactcttcaaaagaaaggtacaaagggaatttttcctccgtggtgcactatgtaagaaaaaaaaaagggtaacttttattctttcctaaccaaaaagaatatatatttgcagaaacaaactcgagtgggaggcaggcactactgatgcacttagcttctgatgaatatgtcacaacaaaatattttccttcttgactatatgcaacttgagtccctaccgaagataaagcgacggctccagtcagagatcaccagtgccctcgtgcgccagcttatttgtttactgaattcagagaaaaaagagcattagacaccagcatagatgaaccaaaatgggggcacaggagtgatagcaacataacctttgtcactctgaaatggaagagaacacttacgttgcgtagacagaataccagagccactgtgtgctgtggccaatggagatccaatcaccagggagctgtgcagcagtctgctcacctcctagtggggcaaattggcctaaatgcctgtacctggatgaatcagcaaagctatcgtatcagatgcctgtgaaaaggaacttctagaattatgcagacatggacagattaacgcggagcgcaatctactgctacatacttctgtctttgggtttgggaagcttactgttcaatgacacttttagttgggtaattataacaggcattgtgtttcattcaactggtttctggataatgtcaaatggtaatacttctagcagcataataagcagagaataggaacctgaaagggcggaaacgatggcgtccttctccccttatacggatggggccttcagggttttcttcagcatccttcatcttattgaagcacctagccaaatattgtccctgctgtgaagcaacctgacaaaaaaaacagactagttaacacttggcagtgatgcacttccatgaattttcgctttgaaactgtcaaaccagtgaaaattccaaggaggaatagaaagcgacctgagcagttgcaggcagatttttgacttgcgaatcaacaagagaaagagctttcttaaattcttcaatgttcagttctacagattccttttcagcatcacctttggcagtccttactaaatcagcgattccattcatttgcctgctcttcagatagagctctacctggggatatctcacgtagatatcatccaagacatcttggatttctttcactgtcaaggttccagagttatctttatctgctactctgaatatttccgagatatcatcctgcattacagatcaagaatataaagccatatatattgacataacagaaacaaaatcttttacattcatcgacttatagcttgtattgcaggaacaaaggatagttgaaacaccccctcactcaaaggtaatttgtcaatgcaggtatactgcttccattatatgctagtacaagtcaaatgagctaccatttccactaccacttaataaaatccaggagcattccaagttagcaaagatagatgacaggagtctcaaggaagctaaaaaacaatgtcaagtatgcaagaagatgaacagaaaagaagtcttatcttcatagaagaacgtacacaaagatcaagtcccattacttaccattactctccgctggtttatcgtagcacaatctcctacagcataaacaccatcacattcacggacccttagccattcatcagtggctagtacacgccgtttgccctgcaaatgtagacggagaattagatggataactcagctagctacaaagagtcgagctgagtttcttgctaggtacctgcccaatttgtttcatgaactctgaaatgaagggccgggtaccaataccagtggaccaaacagccattccataaggaaccgcgatatctccagtggctggattttgcatggtaattgcatccttagcaaccttcacaactttgtatccagttttcacatcaatgccatcccttccaaacttatcctcagcaaattcagtaatcctcttgtcaaacctataggaagcacatgtaatcaaagttaaatttacaagggagggtaagcttgcgttgccgcatccttccatcatagctaatcatggtaatgagaaaaaggtgaatcactagtcataacttcatatgaatcaaatgcaacagaaatccagtatggccttacatagtcagtatgtgatctgcagcttcaatcagtgatatcttgacaaggtgctgaatagaaggatacagcttggatagatcttcggtaacaaaatcgtgcaactctgcggcaaattccacgcctgtaggtccaccacctacaacaacaaagtgaaggttcttcttcctctcttcttcatccaggtaaggaagacttgctctctcgaagcagtccatcacattccttcggatcttttgggcatcctctacttcctgtgattcagtaatgacagtatgaacatagaatgtatgattatagcacagaaacaatgaaaatgtagtatatgaattttttattttaaaaaataatataaacttttccgtttgaaaataagtgcaaattgtgtatattacacaatggagcacttatatgagtcatattctatgtcagatatccgtacaccaataccgggtagtgatgaatttcatagtacaagtaagtcatttcatttcatagtgcaagcttaccttcaaaaagaagcaattctcctcaacacctggagtgttaaatgtattagacctagctccaactgctatcacaagatagtcgtagtcaaccaagaattcgccatttccatcaagatttgtccctatattggaccggcaatggatcttcttgtttgatgaatcaatcttaaagcattctgcttcccagaatttgatatctccacctttctgcaagggaattccagaaaacaatgttaatgcattttgctcagaattaaccatctagttgagcttccctacgaaatcaaaacttagtgcatgtaagaaacttaagctagttttttagaggtcaagaaattcattaaaccattgaaaaacagaccagtctgtttctcagtgtattaacaggttgttaaaaatgggaataaacaagtattatattgctttgatacgcaaagccatcaactctacattaagcccaaataacaaataagttgtccaaattgctctgataaagacaaggcggtgacagaagtataaatatagaaaaaaacagagcaatctgtggaaatttctgagaatcatcataccttctccaaaatcctacgaatcggctcaacaacgctccttggctcaactgtcccacaagtgacacttgggagcaggggcgtgaatgcgaaataattccgaggtgaaatgacctgaacatcatacagtctgctgtcaagattcctcaggaacgtggtgccaccccaaccggtgccaagaacaacgattttcttctttggaggtccctggggcttcccaacaacatcatctgaattggaatccgcatatgctactagtcctccactactgcaaatttgataagcaacagatgagcaacatgcttagaaacatatgacaatgcaaaaatatttaagagttcacataattcttcattgtaaactagtctgaatgcatcatatggacgcatagatcagctcaagaacccaatcatccaacagtgacgtttccaaacattcacacgtctccttctacaaatagcttggaatgtccctatttacaaaccccgttaacatcagtaggcataattactgcgatggactagtcggatcaggagttgaatttcttcttgctctcgcatcttctcaaatagataggcatattgcctaacaaaatatataaagttattcaagaatttgatgagaaaatgcagtaaccaaatgttactgtcaaaacagttaggcaagaaaggtctagttgtgatttgtgaaagaaacggaacttcgcaagttcagaaatgaatggcaattatgcacatggcaccgacttctcacctacctttgtactaaccatcatgtgttgtgttcacgttcttgttagtagtagtattaaattaaacttttgaatatcataagtacaagagatctcaaagcacagctggactttttttttaaaaaaaaagatgagaagaaaaatgcttatagaatggagagatggatggaggaggagaatttttcttgttgatctcatggaccacgaatatatggtggaatattcatgtgtggacacgtcggcgccaacgatgtggccatgtggcgaaggaggagcaaatctctcggggggttctttttttccccttcccttttccttttctgttctcttgtgacatccggaattaatttcacaatacaagaaaactaatcttttttaaataaataaataaaatgctaaatatatacggagtggaatggaaaaaaaatggtgaggtaaaaaagaaatccttgctctagatatgaagagttaaaatcagagttgatgtcgagcagataaattggtaagctgagaggagaaacgatgcgatnnnnnnnnnnnnnnnnnnnnnnnnnnnnnnnnnnnnnnnnnnnnnnnnnnnnnn

SEQ ID NO: 18974 - DNA, 1551 bp, Oryza sativa
  unsure (1)..(1551): unsure at all n locations
nnnnnnnnnnnnnnnnnnnnnnnnnnnnnnnnnnnnnnnnnnnnnnnnnnnnnnnnnaacgagtggtgggccacggccggagctgagggcggagcagctacgggccgcgggaagctcctctcctccagccggtcagcgccccgcgcccctccgttcatggccgcgacttctcccccgccggccggccgctccgtccctctgctccggccacgatgcaccgccggtcctcttctccacgggcgccgaccagccgctccgcccacaagttgtgggccacaacacgccgccgctccggccaccgacccgccgctgcccgcctcgcttcgcctctcgcctccgccctctgctctgccgctgctccagccgccgcccaccccgctccgccggttggagagagagatgagggtagtgaggatgacgtgtgggccccaccactttttattatttttgtaaaactaacatgtgggtcccacaggttttattattttttttgggatcggattgccacgtaggtgccacgttggatgaagacctactcaaatgagcgcctcgtaggcgccaagtcagccaaaactagcgactatactgccgagcgaccttgtttgcatggtttcttaagttggaggatgcgttgtatccggttttgtactgtagggatgaaaatcgaactgagcgacaaatagagggacctgaagtgaacttattcctttttgttttgcaaggacaaataacgtagcctgggccatgttgagaaaagcccttccatgggatcagaccccacaccattatttaaactgggcccaatttacatttatgggccataggcccgtagcctctcaaaaaggtccaacgtgatatgggctggttgaccatctcggctggaccatatcgcgtttgatgcctaaacttttaaatgtttatctgtgaccgcactggggagcgacatcttgaacattaattagttccaagcttaattgtatccatttcaataactatgtcctctcggccattatttataaattcaaaaaaaacacttttaccataatggaataaagaaggaatttataaaaactaggcagacatgtcatactcacccccctttgctcaatacatattacgtggcaatgcataattagctgccatggacgttgacagatatattaatgattctttttaaaggaaatatcgatcattctttctacaatatgcacaatcagccagctagagtatttgtgtactcgattaataataattaatctcttgtttgcttgtactcgcatgctattttctcactcggccattattttacccacgttcgccaattattatcaccgaatactgtttatatttaatatttaagctttgactcttcttttttaaaaaaaaagatatcgtgcataaacatttgaaaatatgttaaattattgaagcgtgttgtatcctgaaatataaaaattaagatttcgttaataagctttctttaatattaaatattagtataatcatttaaaaattattagccgtggaagttaaaaccatactttaccagac

SEQ ID NO: 18975 - DNA, 1370 bp, Oryza sativa
cagcagctgacgggatcagctaggcccgggtggccgattgtaaagttgttggcccgggtggccgtttgaaaagctgttggccgggtgccaatcttgtttcaattctaaagactgatacattgcacatactccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaagagatggtatcagagcacaggcttggccctagggcgaaacccgacgtttaggacgaccctaaggatactaagttcaaaactgcttgcgaaaagctaaggcttcttttggtttccttattttcaatagtttgtttctaaaatggttactgatccttctccctctttcaaaattgtagatggcagtgaactccagcttcagttcccacggttttggtgagggtcaccacgtcgctcagcttcgtgacctcgcccgtttcctcggtttctcgtgtcccgagtacacggggtactccgtggaccgtgttccccctcactgtgagctctctgtgtacctttacccccgtggaggtatacacggagccggccttcgcccacaccacttcaccgtggccaggcccactctccagatcgcgtaccaggacctctcctggactgcgcttcgtcgcctggcccacgactacagccaccgtctcggaggctccgccttccggcagcttccacgccttccttctggccactcagacgccaggtacccttgtccgtacagcgagtctcagccagtgctgactcgcatggttgagctttcggaggctcaggccactcagcacgacctactccttgaggcttaccgctcccttgcccgccgctacgccgctttggaggcccgtctggccgaggagggtgtcacctcagttgacactat

SEQ ID NO: 18976 - DNA, 5038 bp, Oryza sativa
  unsure (1)..(5038): unsure at all n locations
agtgtgtgctatctgagttgctatttactttgctacttgccctcctaagggcttatctaactcttaccccgccctcttctgggagtttagatggctagccgcccccgccgtgcagctcgtgcaccagcccgctttggttttgaagatggtagagccgagccagaagcaaatcatgagtcagctaatgagcagtctcaccacagcaaccgttcacaccgtactgtttcccgcaacgcagaagttgagcaaccccgccacagcaaccgctcgcatcgtacagcttcccgtgatacgaagatggaatagtctcaccgctctcaccacactgccagtcacaattctggagaagaacgcctcccttccccacctcatgtggaaaacaacatgcaacacttaatggcagttcagacacaaatcttgcaaggattagccgcagccatagccggttttcagcataatacgcatggaaatggccaccctcacatgagcaacaatagatccaagctgacagactttctgaggtctcgtccgccagagttctctcagaccgtcgagcccgtcgaggctgacgattggctgaaagatgtggatagaaaactcaacttagtgcagtgtactcctgttgagaagacgctctacgcctctcaccagctaagaggacccgctgcagattggtgggagaattactgcaatgcacaccctgaacccactaacattgcttgggatgagtttgctacggctttccgtgcagctcatatgcctgaaagcactattgacatgaagaaagaagaattcaacagacttaagcaaggcaacagcagtgtcaatgagtacctaagtatgttcaacaagttggctcggtacgcccctgaggaagtggacacagacaagaagaagatcaggaaatttttgaaggggatcgcagttggaatgagactccagttgcttgctcatgactttcccacctttcaacatatgatcaacaaggcacttttacttgaggatgccagaaaagaggctatcgaagaatacaagaaacgcaagtctaaccatcagggaaattcttcccgaggcgcacctcgccctcgctacggtcagcccatgcaatatcaccagtcggtaactcaggctaaccgccagccaggctacgcccctcgtcctcagatgaaccatccggcacctcagccacagcagcgtgcccctagtggcaatactgcgccaaacagtgttacctcttttaagtcaccacagggaccgtcagcagttcagtgcttccggtgcaaccagatgggtcactatgccagacagtgtcctcagaatcctaccaacaccaactcagtacatgctaatggcagcactgccagaactcctactccagcgacagctcagtctcgtcccagctctcaggcaagtggacaaggttcacgtgcttccaaccactttggtcgaggacgtgtgaaccatattcaagctgaaaccgctcaggatgctccagacgttgtgatgggtatgttctctgtcaactccgtacccgcaatagttctgtttgattcaggagcttcccattctttcatatcacaagcttttgtgaaaagaaatggttggaaaacccaaaatttacgtgtaccaatgatagtacattcccctggaaggaatataagggcaactcaaatatgcccggaagttaaccttaaaattgaggaagttgacttcctagccaaaccgatagtcctagactcgcaaagcttggacatcatcctaggtatggattggttggctaagcacaaaggacagatagattgtgccgaaaagtccatcaccttgcaaggacctggaggaaagcaagtccgctttacccctaacacccctaccgcaagtcggtctatcctaacctgtttacaagtcacctccttggagtcggtgcccatagtctgtgaatatcccgacgtattcccagaagaattaacgagtatgccaccagaccgagagattgagttcgctatagaactggcaccaggcacggctccaattgcaaaaaggccctaccgaatggcagctaatgagttagcagaagttaaaagacaaatcgaagagttggagagtaaaggttatgtgcgacctagctcatccccttggggagccccagtgcttctggttaagaaaaaggatggctctgagagaatggtaattgactatagagccctgaatgaagtaactataaagaacaagtacccgttgccacggattgacgatttattcgatcaacttaaaggagcaagagttttctcaaaaattgacttgaggtcaggttaccaccaactgaaaatcagatctgaagatatcccgaagaccgctttctcaacgcgttatggtctatatgagttcacagtaatgtccttcggactcaccaatgctccagcattcttcatgaacttaatgaacaaaatctttatggaatacctggaccagtttgtcgtggtgttcatcgatgacatcctgatatactccaagaatgaggaagaacacgctgaacacctaaggctgataatggaaaagctcagagatcatcaactattcgctaaattctcgaaatgcaaattctggttagatcgagtagcatttcttggacacgtgatctcctcccacggtgtcgaagtagatcccagcaaggttgaagctgtacttgcttggaacccgcccaagaatgtgtcagagattcgcagcttcctaggcttagctggatattatcgaagattcattgaagtattctctaagctagccagacctatgaccgagctgttaaagaaggaaaataaatttcactggtctgcatcctgtgaagacagctttcaagaaatgaagaaaaggttgaccactgccccagttctcaccttgccagatatccgaaaagatttcgagatcttctgtgatgcatcaagacaaggcttaggatgtgtcctaatgcaagaacgaaaggttgtggcctatgcatccaggcagctcaggcctcatgaagtcaattatcccacccatgatctcgagttggcagccgtggtgcatgcccttaagatctggaggcactatttaatcgggaacagatgtgaagtatacaccgatcacaaaagtcttaagtatatcttcacacagaccgagttaaacatgagacagagaagatggttggaactaatcaaggattacgatcttggaatccattatcatcctggtaaagccaacgtggtcgctgatgcgctaagtcgcaaggcctattgcaatgtagctcaaatacggcctgaccatgatcacctgtgcagagaattggagaagttaaggctgaccgtggtacagtcaggtgtccctgccagcttgacagtacagcctaccctagagtcgcaaatccgggaggctcagaaagacaacgaagggataaaagaattaataaaaaggaatacaggagaagaaagacaccaatttctccatagacgatcaaggcacagtttggtgcggtccacgcatctgtgtaccggccaagaaggagttaagagatctcatcctaaaggaagctcatgagtccgcctactccattcatccaggaagtacgaagatgtaccaagatatcaaggcatacttctggtgggctggaatgaagcgagatgtcgcagaatacgtagccttgtgtgacatttgccaaagagtcaaggcagagcatcagaggccagctggtctgctgcaacccctaccgattcccgagtggaaatgggaagagatcggaatggatttcatcaccggtttgccaagaacccctaacgggtacgactccatctgggtaatcgtggatcgactcacgaaatcagctcatttcgtgccagtgaaaaccacctttgatggaaagaaactagcagaactctacatgacccatgtcgtgtgtagatttggctgtcccaagaaaattgtgtcggaccgaggcactcagttcacctcaaggttctggaagcagttgcatgaagccctcggaactgatctaaaatttagtacagcctaccatccgcagaccgatggtcagaccgaaagggtaaaccaaatcctagaagacatgctacgagcgtgtgccttggatttcgaaggcacttgggatcgttgtttgccgtacgcggagttctcatacaacaacagttaccaggctagtattcagatgtcgccgaatgaggcaatgttcggaagaaagtgccgcactcccttgtgctggaatgaggtgggcgaagcactggtattcggtcctgacatactcaagtcagcagaagaataagttaagctaatccgaaaacgtttaaagacagcgcagaaccgtcagaaaagttacgctgaaaatcgaaggcgtgaccttgagttcgaaaaaggagatcatgtgtacctgcgagtatcacccctccgtggtgtgagaaggtttgggatgtccggctagttagcaccccgctacatcggcccctacctcataaccgccagacgtggcgaagtggcttatcagcttgagttacctgaaggtctcgcagatgtgcataacgtgttccacgtatcccagctaaagaaatgtcttcgagttccagaagagcaagtccccctgggtaatatcgaactggaaaagaatctgacctacaaggaaagaccgatcaaggttcttgaagaggcagaacgtcagactcgaaggaagaccatcaagttctacaaagtccaatggagcaatcattttgaagacgaggcaacctgggagcgagaagatcttctccgcgccgagttcccggagctgctcccttaggtgctgaatctcagggtcgagattcttgttaggggggttggtctgtagtgcccattccgtcgtggcgcctagcgggaaaattatctcttaaaaaccctaattacgaaatttgcttctttgcttattgtctagtgtccgtgccatctcaagatctcaatccccgatctatcgtcgagttcaattccgaatnnnnnnnnnnnnnnnnnnnnnnnnnnnnnnnnnnnnnnn

SEQ ID NO: 18977 - DNA, 689 bp, Oryza sativa
gacggcgtggtgtcaaataggctgggcagcgacaaggcggtggcgaggatgttcaaccggctggcgaaaaacgcagtgctggaccggcggagcccgctacgcggcgtgcaggggcaggtgaacgaccaccgggagaacgcgtggaacgagtggtgggccacggccggagctgagggcggagcagctacgggccgcgggaagctcctctcctccagccggtcagcgccccgcgcccctccgttcatggccgcgacttctcccccgccggccggccgctccgtccctctgctccggccacgatgcaccgccggtcctcttctccacgggcgccgaccagccgctccgcccacaagttgtgggccacaacacgccgccgctccggccaccgacccgccgctgcccgcctcgcttcgcctctcgcctccgccctctgctctgccgctgctccagccgccgcccaccccgctccgccggttggagagagagatgagggtagtgaggatgacgtgtgggccccaccactttttattatttttgtaaaactaacatgtgggtcccacaggttttattattttttttgggatcggattggcacgtaggtgccacgttggatgaagacctactcaaatgagcgcctcgtaggcgccaagtcagccaaaactagcgactttcctgcgagcgaccttgtt

SEQ ID NO: 18978 - DNA, 675 bp, Oryza sativa
  unsure (1)..(675): unsure at all n locations
nnnnnnnnnnnnnnnnnnnnnnnnnnnnnnnnnnnnnnnnnnnnnnnnnnnnnnntttctccccctccttttccccttttcctcctcgccggcgtcatcctccctgtcgccgctttggccgcgaccgccgagcgccagctcgcgaccttgaccgcgcaagtcggttcccaaaccgacattgccgcccatttaaaccccagcctcccctttcccttcctctcccattcgtctccgcgccattgccgccgcccccgtgctcagtctcgcctccgccgtccttcgccgagcgccgggagagccggtgcgttcgaggacgcggaaggggacttcggccgcgccctcttcttcctcttccccggcccgaggccggagagattactcccgcgccgtcggcctcttgtcacaacgcccctcctcatcacggtagtgcctccctccgttcttcctcctcgcttcatcttccccccttagatttcggtagtagctcgagtagcctccccgtagttagccggcgccgccccgaccgtgccgtcgctcgctgtgtgctcgctgccgtcgccgctcgagctccgtagcacccgcacgttgccagcctcgctcggcgtagctccgtccaatccgacgctagcgtcgagttcccgaagccgcgtagatgctcttaccgcgggaatcgac

SEQ ID NO: 18979 - DNA, 575 bp, Oryza sativa
tatagggcgaattcgagctcggtaccccgtcccaaaatataagcatttttagcttccaatctagacaactgtttgtctagattcatagccaaaaattactatattttgtgacggagttagtagccaaaaattaaagttcaatatttaatttggattttgaaattgtttttttttcatcgtagtaattgcttgataagcataaacataaacagcgaaacgttgcacatcacatgaagagaaaacaattcatgataagcatatactctcttcgtctaagaaaaaacttaacgtagaagtaggaggacgaatttgaactcctacgagagtcacatcctcttctaggttgaattttttctcaatggaaaaacgaaaaaacctcactgacttcctcgaatgaaccacggctggcggaccatgtatcgttccaggaattgcgatacgcgatatagtcccagttggattcatcgtcgtcctgcgaccgcatcatctcttcgtatgctttgtcctgctactcgatgttctttcttaccctcgacttccattcctgccgggtctctatcctcatgggtctcgac

SEQ ID NO: 18980 - DNA, 1330 bp, Oryza sativa
gaaagaaataaaccactgttcatggtgtggcaacattttcttgctattatggcgtgactggaaggttcctttttttaaaaaagaataaatttgtgagagttgattttaaaattttgaatttataaaagtctgaaaaataagaaaaattctcatccagacatgtaagtacgtacttattatcacagcaagttaagatatattgctcgttctcaaaaaaaaagtcagatattgccgcatatatttgcacttcatgcatgttcagatcatcagatggtggtgtcaagccacagggaattaagctagcttggtgttagactgttatatagtccctctgtctctaaatatttaacgccgttgactttttaaaacatgttcgaccgttcgtcttattcagaaatttttgttgaaatgtgtaaaactatatgtatacataaaagtatatttaacaaagaatcaaatgataggaaaagaattaataattatttaaatttttttgaataagacgaacgttcaaacatgtgtaaaaaagtcaacggcttcaaatatttagggaaagagggagtatattaagtgtggttggtattatctaaataagaaaataagtgtggttggtgaggaaaaaaaactgtgtagtcggattatggtccagggatgtactacgtgcacaattcgcctcttctcagagagaaaacgacgtctgaattacgcatgcacattgattaattaaacgaccggtcgtctcgtctctctcacaccccccggccagccggctaccatttctaaaacgtggaaaagtatatctattctgctaattaacaagctagctacttcaattataacacatgttttgtgtgcatgctgatatgatgatcaataaatcaattgattgattattacaacgcggtatacgtactggcctgcatgggaacatatacagcagctgatcgatatcgatcgtcgcatagttttcgatcagtttttaactgtgcaaaacttaagttaagctgtacttttttttctgtgtggttattattattattatttttgtaaatgtgcatacttaattaattactgtacgtatactatatcgatcgtagcaaaagttaattactgtacgtatccggcggcggctaagggctggctgctagctaggtcgttcgtctcatcgactgatataaacgtacgtacgtacggtgaaattataaatttggattgatccatgacgacgatgactttttggttgctgtgaggaataatattctatctatacgtatgcatacgtacatgcatacatagcactgttcctatcgaagagcgctcagcccggcag

SEQ ID NO: 18981 - DNA, 5504 bp, Oryza sativa
  unsure (1)..(5504): unsure at all n locations
nnnnnnnnnnnnnnnnnnnnnnnnnnnnnnnnnnnnnnnnnnnnntattctgctaattaacaagctagctacttcaattataacacatgttttgtgtgcatgctgatatgatgatcaataaatcaattgattgattattacaacgcggtatacgtactggcctgcatgggaacatatacagcagctgatcgatatcgatcgtcgcatagttttcgatcagtttttaactgtgcaaaacttaagttaagctgtacttttttttctgtgtggttattattattattatttttgtaaatgtgcatacttaattaattactgtacgtatactatatcgatcgtagcaaaagttaattactgtacgtatccggcggcggctaagggctggctgctagctaggtcgttcgtctcatcgactgatataaacgtacgtacgtacggtgaaattataaatttggattgatccatgacgacgatgactttttggttgctgtgaggaataatattctatctatacgtatgcatacgtacatgcatacatagcactgttccctatcgaagagcgctcaggcccggcagctaacacgtaacgtaaaagcacaccgtcaatcagtttgttgcatgcatgtatatacaataatgtaaattatatactcccctccgttccgtttcatattataagtcgtttaacattttttctaaataaatttctttgagtttgaccaaatttacagaaaaatatagtagtattttcaacacaaaataaacatattaagagctcccctaccgtcgccctactgtcgcgctactgctccaccgccctactccctcgagctcccctgccgccgccgcgctgctgtcgcggctgccaccgccgcgctctgcgacgtgcttcatggcggtctcccagtgggtcccggtgggccactgccgccgctccagcccccatccgccgccgccgctgctctggcccctgtccggcaccgccgacaacccgacccttgcccgtcgccgatgctcccgtgaagagaaacgggggagaaagagatgatggagagagagagggaggaggaagatatggccctgccgccgccctgaccgccatcgaccactccctcgaccaccgccgtcgccgccctagtgtcacctgcctgtcgctgccgcttgccctagtgtcgcctacctgcctcccttgactccctcgatcgccgccgcttgtgaagggaagagaaagagggagaggatgacatgtgggcggccccacatgtcagtgggtcctacaatatatttttgtgtgtgaatgacaaatggatcccacataattttttttatttctaatgccacctaagcaccacgtcgatcaatgccatgtggaaagaagaccgagtcaatactaccatgtagacgccacgtcagcgaaaccgtcctccaaaaccatctagctagggagttaaattgcaccggttttaagagttgtggtgtcgagatatccggttttgtagtttagggtcatggattatatttcaatcacttttgagtgtcacaaagtgaacttattccaattatatgtgctacccaaatttgggtacagtttcccatctaaatatatattaattacttcaaacgatcttatacatgcagacaaagtatcacgtacctgccaagcatagaagccttggagaataacatgggaatatacggggaaatatagagaagataataaattaaagagatcaatttctatactggacagtttaattagggtgtaaaataaagtaaaacccagaaccggcatacacaattttctaggcaattgtcaagctagttgaattgaccgtctaaataatttcttcatccagccatttcgttccgttgaagcctttatacgtccattcttgtgagtgcgtcatacatacgtacatgcatgcatctaaaatttgcagtcaagtctacctatatctaattaagcttgcaaactttagtttccgcggcgcaaagtgcaaacgatattatattatcaatctgattaactaattaactatctccgtttcacaatgtaacactttctagcattatccacatttatatatatgctaatgaatctagaaagtcttacattgtgaaacggagggagtaattaaataattaatagtactctcctccatcccacgaaatagcaatttagtacccgatgttaacccatcataatactacaaatttagacatagattattctgtccagattcatatactccatccggccgtctaaaaaaacctagcatgtctagatttatttattgtattagattatatcccatccaagtttcagttgtggttttttttttttttgaacgatataagtttcagttggggatttttttttttaaacggatggagtacgtatcaatccaattgaccagtaggaacgcgtgcacggcagcatcagatcaggattctgtttctccatcgatcataatcgatcaggtgcacgcgtcaaaccggagccgcacgggtgtttcggttgcaatgttttttcaattttctgcagtgaaattttcggcttgttcagttgaccggcaatagctagcaatcgtactgtctacgggaagatccaacaaataaaacgtttgcgtttacccggcatttatgcgcatatattgtgattcacgcatgtgcatatatgtatcagcgtatgcatgtgcttatatgtcaagctagctagaattaatagtctataatttcttcaacgatatgttttttgcttttcattttgtaggtattgtatatattgcggaatataatgcacaattctagaaacggaattttgggaagttctataaatttcggaccgaattgaactaagttaaaatttgaacaaattttggttaaatttgaataaaattaattttattaattgaaaaagtgtatgtttctatcgaaataatatcctaccaggggagatccatggacccgtaattattaattgtaccaatggcgccatagacaatatcaaattattaattgtacaaaaacattggctaattctatcataaagcacatgcatcttcattttgtcatatactcctggtcgtcaaagttagataaatttagcttataacaaaactaaaatactttagaataccggacgagtatcatatagtataatatataccatcggttgggcaatgtcatgataattgaatgaaatcatcagttcgtcactagttatatacgtgttactggtgtaatgttcagtttatgcaggaaacctattgggcgggatgttgcttggtcagctagcatatactagtatataacaataacgaccataacaatattataattccaacatgtcaggaatcgagacattagtttcatttgacaagtagtagtatattaatttacgcgttacgatggatactacgtacccccgtcccaaaataagtgcagtcgtgaggaaccgtgtccagcgtttgaccgtttgtcttatttgaaaaatttataaaaaaaattaaaaaaatagacacccataaagtattattcatgttttatcatctaataataataaaaatactaatcacaaaaaaatttcaaataaaacgaacggtcaaacgttggacataaatagcgcaaaactatacttattttaggatggagggagtaattaactagtacagtggacacatgtttattacaatatgatctcgtctcaaggatgacaaaaggaaaaaaaagaacagaataaggcgacttgctaattaaacagaagctaacagtaaccaagctttcagtaagaggttcaatctgtcagcaaatttctgagctgttaggaagatttcatctgtcggtaaaaggtgatccatgcatgtaaatgccgtcactttatatgtcggctaatgatttgcaaagtcttcaatggcctctagcgcactcagtgaagaaattacatatcatgagcaaattaagatgcactaactgagtccttgtatggggctttggacgacggataggattgtttggggaaatccactacgtgcaataatgtgctagcctgcaacattcatcgatggttgcaaaatcctccatttacaatttgcattgcatagtaattttttgacatgatggactgacggactgtgcaatagctaacaactcatagagtctaaacatatttttcccgtgagctaagtgcctgtcaggaatataatctatattcgtcggtgaaaccgagaccgttggattaaaaagagtttgcacgcgacagcaacaccaggacttgtcacaacatttcaggtacatatacatacgtatatatctgcaaattaaataagaggaagaaaaataagaagcaaaaaagatgatacaagtttattaatttcattttctggacccagtcaagtcgccgtgcagacaggaggagagtatacttttcgattcagaggaggtctccaaaactcgtcatgcaatatgaaaaaaaatgccgtttgttgttttactgcttcttggtcatacctaccaacaaatgcaaggtcgatgttgatgatcctagtataactgaaaacgacgacgacttctgccatgaaatgccgtacactttctgctacctttgttcagcttctctctctctagaactgtttacgcaagctaatctgtacgtaaactagctatagaatagaatgacgcatgtgttgaacttggttggtgaatatgaactctagcttttcggctagctttcctctctctcttgatcgatctgtttgagtaattaattaaagcatataggagtatatagtatatggtatagtacatgaaactggtaatggaatgaccaatatgtctggaactgaacgttaattatatattgtcttgacttttgaccgggcattcattcacgcgcaaagataaaaaaggtaaaaaatctcttgcgactttgccttctagctaccaacctagaatagcttatgaatatatagtaatttcgatttgatcgggttaattaatttaattttgtcctggtagaacatattcctcaagctaaccatacattttattacctccccgttctatacttgtgggtcgatgtgttgtctggtaaagtatggttttaacttccacggctaataatttttaaatgattatactaatatttaatattaaagaaagcttattaacgaaatcttaatttttatatttcaggatacaacacgcttcaataatttaacatattttcaaatgtttatgcacgatatctttttttttaaaaaagaagagtcaaagcttaaatattaaatataaacagtattcggtgataataattggcgaacgtgggtaaaataatggccgagtgagaaaatagcatgcgagtacaagcaaacaagagattaattattattaatcgagtacacaaatactctagctggctgattgtgcatattgtagaaagaatgatcgatannnnnnnnnnnnnnnnnnnnnnnnnnnnnnnnnnnnnnnnnnnnnnnnnnnnn

SEQ ID NO: 18982 - DNA, 2222 bp, Oryza sativa
ccggtgctcggcggaggcggtggcagcgtcccgtggaggaggctccggtggcagacgtcaatcgggtgtagcgccagggcgtcgccggtgatcagaggtgggtctcgcgtcatcgacacgaatcagagcaccatgtcgttgatgacatcatccgtctgtccatcacacggatcaaatcaaatcggttcttcgatgattcttgatttcttgattgattggtcgattccgcgatgtacctaacgctttgtgcgggccgcgaacgacggcgacgaggcgccgtcctactcgtagcccgctccggccactgcccaacctgctccgccggccggccgctgcgccccgctcgtagcccgctccagccgctgctcaacctcctcctatcggcttcgcgcgtcgccgccgcttggctccgccggccgccgccgttccgccctcctgccggcgagcttcgcccgccgtcgcctcgcctgtccgccttgctctgcgagttggcatgtgtttagagagaggatagagataatagatgaggccaattgtgactgtgggccccaccattttttattatttatgtaactgacatgtgggtcccacgggtttgattttttatatcaaattgtcacgtcaatgccacattgaacgaagacctagtcaaagaagcgccacataggcgccacgtcaaccaaatccagcgactataccgccaagggacattctttgcacggttttgtaagttgggggatgcgttgtatccggttttgtgctgcagggatgaaaatcagactgggcgccaaatagagggacctaaagtgaacttattccaaggaaaaagtacacaagatccctcaccggagtttgctaattcgcgcatacgcgccgcaggcacgcactccggcccacccggcccacgcgcgacacgcgcgccgtcgcccaccaacaatttttttttggtttttggtgtttttttccccattgctttttccctttttcgcttttttttcctgcgccgtgggaagtcgaatcaccatgaatatttttttttgtgattttctaaataatatgcgcacgattttatttttcgtgattttttcacatgttttgttgtgaattttttaaaccacatgcgcacgtttcaatcaaaagtttttaaaattttaataaaaagtttttgaattataagtttgaaagtttttataatttaagttgtatgattttaattttgagatgaaagttttcaaatacgagttaaaagtttcaaatctttagtcgaaagtttttaaatttgagttgaaagtttttaaattttgaattgaaaattttaaactttcaacactaatttaaaaactttcaactctaaatttaaatttttaactcagattgaaactattcaaattaaaaatttgaaaaaaaaataaaatcaaaaattaaaaactttcaacacaattttgaaaactttcatttcaaaatttgaaaactttgaactcaaatttgaaaactttcatctcaaaatttaaaaactttcaactcaaatttgaaaactttcatcttaaatctgaaaactttcaactcaaaatttgaaaactttcaatccaaaattcaaaaactttcaattgaaaaataaaaagctttcaactcaaatttaaaattttcaactattctttttaaaacttttaactaaatatttatgttttttaaatatttattgctaattaccataattagccctaatttactataattagtattgattaggtaattagcctagaaggaagcggccgcgtgcgcgctgcttctgtggctcggcgcgcacgcgccgagtaggaacaccctccctcatcttatcatccagttacgaaattgtcccctaaccacaaaaccagatatattatatccttcaacttacaaaaccgttcactttaggtctttcggtgattttgatcctagttttgtctaacgtgacagctgagtcagcgtgaggcccacgtatcatgatgccacgtcatcaccctctcccttcttcttctctctttctcacacacttttctcctctaggcaagctggccggcggatggggaggaggtcaccaggggtgaggccggagaggaggaagtcccgctgtccgcgacgaggtggcggtggctgcaacgcgggagcagggcgctttgccttggtcggatgtccgggcgaagactactgcggcggggcgaccggaggatcgaggaccc

SEQ ID NO: 18983 - DNA, 4330 bp, Oryza sativa
atgcttgcagtcctttctccaattaattatgccttcgtcatcatgttcgaggaactgagcaaccacggcatgtgctcggctccaatgccgccattgccgcggccggctgctgcatgctcccggatcgatgccgatggcgtcttggtgcagctcgtcggagttcatcggctggaagataagaaaggaggaatgaagacggagagggaggagggccggcgagctcgcccactccgcccgacgctgtgtgggtgtggcgaggagaaagcaggagatcaggaaggagaaaggtggaaggagaggaggatgacatgtaggctccacatggggccatcaattttttttgtattttttttatcaattttagtgtgacgagataaattgaaagtataggtttcccaaatacaatttgcttttttatccatgcctagcaaagttttaatttggatgcaaactattgacattgtttttaatattgcatgatgtgcaacaacatagagaattaaatttgaaaatatactattcatcaattttttttcttaagaatagtcgggatgcaaaactttttacaaaaatataaactgttgcgtgaaaataatgtgtgcgtaacgttgcgggcggtgtcgcaccagggaagcggtctcgcggagcgagaccgaacggtctcgcaaaatcaaatagcgagactgtctaacagctcaatttaattagtgattaattacttaattaacaattaactaataataatttagtattaataataatttagtaattaattattatgattactgattaattaatcactaatcatgataattaatcgctaattaaattggcattgaatggctcatgcatgagcgagagcgctatccgcgagaccgcgcggtctcacgctgctgccgagcaagaccgtgcggtctcgcgctttttccgcgtgataccgtccgtgacgtcattctcatatcactttcacgtaacggttgtgcgagaccgacgatatatttctgtaaaaaattttgcatcccgaatatttctgagaaaaaattgaatgaatagtatattttcaaatttaattcacaacatagatacatgtaagcattattgaggcatctcccatattcaaacatgtcctaccttttgttttcttaggcctctcctaattaataggagattcattttcattaaagagtgagatacatagccggtacttaaacttgcagagtaatattatttaggtccgtgaacttgaaaattacacatttagatccgtgaacttggtttaatgtaccactcccggtctaatcgttatttgaccacgtttgacccccaacatagcatgccacgtaggcaacacttttgtactcagccccctccaaatatacattcgcacataaattgccttgaccagtgcatttcaacctaaatcccccaaaatattcctaaatcggctaaggttttgacggtgaggttagtgaaaggaagccgagaggtagcggctgtggtggccttggcggtgagattagcagcaagaggcagcgcagtgcagcaaggttagtggtggcacagtgcggccggattagcggtgggaggtagcgcaatgcagtttgcacgataggcattcccatggattctccaagctcgtcctcgtcttgaaatcgccggaagaaggtgttgttgattgcccgttgtgcaaggataaggtcattttggagcatagagcaaatgacaattgctaatcgggaccacattttctatacatgcaaggagaagaatgaaagggaagaacgatttgagaaatttttttaggattctgatgtcactatatagctaaaaggagatatatgcgacgtgttgtgatgtggagggggctaagagcaaaagtgttgactacgtgacatgccatgttagcggtcaaccataggtaaatgacgtttggactgggggtgatacattaaaccaggttcacggatctaaacgtgcaattttcaagttcacggacctaagtgataccaccatacaaatttagggactgaccatatatttcactcttcattaaatatggtgttatgtcaacatttttatgatgtggtaaggaattaatggagatagaaatgaaatgagtttcatctagattaaaccatatatacattatttccaatatgactcgtctatgcatgtgttgcctatgaaatagcaaaaatgaaacaatacattgtgtgagttattttaaccatcaattaaatttcttaaatatcttgtttatatgtcacttgaaaacatactaatgaagcctccagtctgcaaggaatggccttactgatatataggtacatgtaaatctcgaggagctattgaagggtgtcatctaccatagagatgggctggtagtcaaatggtgacatcttcttgagttattgcttatgtcctggaagcatttaatttattttgttttttagccaaataataagtgcagcgagaattagtgaaatggaaaacagttgtatcaggtctgccctttgttcttcttatatatagggggagagaagtaccagggaaccacattccctttctcaaagatggaagcaacatctctagatcttcgcttcatcttggttcttgttctacttctgaatccaacatttgcaggtgcaagggtggatccacacagagctcaagtggtgcacaccacacagggtaagttctgaaaaattcattagcatttgatcatgttatcacataaataaagtagcatatgtgtgattaagaggtacttgtgtatgatacctggtaatttggattctacatttgcccctagacaggtgagttctttctcgactattttttgacgttattggtataccttttcttgtcatgtagcctctatctaaaaaaaaaagacttgatttctggctaagcatagaggcaagtaaatagccagaagtcaaatcttttttagagagagggagtatgttgtgtcttgcaatgtttgttgtgatttactctgtttataactagtgctttgtgcatattcaacagtgaaattatagatcagattccttctccatgcaagttctgaatggtgatagtctgattgatgataagcattataacaagtggtagttaatctcttttttttcacagaggattgtattattgacattggctgggtagtgttctgcaccaaaaggttctgcaaatttagttgctggggtgaaggtcttataaagaaggggaaagtccgagactattggtgcagtgattttcacggctgcaactgcttgatttgccgtggcatctaaaaaagcaggggctgttttgttaaccgtatatagtactaaaaggtgtatcatcatgcttaattatgcatgggaatagtcaataataagtcagttgcttcatgttctactgctatatgatttgatttcaggtctggctccgtgtgttatcccctcctggctgggctgccctctctccccctcgtggcagctggctccaggattggtggtcattctccagggtatgtttacctgagcaccttcgcagcggcttcgactccttggtattcctagtctcctggcagctgtagaaggaacgaaacttcagggttttcgactctgcgctcgcttcggtcgcagtggttctagagtccttccgctcggagggccagctgtggtctttagctagtgttacttgttttggggatttcttgggagtgtagcgtggctctgcccccctcccgctgtttggagttgcgtttttaaccgtcgtagtagttcctagcttcaagtcccccctttaggcataagccagtctagctgattactttgtgtaacaaaaactcttttcctgctaatatattgacgtgcaattcttttacgtgttcacaagaatatatgatttgattcgtcatgtggatgtgttgttctgaaatgatattcatgtggatgcagagtgtttgaaaaaacagaaaacgagaaaatcgaggagatacgtaaaacgagacaagctattaacgtgcgattaattgagtattaactattttaaacttgaaaaatggatgatatgatttttaaacaacttttctatagaatttttttaaaaaaggcattaccatttaatagtttgaaaaacacacgaaaaataaaaataagagactttttccctctgtctagaacgtatatataattcggctcggaattttaggaagaagcaatcactatcactcgaaccaaatcctaataatttcatttcagaatagaattctattgatcgaaacaaccccatgagactttgatttggctggagaaattcctgcgtctgtcactgtattact

SEQ ID NO: 18984 - DNA, 4120 bp, Oryza sativa
tgtgtacaaagtttaaaattccacaacttgatcttgctgaattacctgtattgatccatctgtagctatgttgcgagctatatacgacaccacaagaacttcttaacactcttaggcgttgtttagttcgcgaaaagaaaatctttagggtgtcacatcggccgtttgaccgaatggtggaagggattttcgaacacgaatgaaaaaattaatttcataactcgcctggaaaccacgagacgaatttattaagcctaattaatccgtcattagcaaatatttaccgcagcaccacatgatcaaatcatgacgcaattagactcaaaagatcgtctcgcaatttacatgcaaattatacaattagttttttttcgtccatatttaatgtttcatatatatatctaaacatttgatgtgtctaaacatttaatgtaacagaatttttagaagtttgaagagaactgaacacagcctaaataaagccttattttgcaacagatgtgcgtccgtctagttactcgtctactacttttgtttgtttttctttcctgaccagctgagctcagcaccccgtaatactgtagaatactgtagtattgtagcgttatcatgggccggccattttgggcctagatgggcctgttgtgatacgtgggctgctctttatatctacgtttaaccttttgttattttgatgagaaatttgcatatatgccatccatagaaattggctttgctagaataccatcacttaaattggatttgatcaaatgccactctcaactagggtgtattcgctggaatgccatcttaagaccattttgtccttaggcttcttcttcctcccatcaatgtaggaaaaactcgcccatggccatcgcaagctatggccgctaacagctgttcgcgtgcccccgttgtcttcttgctcgtggcagtgttgacacaaaatttgtcgtacacacgaaggcctcaatgattttcttagctctggtgcagatcctatcaatccggtttagggcgtgacaattaatttgattctacaactaacaagaaaaaaaataaaaaggttagatcatgggggccaatcggccaaagggtcgatataataccatgtgccaactgaatcctgaataaacttgccaaccgaatcatctataattacgacgttaattcattatttgactcggtcttgactaaaggtaattgcctaattttttgattgggctcttaatccagtggcacggtgattgggcccaattacaggtattttgttgggtttatgggtccaatattccataggcttggttatgaatataatttttcctcccctttatgtttatttcttctcaactttggtagttttgtcatatacatccaaatatacatcaacactcataaaaattattagaaataaaccctaccactattctggatgttttatactttcatatttatgcaggtatttgatagtgtaaaattggtatttaacaaccgtcaacaaccgcctcgccggacgccggccgctcggccggttgccggcttggcggcttgccgctgccgcaggcccacagcggcgcaacgctgccgcccgccttctcctgtctgcccatctccgttcccatccggactccttctcagctgctccatgcctccaccgatccggcgctccacccttcagcccaggtaacgaagagtgaacagatcaacagaatagtttcctagtgcctaaatcgatttgtgattagagattagtgaatctgtaaataacttaatatgcaatttataaattattactgataagtgaatgtggaccgttgtttttaggattggtaaaacatgaagaggagcggagatattgcgtcgctatttcggaaccatgaagcaaagcaaagaagattgcggtggtgtttgaatctcataaagatgaagatgaaaaataaagattaagtgtttcacacaaagcgaggtggtaataacatgtgattaattgagttttaattgttacaaagttgaaaaatagattaatctgatattttagaacaactttcatatagaaagtttttacacgaaacgaaccgtttagcaatttgaaaaacgtgccacttttatcaaaattgattttcaaaatgctcaaaatccgtcaactttataaattttgagggttcaagtcaagtccctctttccctaataaaaagtccattttacttcctaactattgtaccaacctctgtagaagaaacgaacaggaccgcatgttgcttatcttcggatgaggtcattggtaatgaagctcctgaacctggagaaccaccaccacaagttcctacagttgatgatgaagttcctataccaagaaaaaatttgtggctacgccactgccgagtacgatacttcctaattgcaacaaaaaaatttctggctacgccgctgccgagcacgacacttcctaattgcaacaaaaacgtgaaaaacacatcaaagtctaggtacacatcaagtatgaccgaccggccgaccggattttctcgtcaatgaattcttgtagcgcccgttccgtggtggcgcctagcgggaaaattatctcttaaaaaccctaattgcgaaatttgcttctttgcttattgtctagtgtctgtgccatctcaagatctcaatccccgatctatcgtcgagttcaattccgaatccaaatccttcccatcaaattcctccgcaaaagtctattttgcctcccccgaggtcgatgggccgaaacccgctcggcccatctctcccccggccccctctctcccgggcgccctcgctctctctctctctctctctctcgccctctcccctccccggcgcgctccgcttctccccccactcagctccgctccgcctcgcccgcgcgccgctcgcgcgagcgcgtgagccgcgccgcccgcaccgagccaagccctcctttccgctccctcgctgccgctccccgcgcgttgatcgcgcgcgcgtccgcgtggtcctcgcccgcgtcgcgtctgcgccgcccggccccgctgccctgccgcgcctgcagccgctcggccccgcagccagcgcgcgtgccgagccgcgccgctccatccgccacgcctcccgttgcaagccgcacgcgcgtgccgtggtggccgaccgcctggtcgccgccgtcgtcagcgtctgcgcgtctgtcgcccgtgtcgtcgcgccgctccaaaccgcccgccgtcatcgccgtcgtcaccgcccggcccccgccactccgcgcgcaagccgccaagggacggaggcagcgcccctcctctctctgccgggtagcccccgctcccctcctcctttatcccgaatcggcaaaggggcaagcccccctttctccccctccttttccccttttcctcctcgccggcgttatcctccctgtcgccgctttggccgcgaccgccgagcgccagctcgcgaccttgaccgcgcaagtcgggtcccaaaccgacattgccgcccatttaaaccccagcctcccctttcccttcctctcccattcgtctccgcgccattgccgccgcccccgtgctcagtctcgcctccgccgtccttcgccgagcgccgggagagccggtgcgttcgaggacgcggaaggggacttcggccgcgccctcttcttcctcttccccggcccgaggccggagagattactcccgcgccgtcgacctcttgtcacaacgcccctcctcatcacggtagtgcctccctccgttcttcctcctcgctccatcttccccccttagatttcggtagtagctcgagtagcctccccgtagttagccggcgctgccccgaccgttgccgtcgctcgctgtgtgctcgctgccgtcgccgctcgagctccgtagcacccgcacgtcaccagcctcgctcggcgtagctccgtccaatccgacgctagcgtcgagttcccgaagccgcgtagatgctctcaccgccgggaatcgacccctcgtggcctcgtcgccgtttccttcttccctccccgccggttgtcgccaccgcaattcgccgccgtcaagctccctccggcgaatccgagccgttggctcgtctcccctcatcagggtaccgagct

SEQ ID NO: 18985 - DNA, 8998 bp, Oryza sativa
tcttccctccccgccggttgtcgccgccgcgattcgccgccgtcaagctccctccggcgaatccgagccgttggctcgtctcccctcatcacgaacaaccgcccggtgtgctcgcttttgcccgtatcgccgtggttcgctccgccgctcgccgccgccgcccgccatccattcgcggccgggtcgtcgtctaactcccgccagcccacgtggccgccacgtaggcgccacgtcggcgccagctcagcctagaccagggtcgagccgaccccggtcagtccctccccgtgcgcgcgttccaccgcgagccgtgaggctgcgcgtgggcccgccgcatccgcgtccaccgcgagccgcgcgcgtgcaccgcgtccctcccccgcccgcgcgcataagccgcgtactccctccgcacggtgagccgagccgctgataagcgggtcccacccgggaccgcgcgtggtgagcccggtccaccggactctctctcctccctccgcgcgcacgcgcgtcttgggccttcttgggccggccggcccgttaagctcggccgagccaccccatttcccttgggccgcgccttagccgcccgaggaaaagtctataatccctccctcttttcttttcaattcttttcttttccaaaaggatttaattaaatccttttcctttagaccaaaaatccaataatcttagaaattcaatatcttcccaaccgtaaatccgtttgactccgttcaacttccaaaattcctcaaatctcgagatctatctaatggcatgcttagaggtcattaatagggctttattttttcgccgtttgttgagttgtcccatttcgcgtgtagtttcggagcccgaagacccgcagcgcgaggatttcgaggatcaagctccagatctcgagcaaggcaagccacctttgaacatcttgagcctatatttgaaatttaattaagttgcttgaaaaatattatgcattgataggatcgcacttaatctgtttgtcccgtctgcaaggcagattggcggacctacctagtttgttgcatatgatccttcctttgttaattgttataccatgttcccttgtaaccacccagttgcgcctcgggaatcgtgcactctgtgcgagtaccgacggtcgccttcaaacttaaaatctgagtaacaacttgggtaaaacttgggttttacaaaagacttggaaaacccgacacctgggtcggtgcttgcgaactaaatgaatttccaaaaccgcggaccggggaacgtaccgggtgtacggttttcccgctctcgcacttaaggaccgtttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgttggctttggaaatgccttgtcatgaaagcttggaggtctcccgacgtggctgatccccacgggctgggtgatccgggttagtaatgttgtgtgggtaaagtgtaccccctctgcagaggttaacaaactgttcgagcagccgtgcccacggtcatgggcggatgtgaggtgattcctagcgtagttttgtttgactactgcttgtgaaattgctgttgtgaaaaggggttcgatgtttgaaaaatcagcagctgacgggatcagctaggcccgggtggccgattgtaaagttgttggcccgggtggccgtttgaaaagctgttggccgggtgccaatcttgtttcaattctaaagactgatacattgcacatactccgaccggacgagacgcactgtctcatccgtgtcgtttgagaagcactcacttagttgtttttagaaaagagttcaaataaaatcaattacgaaaacaacagcctttccttgaagcctacattaaacacttatttccctggcttgctgagtactcccgtactcacccttgctctatataaatatcccccccccccagttgctgaagaagatgaagcggatcctgctgatgaggagttcttccaggagcaagccggctatgatgagttttagggtttcggcctagttcccaagtcgcgcctgtgttgtttggtccaagtcctggcttccgtttcccttctgtaatgcagttgtgagctcgggatctgtccgcagcccaacatgactgtacctctactctataataaagagacctctgttgctgtgatattctgtctccctgtcataccagcactatttcctgggactggtatcgattaacaggttaaattggagcgtcacgggctagttccggtcgggactagttcggggcgtgacaattctactattatcaagaggtagctagccatggcatgaatgatatgtatccatggcaatgtggatgaggtcctgtttagttttcacgcaaaaacttttcatcatgtcacatcgaatatttggacacatgtatttagtattaaatataaataaaaaaactaattacacagattgcgtgtaaattgtaagacgaatcttttaagcctaattgcgccatgatttgataaaagtattaattaggcttaataaattcgtctcgcaatttacagacggaatatgtaatttattttgttattagactatatttaatatttaaatgtgtgtccgtatatccgatgtgacacgccaaaacttttcaccgtaaaactaaacagggcctgaccacaaaatgccttttagcctagttcaccagaatgcagcaacatcagcacagctgcaagttgcaagagaaaagccacacagcttgtttggctattaatggagaggcagattgagacgtgtgcgtgccaagttgaagactggatcccccgttcgaatcttctaaacatgaagattaagggattaagggggtggttaggtatagggatgtaaagttttagcgtgtcacgtcggtatctaattacataatccctcaataaacagtgagatgaatttattaagcctaattaatccgtcattagcaaatatttaccgtagcactatattgtcaaattatctcataaattagtcgcaatttgtgcaattaattattttttaagcttatattcaatacttcatacaggtattcaaacgttcaatgtaatatggtgtaaaatttttgtgtgggaactaaacgatgatggaaaatgaggggtgggagggagaaagaagaaggtcagaggtaaattggtcgaggataacattctagcgtagattgagtaatggcattttagcgaatccatggtagatatgtaattttgtacgaatatgtggcacgcttctctagccgaacggagctttatttgtggtgccacgtcggtttataagattcctatctctatatatagcagccaagtaagttagggaaagaccaagttagtttgtagctcagcaacaactcatcctagagcttgcagagcaagagggagttgaagtatggcaacctctgttccgagtgtactactactacctgtgcctacctgcaccgatatgctagtctcaccagtagaaggaggagatctgctgcactgtaaaccccactttgatcaccatcctaatgtctggggcgattactttcttaccttctcaccctgcactccatcaatggtaaaacagcacaattaaatcagtaaattatatataatttactactacccatatgcaattttcctatctatctattattcttcatttagagatatatagtacgtatagtacatataaatatgcctaacaaataattaattacttcgtagcataatcgtcctcgcatgtatatgtatatgtagcttctgaatatgaagagaaaagctcatgtttccgaggaacaagtgagaaggatgatacttgagtgttcttctggccccaatttgcacgtaaaacttgagctcgtcgacaccttagaacgtctttgcattgactaccactacgagaaggagattgaaaatgtgttgcgccgggttcatgaggaagaagacgataccgacaatcactatgacctccacactacagctctccggttctatctgctcaggaagcatggatactatgcctctccaggtgggtgtgtgtgtgtaattgacgatgatataccatatttttagcatgaactaatactctcccttagttaactaagattataagtcgttttgagtttggtcaaacttaaattgctctttatttgaccaagtttgtagtcaaatatagtaatatctatttataataccaaattagtttcattagatctaaaattgaatacattttcatattatatctgtcttgggttaaaaatgttactactttttcctacaaactcaattacatttggaacagtttgattttgaccaaagtacacaataacttataatttgaaacggaggtaattgaatatatgcaatgaaatatgttcgttgtagatgtgttccagaggttcagggacgaggaaggaaatttcacacgcgatgataacaataacggcacaagaagcatgctgagcttgtacaatgctgcccatctcaggattcatggggaggagatactcgacgatgctatcgtcttcactaggaactatttgcagtctgtggtaaaacatctgcagtcgccaatggcggacgaggtgtgcagtgcacttaggacccctcttttcaggaggccaagaagagttgaagcaaggcactacatctcagtttacgacaagttgcccacacgaaatgagaccattttggagttcgccaagctcgactttgggattttgcaatctctgtattgcgaggagctcaatatcctcaccatgtatgttctaaaaatcactagattaggtccaattatcgtttctgctataggaattggatgaaaattatcatcttggtgacatgcttttcaaactactaaacaatatgtttcgtgcgaaaactttctatatggaagttgttctaaaatatcagataaatctatttttaaaatttataataattaaaactcaattaattatacattaataccatcttattttacgtaaaacacttaatcttcatcttcatctacaccacaagagaataccttattatcttttcgtgctagctataatacctgaaccaaccctaaaattcaaaacatgcataggctcaattttactgtccttgccaaggtattgggagttaccaaaattcacctatatatctatatagatgtccaatttaatgcatgtacatacaagaactggacctagaatgtgaatttttatttattatttcggtgtggtgaaggtggtggaaagagctccaactccaggatcatctaagctttgcgcgagataggatggtggagatgcacttttggatgcttggagttctcttcgagcctcagtactcatatgggagaaccatgctcactaaattgttcatctttgtctcgattttcgatgacatctacgacaactacagcaccttggaagaaagcaagctgttcacagaagcaattgaaaggtcaattgattaagtttcttcttttaataatgaaattcattccgaacttaatttgtttcaaagaagctgcatggagccaaaattcttgtctttaacttgaatttaatttttatcaatgattgaaccataaaaatataatagatgggatgaggaagccgctgaagaacttccaggctacatgaagttcttctacaagaaagtactgaccaccatgaaatccatagaaactgatcttaaactccaagggaacaagcatgtcgactatgtcaaaaacctagtaagtagctagtctcatcaactacctgcaggcaggcaggcagctgatctcattgatcacaactttaactgcttggttaatcttgcagttaatcgacgctacgagatgcttttacaacgaggtgaaatggcgctctgaaggtgcagatcaggtagctgctacggtggaggagcacctcaagatttcagtgccaagcagctgctgcatgcacgtccctgtctacgccttcgtcgccatgggaaacgatgtcacaaccgatgatgctatcaactggggcatggcctaccccaagatcatcacatcttcctgcatcgttggccgattactcaatgacatagcttcacatgaggtatgtttgagtgttttttttgggtaattttaccatcttaccaggaggtatcatattttttatgtattggtacctctagatacttactccctccgttccaaaatataagcatttttagagttagacacggttattaagaaagcaagtagaagtgaatggtggagggttgtaattgattaaatagtgaaagtaggtgggaaaagtgaatggtggagagttgtgattggttgggaagagaatgttgatggagaagttgttatattttgggacaaatcttgagagctaaaagttgttttattttaagaccaaaggagtaatatttaaggtttctgaaattttgatgtaaatttaggtacctcgaggtactttcttaaagatcgtaaatttctcttttttgaaacttttttacatcttataagccgaagagacatgattgaatcaataaaaaaaaacaagctctatatagtatctgctaattaattacttattttgtccccaaaatataagaacttatgttcggatgtgacattttctagtaatatgaatctgaaaaatagaaaatgtcacatccgattctaagttgttatattttaggacgaatggagtagttaactagttgctaaatatttctcttaattaatctgttcgctaacttggatcggccaattaatttccttattattgaagagagagcaagggtcttcgtcgtcgtcgtcgtcgacggtggaagcctgcatgagggagcacggcggcatcacgaaggaggaagcctacgcgaagctgagggagctcgtggaggagtcatggatggacatcgccggggagtgtctccggccggcggcggctcaaccgccgccgctgctggaggccgtcgtcaacgccacacgcgtgctggatttcgtctacaaggacgaccaagatgcatacactcatccaagttcgctcaaggatacaatacactccatctacatcctctctgtttaattagttttcttctaatgaagcgtgactgtatttcaattattaggtcttctatatatgtatatgttgaactttgggaatatttttgccttgtaaaatatgttttttttccattgaaatatgaatacagtggtattacttttgtgttacttccagttccgtttggacttatttggttttgtaggagaacttctatatataaatttttttcatgaaaaatcaacaccgtttaatggtttcgacaatcgtgctcatgggcaacgatggacaaacccaaccgagaatctacattttatttttcggggaaaaaggaatatgttactcctcacaaacaagacgtgagatgaaccgagaatctacactgatcacagcaatctagacgtacttactacttagcttacatgttggttgaaattaacgaatgtcaaatcttcaaatatgagctcatgtatattactacctccattccaaaataagttcatctttcacccatcccacacatactgatacaaaacctaaaagattaaaatatctctactttatcaaatccccatgtaattatttcttactttatctacttccaatacaattattctctactttcacaaactacaatacaaaggttactttaaaaatgattttttttgagccaaaaatgaacttattattatggtcctatggagcagaggtagtatatgtagtgtaggatactgctggctagtactgatctttgatggttttgaagtgttctctttgcaaaaaacagtcaaacagatcttgttgtgcccctctgaagtctgaaccccaccaaactcctgtttcagttcactccattctacccttgctctccgtcctgctgcagatatcttcagagtttcacatcccactctgaattatattgttcagcatatatacattgagagagagagatcaaacataatagtagaacggtagcactgatattggcttctgaaaggaatatatgccccagccaaacatcgattgagaagcttgtcaagaatggcctgcagcgggttcttcggtttcaggtgaatatgttgaatatggaaagcctagattatatatcacaaccttcacatgcatggctgatgaactctccacccttgcttacctgcttaatgtggaaaccaggtccgcagtgaaatgccatgtagcaaagcatctccatccaaacattcatgatgatatcccatcgatcatttgcttctttcatcttaagcagctccttggcaagttggccactttggattaacacaggctcaactgccgtcagtattcttgggtgctcgaaatcctcagttagattatctatctttgcagctacacttctgacaacagcatcttgatctagagcttcctggcggtcttccagacattcaacgatgaattcctgagcatttctaagccgcatgtgcccatcattgccagataggatgccatgctttgcagaaaggtacatgacatatttagatagttctctgcttggacctctggatggagagctgcagcctagctcatcttcatggaagaaggatatgtccgtcgcaatatgccaagcaaggacagcagacatgaaaccggcacgctgaatgctatcgctgatcagcacctgcagccgagctcttgatgaactttcaatgtgcagtttgctcctcatgagctccaactttgcccattggccggtgaatttgctgatgtccccacacatcatctgaatgcaatctgctaccaacctg

SEQ ID NO: 18986 - DNA, 698 bp, Oryza sativa
  unsure (1)..(698): unsure at all n locations
gtgaaactctgaagaaatctgcagcagggcggagagcaagggtagaatggagtgaactgaaacaggagtttggtggggttcagacttcagaggggcacaacaagatctgtttgactgttttttgcaaagagaacacttcaaaaccatcaaagatcagtactagccagcagtatcctacactacatatactacctctgctccataggaccataataataagttcatttttggctcaaaaaaaatcatttttaaagtaacctttgtattgtagtttgtgaaagtagagaataattgtattggaagtagataaagtaagaaataattacatggggatttgataaagtagagatattttaatcttttaggttttgtatcagtatgtgtgggatgggtgaaagatgaacttattttggaatggaggtagtaatatacatgagctcatatttgaagatttgacattcgttaatttcaaccaacatgtaagctaagtagtaagtacgtctagattgctgtgatcagtgtagattctcggttcatctcacgtcttgtttgtgaggagtaacatattcctttttccccgaaaaataaaatgtagattctcggttgggtttgtccatcgttgcccatgagcacgattgtcgaaaccattaaacggtgttnnnnnnnnnnnnnnnnnnnnnnnnnnnnnnnnnnnnnnn

SEQ ID NO: 18987 - DNA, 941 bp, Oryza sativa
  unsure (1)..(941): unsure at all n locations
nnnnnnnnnnnnnnnnnnnnnnnnnnnnnnnnnnnnnnnnnnnnnnnnnnnnnnnnnnnnnnnagagcgagggcgcccgggagagagggggccgggggagagatgggccgagcgggtttcggcccatcgacctcgggggaggcaaaatagacttttgcggaggaatttgattggaaggatttggattcggaattgaactcgacgatagatcggggattgagatcttgagatggcacggacactagacaataagcaaagaagcaaatttcgtaattagggtttttaagagataattttcccgctaggcgccacgacggaatgggcactacagaccaacccccctaacaagaatctcgaccctgagattcagcacctaagggagcagctccgggaactcggcgcggagaagatcttctcgctcccaggttgcctcgtcttcaaaatgattgctccattggactttgtagaacttgatggtcttccttcgagtctgacgttctgcctcttcaagaaccttgatcggtctttccttgtaggtcagattcttttccagttcgatattacccagggggacttgctcttctggaactcgaagacatttctttagctgggatacgtggaacacgttatgcacatctgcgagaccttcaggtaactcaagctgataagccacttcgccacgtctggcggttatgaggtaggggccgatgtagcggggtgctaactagccggacatcccaaaccttctcacaccacggaggggtgatactcgcaggtacacatgatctcctttttcgaactcaaggtcacgccttcgattttcagcgtaacttttctgacggttctgcgctgtctttaaacgttttcggattagcttaacttattcttctgctgacttgagtatgtcaggaccgaataccagtgcttcgcccacctcattc

SEQ ID NO: 18988 - DNA, 590 bp, Oryza sativa
tttccttgggttgtcgtgtccccagtacacggggcactccttggaccgtgttagccctcactgcgagctctcatgagccctttgcccccgtggaggtatacacggagccggccttgttccacaccactttaccgggggcaggcccactcttcaaatagcgtaccaggacctctcctggactgctcttcgtcacctggaccaccactacagtcaccttctcggaggctgcgtcttacggcagattccacgcctttcttctggtcacttatacgccagtttcccttgggcgtacagcgagtctcagccagtgcagactcgcatggttgtgcttcctgaggcttagggcacatcaacacgacctacttcttgaggcttaccgctcccttgcccgccgatactccgctctggaggcccgtcttgccgatgagggtgtcacctcagttgacactatctactgtgacttaggtcggctctgatacaccagtcaactgtgcttccacagctatccgtgggtgtgcacgcactcccaatggttcgtgcctcccccaacttttgtgcgccgtactcaacagtgtacttcccctacccac

SEQ ID NO: 18989 - DNA, 854 bp, Oryza sativa
tatagggcgaattcgagctcggtaccccttttccttttctgttctcttgtgacatccggaattaatttcacaatacaagaaaactaatcttttttaaataaataaataaaatgctaaatatatacggagtggaatggaaaaaaaatggtgaggtaaaaaagaaatccttgctctagatatgaagagttaaaatcagagttgatgtcgagcagataaattggtaagctgagaggagaaacgatgcgatcgtgttctagttagggaatgagagaagtgacgcccccaatcgagatccatagatcggtgaagacgaggaatggaaaattcatttttaaaaaaaaatataaaaaaactaaaattaaacgaaaatggatgatttaggaaaggaactcgtcgatctccgtagaaactacgaaaatccatctgaatacacgcgagaggcgaaggttcaggttgatggaggaggaggcagcggaggtggaggcaacggagagagcggccggcgaactcgttggtcggaatggggggaagtacgtacctggcggcgccgaggacgaggacgaggttggtgaaggtggggcggtggttgaacgccctcgacgcgccctcccacatgaacgccgtccacctcatcgccggcgcggcgccctgctgctgctgcctcttctccggtgatctcggaggatatgctcctccgctctaggctctagctagctacgctacggcgagaaggtaggaggagtagagagaaggtggtggaggaggaggagacggaattggtgtgcttttcgtctggtcgccgtagacccaggaagaagaaggcctatataaaagcttgagtattctatagtgtc

SEQ ID NO: 18990 - DNA, 1389 bp, Oryza sativa
caatggtcagcctcgacgggctggacggtctgagagaactctggcggacgagacctcagaaagtctgtcagctgggatctattgttgctcatgtgagggtggccatttccatgcgtattatgctgaaaaccggctatggctgcggctaatccttgcaagatttgtgtctgaactgccattaagtgttgcatgttgttttccacatgaggtggggaagggaggcgttcttctccagaattgtgactggcagtgtggtgagagcggtgagactattccatcttcgtatcacgggaagctgtacgatgcgagcggttgctgtggcggggttgctcaacttctgcgttgcgggaaacagtacggtgtgaacggttgctgtggtgagactgctcattagctgactcatgatttgcttctggctcggctctaccatcttcaaaaccaaagcgggctggtgcacgagctgcacggcgggggcggctagccatctaaactcccagaagagggcggggtaagagttagataagcacttaggagggcaagtagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctgacacccggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaagggctaactgggtgtgggtagggggagtacactggtgagtacggcgcacgcgagctgggggagcgcggaccactgggagtgcgggcagagccacgggagctgtgggaggacaggtggctggcgtgacagaggcggcctgagtcccaggagatagtgtcaactgaggtgacaccctcctcggccagacgggccttcaaagcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggcc

SEQ ID NO: 18991 - DNA, 548 bp, Oryza sativa
caaaactaatttaatgttcttgattatgtaattttttttataaatttggtcaaatttaaagaactttgactaaaagaaaagtcaaagccttataatatagtatgaaatggaggagtacttcctagtatcatgcaagaattgtttgttttctccatcgacaatagttctaattgctactccatattttgttttctccattcacaacatggttgttaaggctaaaaggcgtcctaaggcgaccccggactgccatagcggtaaggcgtaaggcgaggcgacgccttaggcactccataccaattagatgacaaataaaataatctaatatgatagcaaatcaaagatgcattttaagagcagtacaacacacacacacatatatatatatagatggttgtaataattacttaaccagatatcaatttattaactaaaagagcaccatcttataaatacagagtgagggtgcatgggggaaagagcaaacaaggtaaatatgtgctaagtactaactacaatacaaagtgagggtgcatggggaaagagca

SEQ ID NO: 18992 - DNA, 731 bp, Oryza sativa
  unsure (1)..(731): unsure at all n locations
atcgcaatgttgtcttccaccgcacaagggacacctgccaaaccctcactgaacaggtttctgacctttttctttacttaacattccattgatctgtttaattacctccaacatgcagctgtccgcctttcctaatttaatttcataaccgtgcaagcatgcatataacatgcagtctttgtacctacagtttctccttgtcgttttcaattctgtcaatggcctcatttattgacactctggaaaatagcctgttacgcatggtgatcagatataattgcttcctgaaaattaccatgtcctttatgctacgtgtgatttctgtttattatgctgctcatattagtgtcttcttttactccagttccatgattattcatttgtggcattaattccatacaatgcaggaacgaaatttagtgctggtagggcccacccgtgctgttgtgttgtcaatgccggatcctctgatcatcgatgttgaaatgaaagtgaagggcaccactgaatctgaggacaagcgcttgagcttactagctgtgccactcttatgtgctggtaagtattactcacacgtgcttaaatctggttcttacacaagcaagctaagcacactggagttcagacttggctacatcgtgtcatctgtggaggccacaatatctgtgcgtgtcattnnnnnnnnnnnnnnnnnnnnnnnnnnnnnnnnnnnnnnnnnnnnnnnnnnnnnn

SEQ ID NO: 18993 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnatcgttgatgaaaatttctcaatgaacctaacattatttttatagaggtggtaccgtttctacaatttctaattttagacaagtgtatatataattaaaatttgagttttctagtttttttcagtgtgagttttctagtttctttctgccatggattgcagtcaccactaaataagtaaattgataaatatataaattctcaactaatcgagaattttccaaagaaatagtaatgatagatacagtttccaactatttacattcctaaataaagtgatttttaataaagcgctttaagaagtcgagtgtgtgtacggcttgtttcgtggagctgcttctggctgctatagcttctcctaaaatcaaaagctccactaaacagtccaacatttcgatcagattctgcgaaattatagttgtaaaaattaaaaaataaactagaagttagaaacttggataccagcttcttcagattctcagaaaatggttaccaatcagctgctttttaaaattttaaattcctcaaatagactctaaattaaggtgacaatcgcttcactactattggtactggatgtcctacgtacccgttgcagcaggattttaaagttctttcctgggaaacattaatcttggtactcctagctgatatctcactgacatgactaaatatgacagcttctttataacaattaatgtcgttactagtgacta

SEQ ID NO: 18994 - DNA, 496 bp, Oryza sativa
atcaggtcttacttactacttcctctgtttcatattataattactcattttgaatttggtcattgtcaaactactttaagattgattaagtttatagataaatatagtaatatttacaacaccaaattagtctcattaaatcaataattgtcacgccccgaactagtcccgaccggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattgcaaaagggaagtggaagccaagacttggaccaaacatcacaggcgtgacttgggaactaggccgcaactctaaaactcatcgtagcccgcttgctcctggaagaactcctctctagccggatccgcttcatcttcttcagcaactggggggg

SEQ ID NO: 18995 - DNA, 789 bp, Oryza sativa
  unsure (1)..(789): unsure at all n locations
nnnnnnnnnnnnnnnnnnnnnnnnnnnnnnnnnnnnnnnnnnnnnnnnnnnnntaacaaattaaagtgaaaataattattgcacattcacaactatatttgttatttttgttacaacttgtagaagctgaatttaaacctgcatatttgtggagtgatatatttcatattaatatatgttgctaacttcttttgtattcttttagtgaatattcaggtggcatatacgaaacgagagggtatcggatgaaatcaatttccctgtataatgttaggcagtctgttcgtgtgaccatgaccggccgatggctgcgaccgacgacgaaatgaggagtgtcaaactgtgaaacttgctgacatgggtgcatgcggcgatcgattaatataagtcagggggtgcctgggctgggctttcgatcgtatatcaaacataatgcggggataattgattgcttggccagtttatcagtttctgcatgtatggttcaggggcgcagccatgcatgcctgccttcatctgcggtacgtactccctcctccgtacgttgtttacagcatcaacagtctctataatgatacttaattgttttcttatgatatttcaaaaaatatatattccctccgtttcaaaatgtttgacactgttgactttttagcacatgtttgaccgttcgtcttattaaaaaaaaattgtaaaatatgtaaaactatatgtgtacattaaagtatatttaacaatgaatcaaatgatatgaaaagaataaataattacttaaatttttttaataag

SEQ ID NO: 18996 - DNA, 566 bp, Oryza sativa
  unsure (1)..(566): unsure at all n locations
nnnnnnnnnnnnnnnnnnnnnnnnnnnnnnnnnnnnnnnnnagacaccatcaccatcagaaaaaagttctgcgccgccgccacagaacggacactcaagcagaaaagcccaatgaggtagcttgagatcgaatatcattggtttcatgctgcctcccgctgtttcagtgctttgagcttgtcgcggtactcatcccggatccggatgaagtcttcacggcggtagttggtcatttcgtggggaccattgagccagttgacgtatccctgaccgtaacgagcgaccaacccagcttcgtattgctgcgccacggtcgcctctttggcggtgtacttgccagctccggcattacaggatttgcactgcttatgggcgttgcgttcttcaaagcgcagttcagggtaagcacctactgtcttgaaatggccgcaatcccactggccaccatgcagatcaggcggattggtctcgccgcagctgatgcatggcaaatcggcgtcgcgcgcacggataaaggcgttgaaagctttctgagcctgagccttgtagtatccgtctggcctgag

SEQ ID NO: 18997 - DNA, 2081 bp, Oryza sativa
  unsure (1)..(2081): unsure at all n locations
nnnnnnnnnnnnnnnnnnnnnnnnnnnnnnnnnnncctctgtcaatgaatttatttttagctatgaatgataaataaggctccgtttagttcacactaaacttcctccaaaactcccaacttttcatcacatcacatccaaaactttcatacttacataaactcctaactttttttttaaattaccaactttttctaaacttctccccaattttagaaactaaacacagcctaaacttattttgataagcacagcctaaacttattttgataagggtgtatcccatggaggtttgcttaaaggttatatttttcgggttatcttttttgtgctttgaacatgctcacgtaatcgcgatatagtcttatagaccacgccaaattagcaagtcgagtaaaacagtaaacaatgtatttgacaatggtataacaatacacaataccatggagtaacagtatacattaagaataccttttaaatccatacgtttggtacttccactaatttaagtgccgtgaaatacgggaatacatttccagtcgcggtctgcaggccgtaaaataaccataatgccctgaaaattactatgaaaccatctgcagatgtcttttctctctataaaacaccaaattatgaaaccaagccatccagagagaggcatgggcaagacaaacaccgatcaaccagccagcttccaccagtcgtgattctctctataaaacagtactacaaaacagatatgtacagttgaacacccgacatcagagccgatatggacgaaactatagacaaagttctgctacatcgccctctagtatccgatctgagctcttagccaaaaaaacagtgatattatgaaaaaaaacttccaaatctaactagtgttcctaggcctaacatataaagcatcagctgattcattcagaagtctggcctcttccttcagtgtcttgctccaaatgcttgacaaacaactgcatggccaaggaaacaactcgtaaataaacgttgaaggctcgccaatctttgaccatgtataggaagttaacaactccaatgcacgcccgagaatcaatacatgcttaccaacaaagacgtgatgttctcatcagcgatgaaacaaacacacgcaacagccgtcatcttcttggtctaatctgacgatatttgataccataacctactgtggatgcaattgttgtagaagctacaagccagctgcatttcaagaaacaaaagaaataaagcatgaaacacagaaaagataaaggatcagacaacattccgttagcaaaatcttcaagtttccctctagctgcaaccatttattacaattgtcacctatttgtatttgatttttcttctacgtgagtgtttcttctaaaactattgggtttacattacagtatgttcacatcaggaatggtttaattggttttataaaggttaaaaattacaaagtaacacaaacataagattagagaagagttacctcaacactgtaatataattctgagtctcctctgtgccaaattctggctggaggagagcagcagcaaccaacatcaattggaaaactgtgttcacctggacccaaaaaatatggtcatgctttgacatataaggatataatcctaaatgatcaaatgttatgataacacaaagccacaccttgctgataaaaagaggtttgaccttctcacggtgaattgcatctaagttaacaaagtctgaccaactgttccactggcacaagggcaatatacagcagttaatataattttaatagtccaaaaaaaatcctgaagtttccgtaaaacagtctaccttccatcccagactggaagctcgtttgtagacagcaccacccacaaggagcaagtctcttacaacaaccaagccaacaagcccagctttgagcaccattaaaaatacaaattaattgatttattgaccaaattatttattcaaaggagaatacagcaacaagaataagtcactagcaatcataatagttcttttttaagttggtgaatggtgcgtcagtacataactagaactggtaccatagatggggatgc

SEQ ID NO: 18998 - DNA, 917 bp, Oryza sativa
  unsure (1)..(917): unsure at all n locations
cttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatatgtaattattggaataattgttggagactcaaatgatggatatgcaagcatgataacttatatgcttttctatatctccatgaatctaggaacttttgcttgcattgtattatttggtctacgtaccggaactgataacattcgagattatgcaggattatacacgaaagatccttttttggctctctctttagccctacgtctcttatccctaggaggccttcctccactagcaggtttcttcggaaaactctatctattctggtgtggatggcaagcaggcctatatttcttggtttcaataggactccttacgagcgttctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaataggaatgggcgctagggtaatgaacttataatcatggaatcgactcgatcatcagattataagttcattccannnnnnnnnnnnnnnnnnnnnnnnnnnnnnnnnnnnnnnnnnnnnnnnnnnnnnnnnnn

SEQ ID NO: 18999 - DNA, 1831 bp, Oryza sativa
  unsure (1)..(1831): unsure at all n locations
nnnnnnnnnnnnnnnnnnnnnnnnnnnnnnnnnnnnnnnnnnnnnnnnnnnnnnnnnnnnacattagatctatacatagtgaaatattgtgagtacactaggtataacatttttcggtggaacaaaaaatataccaaagtcccttaatatggggtttccaaaatatgtgggtttttttgttgcaatgaaatgtttcattcactgcaacattagacattgtgagtacatgaggtgaaacattttttgtggaacaaaaaataaatcaaaatcccttaatagagagtctacaaaatatgtgggttttttttgttgcaaaagagtattttaataaactgcaacattagatttataaatagtgaaacattgtaagtacactaggtgaaatatcttttgtagaaaaaggggagagagaaatgagtggttccaacagatacgcacgtggaggagggacgcgcggggggagcatccgatccggctccccctgccggacgcccggcaatgagcattttcgatataactggcttatggtaatgtcatcattcttgtcattctcatcgtatctatagttagctccaataacttgggactgcaagagagcagacagtcctgcgagctccaataacctggtaatgaatcctgacgaacagaccaagtaccagtcaacatcgacttgttgctgttacatcctgcctaggtggtgtacattacacaagaaattcaagagagcagacagtcctgcagctcctcccttccctgctaggctgttactcctctatggtcacctgtgcttgatttcatcatctgccttgatctcagaaaccatgtctgtcttcctgggaggattgctacagtccctgtctctgctcttccgggcggcctgatccgggccatcttggggatgatacttctgctcggcaagaaacgagagcgccgcgacgacgtcgctgatcatcggcctgttgctggcatcctcctgcaagcacatggaggcgatcgcgagagcttggtaaagccccttgagggggaatttctcttccagcaacgggtcagccagtctcacgaatctcttcttgtccttgacgagaggtgccgcctgtgtttgcacacacagagaagccagttaattaatgcagctcgaaatcggttaatttttgtaggacgagggcagtgagttgctcacccattggacgagaacctgctcgtgcgtcggcctggaggtatcgatcgcccgcctgccggtgatgatctccagcagcacgacgccgaagctgtagatgtccgacgtcttggtgagcttgccggtcatggcgtactcgggggcgcagtagccgtacgtgcccatgacccgcgtgctgacgtggctcttgtcgccgacggggccgagcttggcgaggccgaagtcggacagcttggagttgaagtcctcgtccaggaggatgttggacgtcttgaggtcgcggtagatcaccggcgggttggccacctcgtgcaggtactcgatgcccttcgccgcgcccaccgcgatcttcatccgcgtttgccacgggagaggctttgcctttggagggagatctgcacgcacgcacgctcgatcgatcagcggattaatcgacggcatggcgatccaacgctggctgttccgcccgtacgtacttagaagatgatcctccagcgagccgttccgcatgcactcgtagacgaggattctctggtccatgtcggtgcagtagccgagcagcttgacgaggttggggtggtgcaggagactgagcatcagcacctccaccaggaactcgcggttcccctggaacccgtccttgtccagctgctt

SEQ ID NO: 19000 - DNA, 14234 bp, Oryza sativa
  unsure (1)..(14234): unsure at all n locations
nnnnnnnnnnnnnnnnnnnnnnnnnnnnnnnnnnnnnnnnnnnnnnnnnnnnnnnnnnnnnaaaaataatccttagacaagttgttttagttgtttaattaccctggcctgcttattttgatgtttaggatcactaaagccatcttttctagaagggttctattaatattaaagtccgaagggatcgcggcaacgattccccagctctgttccgccatgggggatgaatgggagacttggatagctgcaggtcttgttagccccatgtgtcactctgtagcaactcattctgtgagattttagctttctttttatgtctgtaatggtggtgcattgacgcaccgcgctaccttgtacattccctttcttactcttaatatacattggccggctattcgccggcccggcgaaaaaatattaaagtctcgtgaggtatatcataaatgagatcataaacaaggtaagtggttggtaaaaggtaattagtgagatctatagtttctgttcggtttaggattttaagttgactttttgacttgtacatttttttttgaccggaaatactgccggggctttgcccagcagtgtacacttttgttaatcggtggcttttaagtcttaagtttaaatataatatcctaactctaacttacgtaactaaaaaatctacttaaatttagcatttgacttaataatgtgtgcctataaaaaggatatttgtttgtttagatatgggccaaaacaaaggggccttaatagtacgtatacaatttcaatccagatgcctttattaaatatactagtcattggttttccttttttactgtacctaaacttatgtactaagtcagagaggaaggattagaaaaggcagtgtataaccaacgaacaaaggtgaatgttatttttggcatgttatagatgccttgtacattatcagtttctgatggcttttaaattatttgtttttttttttcagttcaatgtgccggagtattatgttttagctctctgactgactataatttgtagaatgaattgtgaatctagcactgagagtatcttgtttcttttaatcagaatgatggggagcagagaatgagtattccagcaagagaattatttgcagcaattgaggccgactcaggcttgttgcctgtgaacagtagcaacactaatgaaaaaaggaagaggcgtctacagaggctcactggcaaacagtcggaggtacttgaggggtatgtttcttgaagcacatatcatcatttattgaaagctagcaattataattgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttgttattattattattattattattattataattattattattattattattattattattacatcaacaaatatttctagatatatccatctcttatatgttataactagatgatgacccgcgctttgatgcgagatgttagatattggagaaatgatgaaatgatttagattgaaatattacgaaaataatttaagaatgatgatttagcatatgtatgtttagttttagaatgaaataaattatagatataattactgtatgcttatatgttgagctttgtatgcttaatggattgatgttgcatgctgacatgtaggttttaagagtgctaataaatacaatgcttgcatgttgagttttaggtgtttagtgagaattagctttataaaaatgtttagtgggtattagctttataaaaagaaaggattctatcctggttaaatatattgtgtatgttgcagtatggtactcctttctgaggagaatttcatcatgtgggttatcttcatttttcttggatgaacaggtttttcagcatctgtgggcatcccgatgatggacaaaagaggcatctgagtgagacaacaggtcttggtttagatcaagtgaagttttggtttcagaataaaagaacacaagtaaaggtttgttctaaaacattgctatgtactgatgaacaaaaaagtttagtggaatgattaaaaaaaaattccatgacacaatgtagactatgtgctggaaggaagagaactataagttgtcggtggagaatgaaattctgagggatgagaacaggagagttaagatagctcactgcactgctgtatgcctcacttgctgtaattcatcagtacagaaccagcttgccgttgagatggaaaggttaatggggcagagtgagtggctgcaacaagaggtacatcatcttctgatatgttctcctattaaattacaattacttggcatgttgaattttcaattcagtatcttgaatggatttgttcgagctgcaaccatacatgttaaactatgttctcaatatgattcatttatttgcacaatctgatctaccttgtgattaccaatctgcaccctatctaactatagattgtggttacctcctaaatagtttgtctggaatttatttcccaagctccagagtcctatagagactgtatctagaattgaactaatgctgtgttgtttgtttgtcagattgcacggtcgaatggaacacccccggctgcaaaccttgcctttcaacttaattcatcagcagactatgtattttcagggcaacatgaccaacaaatgattgctgaactagccaaaaacgcaatgcacgcattgattattttggccgaatcccatgtcgctctatggtttcccgtccctggctgttcttatgaagtattgaacaagatggcttatgaccaagcatatcctggggataacagtgcaaacgccattggattcaagacagaggctactcgtgcagtttctatggtgatgatggactacaaaagcgttgtggatttcctcatggatcctgtaagtggtatatagattttaatagtgccttgctaaaaagatgtgaatatgaatgcccgtatcaattctttttagataatatttcaagttgcaatttgatctcaatgttaaatttttactgcagtacaactaccgaactttctttcctgaagttatttccggggcagtaaccaacaggatctacacgtggcctaccagtgatggttataatggggttatacaactggtatgtatagactagtagtatatcttatggggaaatagagtgcaggcaaaatcagcagtacttaccttttggtgatatatattcatgtgctttttagttggtactaacagttcttgagaacaacagatgactgtcgagatgatgttcccatcgcccctggtaccggctaggaaatgcacattcctgcgctattgtaatgtgctgaacgaaggattagtggtcgtcattgatgtgtcattggacgatggcagtatcttctccaaatgccgtaaaatgccatcagggtttctgatccaatccataaggccaaacagctgcaaggtattgtgacacacaaacgttataaaaaaaatggccaagaattgttttttaccaatatattcaatcccgtatctgatctgtcgtatgatatcttcttggcaggtcactgccatagagcacgtccttgcggatgacaccggtgttcatgagctctaccagccttgtatgaatggactcgtcttcggagctcggcgctgggtggcgaccatggcgcggcagtctgcacgcatgagagatgttcatcacaacaagacagctccgcaaggtaatggcaacctgtaaaatcctttcggtgcctgaaactctgaaaattgccgcattcctgtcagaacagggagccgtttccagctttgcatgaacaacgtttccatcctttcgttgttttgttgtgtgcgtgtgtgtgtgtgtgtgtgtgtgtctcagtcagcacgaaggggaggaagaatctaatgaagctagcggacgacctgctcgcgagcttcgccggcggcatcgccgccactggcggaggaacgtggaccgtcgtgatcggcgccggcacggagaaggacatcagggtcgcgtacaggaggaccaccgagggcagcagcagctacaacgcgatcctgtccgtcaccgcgtccctgcgtctgccgctgcccatgaggaaaaccttcgatctgctcaggaaccttactcaccgctgcaaggtacgtacacgaaacaaaaaaagaagagaagaaaaattagtttctttcctaattctcgcgaactcaccgcgacgccggccggccgtgcagtgggacgtcctggtgcacggcagcgtggtgaaggaggaggtcaccatcgccagaggcgtcgggaacgacgacactgtcaccgtccttcactgcaaggtaccgcaccacaaaccttaattttgctacctccaccggccatctctcgtgccgtactccggctgactccgacaatatgtgcggtgttgatcagcgcgccggcagggaggacaggggaaggaccatgatcctgcagaacaacgggtacgacgcgtcgggctcgttcatggtctactcccagatcgacagcgagctgatgaacaccatggtcctgagccccagcgacctgccgcccccgggcggggcgggccgtccctctaccccaccggcttctcccttctccctgacgtcgaggctgcccaggacagcagcggcatcgccctcggcgaggttgggggaactctcatgaccatgggcttccagattccggtgaagctcgccagtggggatcgcatgtattcccggtctgcggcatcggcaatcaggctcatgactgacaccattgccctcgtcaagaagacgctgatgaacgagcattctggtatctacggggttagcccgttccacccctagattcagaaaaacaccagaggtaatcatttcattgacaagtttcctgttaaactaggctaatgaagttccatctgattcctgatattatgctagtgttgctgatgagctctcgtctgttttgtacagggagaaaagggaggtccgtgtgcagataaaaatcaagaacatgcgaaggggattcatcggctccgatcaccctgcatctcccagaatttgctgaattaattagaactttaaggttgtgttaacaacctgtaataatgtttttaaggccaaacttatatcgtgtctttgctgtaataatgtagtatgcgcctgatggatgtcgactgccgtgtaccgatgcagtttgcttcgcagagacgcggatacatttgctatcgtatggatgctcctttagaacctatgttgcctcttaatttctatgggtgctattttagaacatcgatgtgcagttttctttgcagatttggtattctatggatgctcttttagaacttaaattgcctcttcaattacctccatttgccttgcttgccgaattggttttgaatatatatttttttaaggaaactggtttcgaaaaccttcactgcacaacttagcaatttttcgaaaaccaaaagtccaaaacttcattctcttttagtttgaagagtaaaaaggaaaaacttacattcttactatgagcccaattgccacaagctgttcgtactggacttgaaacatctagacttcaattttagaatgtttcagttttagtgttgagggcttatcaactatggtggttattcctgctttcactattcaacactatgagagagcagaaacatgtgagctgcttactcagttattcttacatccttgtccgtacaaactattttaatcagaaacatgatagcagaagttccttgtccatgtaatggactaacagtaagaggagtgaatggattggagaatctaaatggaaccaaatgaacacaaatatgtattgcatgagtatttcaggataaacatgatattagctcatttaagattttcatggtttggagattacatcagcgtaaatgactagaactagtacagagacaggtcagcctatatagttaaacatgtattactttaagtaaaagaagaaaccgaaagcgcaccggccttcctaaccttatcaaaatttgacatgatgacaaaacccctcacttgttcatctctgaaggtccgctgcttgttacttccaagaggactatgggatgccatctcagatacgtgccattaaaatcagtcatgatagactgataaaaagattataatgtcatgcattgagaccagcccaattcttaaatgcaatcagagcttccattttcctgaaattccgctttctcagctttgccactttcagttttttgtgggtctccatgaatgcttgtttgtgtctccacttatccaaaaatattttcaactcttgtgctttctcaatcacttgcattgccatatcaaaaaatccacctttgactaaagcatacagaaatgcatcaattaactcatggttgaaatcagcccccttcctcctcacttcagtccatagtataagcacactaaagtacttctccgctgagacatacccattgattagcgaaaggtaggtctgattatttggttcatacctcaggaataccatccttcggtatgtccttcgagcatcctccaacctcccaaccttgcaaaaggcatgtattattgagttccaatcatgtgttgcaatttctatcctcggatcatcgacgactgtgtccaagaatgatgccataagctcaggacggttgttctctgttaagcctgtcattatagtaagatagcttgtcctaaggtctggtaacctcgcctctctcatctccttgaagagagagaatgcagataggaaatcatgggctgtcatagaagcatcaataagagcatcataactgccagcatcaagctgcagccctgctgcactaatctctgagacaagctgtgcagcctctgcagtcctttgctccttgcaatacgctttcaggattgaggagtatacacctagccccacagaggctccttgagcagtcatttcgtcgagtatactatgagccttgttcaataggccaagctcaacacaagcattgacaatcccaaacccaacagaatcctcaactgccagtgactgctgcaatgactcagtttcctgtgctttgatgatcaactgagctaattccctgatccttccattatctacaaaacgctgtgcaacctctgtatagctttctaaatcaaatgcattgctacccccaactcttctctcctccaccacacgaagaatgactgatgaaactgactcaaagctgcagctcttcaaatacccactgatcaaattcttgaaaaaaatcttcttgccgaatcctaacgcatccagcaatttatcgagctcatcaacacggcttggaatatctctccaagcatacaagaacgcaagacatccgaagctatccacattcggcgacactgcaatagccgacatgatctccaataccctctcagcttctgtgactgaaccgagcagacggcagcagccaccaagaacggcattgcaggcagcaaggtcaggacgcatcgccgctgccgcagagggggacttctccgacaccatttgcttgcaggcttcgtcgaagaccttcaagaaggccacgaaggcgcccgtgtcagcgcgcgtgagctctataagcggggagccccagacagggaaagccgggaggcggcgcccgcagcgcagcagagcgcgcacgagggccaaggccggagcggcggaggccgctgcggcgagcgaagtgaagacggcctgcagggcggcctccgggacggggtccgcgtgggggctcttctcgagcaggaacacggcggccgcgaaggcacgcttgaggccgagacggtggtggtgcgctgcggcgaggtgggagacgagcgccgcggcggcgggaggcgagggcgagagggaggccgacgccagggacctgaacgcgagccacgcgtcgtccgagcggtcctcgaagacggcggcgagcagctcgtcctcgagcgcgacggcatcgccgacggcaagcgtcttgtgcgcggaaggtgtaggtgccgacgncgacggcggcgcctggggtttgggccgcggcgcgaagacggaaggctggaggaaggagtacacggtggggatctcatggggcgcaggggagggtgaagacggcgagaaggccctcgtgtttatgggcagagtcaaccggcggcgaaggcgaagaagagcgcgcatcggagtctcggagaggtttgccgttcaggtgttcgagcctttgccaacctagtctcaagaatttttcaggaaagcccctagtcttctcaagaagatcgtatctatctgaaggtgaaggatgtcatattagtcccgcttcacatattatagtactattaaaaaatatagcaaagttctagagtttaaatctattcaaaacatagcagctagaacatggagtataaagataacgtttactactccaaccatttcaggttataagacgttttgacttttgtcaaagtcaaactgtttcaagtttgactaagtttataaacaaatatattaatgtttataatactaaattagtttcatcaaatcgctaattgaatatatttttataataaatttgtcttgggttgaaaatgttactacttttttctacatacttagtcaaactcaaagtagtttgactttgaccaaagtcaaaacatcttataagttgaaacggagagagtataaatcacccatattacatctattatctcttgactctattataatccgagtcagcgggttatctatcctgcgaagataagtagctatttctaccataattccttcttaacattcgctatcacctaaagaattataaattattacattttgagacaggggaccaagggagtaaactagtcacttcttttttacacgttctatttggcatcatagtcaagcatccgaaaatgcatcccagcacaagtcatttttagacttccacacgaaccaaaccagacgaaaaaaaatctcaatttgttggttagtaatttgtgcagtgttgacaggcagagtttctcagcacaaacaagatttgcaatggcttcttctaatagaccggtaataagaactaaaaccagaatgacggagcataataggcaagacaaaagaacaaacgaccatcaccagcttgacgatatcaacatttcttgcattctgaaggaacggggtgacaattctaggaagcaacttatcaggtttctggcactgaattcatttcagtggcacagctggatgtaaacattttacatgcagtacatcatagcacgacttaccattccctcaaacaggcggtagaaaaggcatatcattacaaatctattactagcatacatttggttattcatcggaacattacaataagttgcccactcacacaaatcagctagtagaacatactataagatcaaaactgcaactatatgattggaccaaaactcatttaatacctttcagccaacctggcagaaacggcccttagctttgaatacactttgccagcaggagaacctaagatgagactacagagtgaatcccgagcaaccttgatgttaacaaaggatccaagtatgtggatctttgtgtcagcaataactatgcgagtcctggtagaattctcaatggcgtatttggtcttgcctcctttccctgacaaacggccaatagcacgtgacagatgctcaccccggagtgtcttcacatccttgatctcgaaggaatccacatacaagtcatcaaggcggagcaatgcaacggcatctgcgatgtcaaatccaagcataaaagcatgcacgaagtctgcacacttctgaagattgctcacatctggtgtgtcttgccttgtttttagctccacccttcttgcctgggataacagaaacaggttgaaaagcttgatagtggatacagtgcaggcatgagcattcaatattaaaatggtaatacaggattttctttttcagaaagtaaaataatgtaagcactgatggcagtcgttgcgttacctaaaaaacatcagagaaaacatggtagccaccattcgagtttagtaataactgaaaattcacaagaaaaccaatttacctacacgttttagacacaacctgcattcttcttgtgatttgtacttattctgcatcactttcctttactgaattggcatagtacattcatagtactaataaccacgtgtttggcaaacttgaatcgaaatacaaataaccaagtgtttggcaaacttgaatctataagcaatactaacttaggttcctttttttttttggggttaaaatttttattttccccccccttttaaattcctatattcagtcatattgccaaaactttgttgttaaaaccggactcatccatgaaagctcttacaccagacgcatccatgaaaggctttccagttccaatgaggaatctacaacataaggaatggccataaaaggagcacacttttacaccatgatccactgaactaaacagtaccaccatttagtcctagcaccagctaagatatcctctagcaccaagcatgtcactaccaactttgtaacagctgcgataattgttctaactattactatatggttcacacaatcgcttaacctgtaaatgtctaagatgaaacttttacaccccggcgtcatgctcaaaaatcacgaagcctggcaggacatgtctcacccttcgcaattcgcaaccacgttttttttaaaaaccgaattcgcaaccacatattacacgaaagcccaatttgaggccccgaacaacagaatcataagtatacaaccaagagtgagtttttagcatcgggtttatctaccttcaggttcatgcgtatgtcgatcttcatgtgctcgtagacgggcgtgtagatgtccatccacgccttcttcagcggagcgaagcggtgctgcggcaccggcaccttccggaactggggcctcccgccgctcatctcgctcggcatcagcgcctcgaaccgcggcttctccaccgccatcgcgccggcggaggaggactcccccgcagcggcggcgctcgcggccctgtcgacctccatctcgtcgcggcggcggaggcggaggcggcgagcggctaggttttgcttgggggtatgggtatgaagctactgggccaaaacataagcacaagaaaggaggcccatgacaagaagggccttcgttaaaattcctcgcaattgtttctgactaaatcgtatccgttaacggacgatcggacggctcccttgaaccgaccccaaatcttgccagtcagcttgggattggacaactggtttgtcattggtctgtccaatgatattttctcattataaatttgtttttgattttcgacctcatgtaacaaaacactctcaagttcactttcaaattcaaagagctcaagatatgtcaagagcagcaaaaggctgagaggtaccatggagaaagcaatatgatcaaacagaaaccgcaaaggattagtgcctacaaattgtcttgtttgctccattatagtccagcagtcacgagcacaaaataaacagaaacaggcaaatgcttaaagtctctaacaccattacaccaagtcagttccaagggaagataaaatgcaggcttcatgcggccgcgaaaggatggaagcacaccctgcaggactctagaaatcatcgtagtcatcatcatactcatcgctatcagtttcagggttactgtcagcataacggctttcgtcgacccattctgggtttttcttcgccatcttctcgaagttgcacagctccttctcccgctcctctatgatgcgcctgttctcagcccgctccatctcttcgatatcttcatagaaattaacctgtatcttctttgggttaatcccatttgctgccagaacattcaccagcttgttgatcccatcatcgcccttggaacattgtattatgacagtctcaaggaacggacattggaaggtcattccatcaattggcatagcatctgtttctgctccttttcttgctgcgtgaggaagctagagacataacaggaaataaataaaaagaggggtgtatttaatgaggaatttccaatatgatgcaagatttttacgtgcggcatacctcctcttgcatcaatgtcagttctcctagtctcggcgaaagttgaaggaaacgaagcacagtatagaaatcctcagttaaacaccacttaccaatttcaagagttgtgagcctctcaaacactggacatgccggcagctccttttccaacataaccttgtattgagtgagtgagcaagtcataactaagaactaaaaccaggacatttccaaactccaagcataataacaatgtaatattgacatgtgaaagaaaattccacattcatcccatgagattaccgtgagaccatatcgtacaaatttttcatactacagctgacagctttgaaagttgtatgggagaaactaacagatcaaaggaactactaattactgaactagcaaacttactctttttgcaggacacatatacgaagggcaaaattagaaaagatatacagcaagtagacacagacacagctatgatctgatctttccagaatagaacccttttttccatatcaaatccccaagattctagtcggttacacaagccctagataccaagttggtatagtttcaagccatgcacattttcattcagagtagttaactagaataaatatagtcaagatttttgcaaaacaaaagagtagagaagtaacaaaagacagcaggcttgtcttttgcgaatataccttgacgtcagaaccaaatagtgcgagtgtcttggcagataaaagtactccaataaactcagattcaccatcatatttcttcccccaagtatctatgtgtgcactctctagagatggtttctctccccaagaaacatcttgcagtgcacaaccctgcccctcaaagtgaacgagatgaggggcggaaattgtgaatcttttgggcccatgcatgaagccatcaagagttagcctttttagcactttggaggcaatcagatcaagatatgttgccgagtttatcaaatgcaaatcttctaggttagggctccgaccgatgaattggttcagagaaagctggtccacttctacatcagagagagtcaactttttgagagaaggaagttgaattatgtccggaagcacaaggcctacgtgttcaagatcttcatcaggggcttctcccatctgcaaacttagctcctcaactgaacggcaggtgaaaatgcgagacggtaaggcccttttatcatacatatccagttccacatcaagcactttaacattgtgcttcaccgcatagaggatccacttcctaagatcattgcagttcagtggaagataatgaaaccaataaagctggaaagtatgcaggtctactttagaacggatgagtaataggttgtccacaaagcgagcaaatttctcaaccttccaatgtttaaaatctctgtaatcaaggcatatgaactgcagacactcaatcactctcatccacctcctagaaagcctgcgcatcctcacaattgctctaatccttgaaaaggacaggatatgctgtaggacctctccaggcagcacactgatcaaatcagtgtcactctccattgcatgctcatcagtggactccatatcaaccctacttcagattccttaaccacctgacacctgccatgcacacggttcacagttattaacacattaagtaatgatatccccccccccccccccccttctttaaagtgcaatgttctggggacggcccatatcatgtaaagcttatatttgttcaattggccccttcatgatgcaatgaagtttggtggactctcatcatgattgcaatgactgggccaccaaatttgtgttcacagagcagggcaatctctagcagacctaaactgctttgcacagcacacaatagaatgatccattgcttaaataccttatcagattgataaaacataaaaccactaacacctaatcaagtcttctcttacagtagcaaatcggatcagattgatataaatcccacttaccatcaaacgttgtcactcaggctttggtacaccgatccgaaattcaaaaccgttatatgtttatctttga

SEQ ID NO: 19001 - DNA, 1154 bp, Oryza sativa
  unsure (1)..(1154): unsure at all n locations
nnnnnnnnnnnnnnnnnnnnnnnnnnnnnnnnnnnnnnnnnnnnnnnnnnnnnnnnnnnnnnnnntacttccacatatccactcagaggaaagtcttttcgtaatggatgaccctcgaaaccataatctgttgatatacggcgtaaatccggatgattgatggaagaaacaccagacatatcccatacttctcgctcccaccggccggctgatggaaatggactgactaccggagatattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaatggaaatgggtagtcagtattggtataagatctattcccatgttccgatcttttcattttatgtacccatttcttgggtaaaatctcccaactatattggaaaatggattggttatccataaatgaaaataaagaaagcttgattttggttccgcttcttgctctaagcagaaagacttgtcggaaatcgccggttgggttggtccgaccaagaaaggcatgggagtggagaggcggaagtgaaagactggctaccaataaagatccctcactgcacactttatatagttctgtatccaggatcggctgcatgctctagtgttgaatctggtatagaacccaggatgcttggttacaattccgaatacgctaaaccatgtttgttttatttttttttctcgactggccatgggtaatgagtttcgatgtattgggcgtttccgtttagaaatataagctttttcgtgcttgcttgcgagcattggaatggcctgaatggaatgaatattaagataaataaaagaaagaaaataaaccattgagaaagttattcattcttatattaatttcctatacttgaccgaacaacttccaattccgttatttcaactacaccaaatgatctttcgaattggtcaagactctcctgtttatggccccttctatatggttgttgtttcattgaatttgcttcaggctcgcgattcgactttgatcgttatggattggtaccaaaccaagatc

SEQ ID NO: 19002 - DNA, 4568 bp, Oryza sativa
ccatttattgtgcatcatcctagtagagtacttgtatctatgtcaattaaagggactaaaaaatcaaaaagtattctaaaattggacttagtaaatgtcaggatatatggattgtgaattacttacttaataatagggattacttgcctatactataatatgttcatttgtatgaatgggataaaatccaaagaagtcagttcggatccgtttgtgaaagagtagaaaaagaaagatagtgaatcttgtttgaaccattaatgaaaaatagaggttggtacaatagttaggaagtaaaatgggctttttattggggatagagggacttgacttgaaccctcacaatttataaagtcgacggattttcctcttactataaatttcattgttgtcggtattgacatgtagaatgggactctctctttattctcgtccgattaatccgtttttcaaaagatctaaagaatgaatgatttgattactcaatattcgattcttctttcaccttcgattggaatggattcacaataattctgaattttatcctaatttattatttcataatcattcataatttatttatatatttatataatccagatgttgatacaattcattttttttagtacttcagttgattttgctttgtttatcccagttttaatttggattttgtgtgaaaatgaaaaaaaagaaaaaaaaggagtctttatgtctcgttaccgaggacctcgtttcgaaaaaatacgccgtttgggagctttaccgggactaactagtaaaagacctagatcctgaagtatctttaaaaaccaattgcgttctgggaaaagatcgcaatatcgtattcgtctagaagaaaaacggaaatttcgttttcatgatggtctgacagaacgacaattacttagatatgtacatattgctggaaaagcaaaagggtcaacaggtcgggtttgactacaactacttgaaatgcgtttggataacatcctttttcgattgggtatggcttcgaccattcccggagccaggcaattagttaaccatagatagacatattttatttcacggtcgtctagtcgatatactaagttttcgttgcaaactccgagatattattactatgaaggataaccaaagatcaaaacgctgattcaaaattctattgcatcatccgcccacgaggaattgccaaaacatttgactagtgactcattccaatataaaggactagtaaataaaataatatttagtaaatggtgaaaataaatgagttcttagtcgtagaatattattctcgtcagacttgaacctaacgaaaataagaaaggttcataaaattatttccccttttcgcggaagggccttaatccgtattttctcattcaattccaatatcttgatttcgagtggcaatgcaccgtgaaccgatatatatatcgtttgctaatacacgaccaattaatgtttgtacaaaaagtttttccgtcatcccattttgaggactcacagaaatagcttggatagtaccacaatctcttctacgcacaataatatgttgaactacttcaacaagtctacgtgtaagatatccagcatccgccgttcgtacagcagtatctacaacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatgaaagccaagcgttttatctgatccccgtatatgggatgtatatcccattccgaaatgctctattaatctgctaataagtcgtttcatagcagttccatctatctctttattctgaaagaccagattggcccgttccgccataaataagtaccccctttttcggctgagtataattcgacaattgctgagtaggattcgacaatgggcctgagtcagtgattcgaaaacttagttaacttcctttcctcaatctcaatctggattcgtgcggcaaaaatgatgatactagcgaaatcggaatgcccctcgaaaggggcatccccgaatctaacttccttgtttagatagtgtatgaataggcctgactaaatccttgtatggcttcctctatttctctataaaaagaaatatgaccaagagtggtgcgaatgtatatagaacggatttccttttttctatttcccactactagatagtgggcataaatctcacgataagtccccaaagattcatattgaacttcaatcggaacttctcttaacccaatgacgcgttgatctagtttccatcggagccacaagggactgtctaaacagatttgtttctgtctataagctcccagtgcatcataggaactagaaaaaagagattctttatctttcgtatacttaggattattattattggaatttactcttttggtttggatagtttccgcaactattatatctatttgcacaaatacctcgacggtttccaatcgttaatacataaagtccgataagcatgtcttgggttggtacgcaaataggatccccaatagcgggagataggagattcatatgagaaaacataagtaaacgagcttccgcctgagcttccaaggataaaggtagatgaacagccatttgatccccatcaaagtctgcattgaaacctttacacactaatgggtgtaaacaaatagtacgcccctctactaaagtgggttggaaagcctgtatgcctaatctatgcagggtaggtgctctattcaacagtacaggatgtcccctcataacttcttgaagtatttcccatacaatgggttccttttcccaaattttccttttagcaatcctgacattagaagtagcacgtttcgtgattaaatcgcgaattacaaatagctgaaaaagctttattgctatctctagaggtaacccacattgatgtaatgaaagtgaaggacccacaacaatgatagaacgccccgagtaatcgacccgtttcccaagcagagtttcgcgaaacctcccctctttaccttcaattacatctgaaagtgatttgtatactttattgtgaccatccctcgttggttgcccgcgggacccactatcaagaagtgtatccacggcttcttgtaccaatttttcctggcacattactaaatctgctggcgctaattcacttctttttaatagataggcaagattgttgttccgacggataactctcttataaagttcattaatatccgaagtcactactttatccccagacctataaacaatgggtcttaattcgggaggaagaactggtaataagcacaaaaccatccattctggttctacatttgtttgaataaaatgtttcgccaattgcatgcgtctaatcaaaaaaacttttcttattcgtctttttcgatcttcccattcatctccactatacccctcgtcttctaattccttccattcgaccgaggaattctctaaaataattcgcaaatccaaatctgctaattgttctctaatagcacctgctcctgtcgcaatttcccgatttcgaaatgttgtaaagcctggggtagaaaaaaagggggaaatgctatggttacaggatgaaatttcatcctcgaataaacctcgtaatcgtaagaaagttggttttttagcactgggcctagcaaaagagaaatcgccatatactaggccctccaatttcttaaggggtttatctaaaagattcgcgatataactaggaagaccttttaaataccacacatgagtcacgggacatgcgagtttgatgtatcccatttgatatcttcgtatccgagaatcaacaaattctactccgcatttttggcaaaatctttcgtcttcgttttcagctccgctcgctcgagaatttccacaagcacaaattctgctttttatgggtccaaagattctttcgcaaaacaatccatctttttctggtttatcggttttataatgaaaagtggagggccttgtgacttcgccaacgacttccccattaggtagtgttttgttagcccaagcctttatttgttgaggggaaacgagtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaaca

SEQ ID NO: 19003 - DNA, 1696 bp, Oryza sativa
tcggtacccgctcctggtgcaacaacaagtaccagcttaacgtggggaggtggcgagttagtagcagtaggcggcaaagttgctttgttacctattccattaggaaccgcagattttttagtccatcacattcacgcatttacaatccatgtgactgtattaatacttttgaaaggtgttttatttgctcgcagttcccgtttgatacccgataaagcaaatcttggttttcgcttcccttgcgatgggcctgggcgagggggaacatgtcaagtatccgcctgggatcatgttttcttaggtctattctggatgtacaattccatttcggtagtcattttccatttcagttggaaaatgcagtcggatgtttggggtactataagtgatcaaggggtggtaactcatatcacagggggaaactttgcacagagttccattacgattaatgggtggctccgagatttcttgtgggcacaggcatcccaagtaattcagtcttatggttcttcattatccgcatatggtctttttttcttaggtgctcattttgtctgggccttcagtttaatgtttttattcagcggccgtggttattggcaagaattgattgaatctatcgtttgggctcataacaaattaaaagttgctcctgctactcagcctagagccttgagcattatacaaggacgtgctgtaggagtaacccattaccttctgggtggaattgccacaacatgggcattcttcttagcgagaattattgcagtaggatagtggctaggaggatttgaaaggcattatggaattaagatttcccaggtttagccaaggcttagctcaggaccccactactcgtcgtatttggtttggtattgctaccgcacatgatttcgaaagtcatgatgatattactgaggaacgtctttatcagaacatttttgcttctcactttgggcaattagcaataatctttctatggacgtccggaaatctggttcatgtcgcttggcaaggaaattttgaatcatggatacaggatcctttacacgtaagacctattgctcatgcgatttgggatcctcattttggtcaacccgctgtggaagcctttactcgagaaggcgccgccggtccagtgaatatcgcctattctggggtttatcagtggtggtatacaattggattacggaccaatgaagatctttatacaggagctctttttctattatttctttctaccctatccttaatagggggttggttacatctacaacccaaatggaaaccaagcctttcgtggttcaaaaacgcggaatctcatctcaatcatcatttgtcaggacttttcggggtaagttctttggcttggacaggacatttagttcatgtcgctattccagcatccaggggagagtacgttcgatggaataatttcttagatgtattaccctatccacaggggttgggaccccttctgacgggtcagtggaatctttatgcccaaaaccccgattcgagtaatcatttatttggtaccactcaaggagcgggaactgctattctaactcttgttgggggattccatccacaaacacaaagtttgtggctgaccgatattgctcatcatcatttagatattgcatttatttttctcattgccggtcatatgtatcgaactaacttcggaattggg

SEQ ID NO: 19004 - DNA, 2453 bp, Oryza sativa
  unsure (1)..(2453): unsure at all n locations
nnnnnnnnnnnnnnnnnnnnnnnnnnnnnnnnnnnnnnnnnnnnnnnnnnnnnnnnnnnncattagagattacaatccggaacagaatgaggataatgtattggcaagaatgttagaccataaagaagctatcatatctcatttaagttgggctagtctcttcctaggattccataccttgggcctttatgttcataatgacgtcatgcttgcttttggtactccagaaaagcaaatcttgatcgaacctatatttgctcaatggatacaatcggctcatggtaagacgacatatgggttcgatatactcttatcttcaacgagcggtcccgctttcaatgcgggtcgaaccctatggttacccggatggttgaatgctgttaacgagaatagtaattcgcttttcttaacaataggacctggagatttcttggttcatcatgctattgctttaggtttgcatacaactacattgattttagtaaagggtgctttagatgcacgcggttccaaattaatgccggataaaaaagattttggatatagttttccttgcgacggccctggtcgcggcggtacttgtgatatttctgcttgggacgcgttttatttggcagttttctggatgttaaataccattggatgggttactttttattggcattggaaacacatcacattatggcagggcaacgtttcacaatttaatgaatcctccacttatttgatgggatggttaagagattacctatggttaaactcttcacaacttatcaatggatataatccttttgggatgaatagtttatcggtatgggcgtggatgttcttatttggacatcttgtttgggcgactggatttatgttcttaatttcctggcgtggatattggcaggaattaattgagactttagcatgggctcatgaacggacacctttggctaatttaattcgctggagagataagcccgtggctctttccattgtgcaagcaagattggtgggattagctcacttttccgtgggttatatattcacttatgccgctttcttgattgcctcaacatcaggcaagtttggttaatttttaaaaattgtgttagtaaaatcgtcttgattttacacgatttcactatatttcttaccctttaaccatcagcgtgcgttgcgtgattccactgtgttttttgcacttgactgggtggacagttgaccggaacataacttcgattcgcccgaccagcaggcggtcggcgtgcttatcttgtgtgacaacactacagagcgagtagctcttctagtcgggcagctgtgtgacaacactcctgagaaagcggcgcttttgtgtaacatgctatggtctcaacgccctaactaggtagtgatgagtttcacgcgctgtaagcatggcccgcgcgcagttagaaggattggccgctatctgagcggtaccacccatcctaccctactacctatagggggccgtccgtcctacagccgcccgaaaaggaactgcagtaatcttgaataggaatcctacagcgatataaagaatccccataaaaataccactagattgagcaccagtgatttcgtatccggtcaaaatcttggctaattgatcgaagtgggtagctccagtagacccatagatcatggaacaaatagggtgggtaggcccaaccaccacactacacgtatagacgcgaacccccctccttaccgtacgtgcgactctcactgcatacggctcgcacaaagactccaaaatccatcccgagctttttattccacctctcctccccaatcttcgatcaaactagccttccccagcaaagaaaacgtatccgcacaggcgcaacaaagcgctcatcgcttgttcttgagcgcgcaaggcgctcaagacggtgattcttgcttcaaaactaaagggctaaagcactccagcttcgaagctggagtttgcaacttcaaaactacaggttttagccctcctgctgggtgggcgcttccttcgtctatcgtatgcctcgcttggcttcgtcccgaaccaaggaggcatgatggcgggcgcgtgcgtgtgccgactgcagagactacaagccgacgccgaaagcgactcgcttctattctcgattggatatagatggggaatctctatagatcgtcttttttcgacaacctctctaaaacgcatacgagaaaattgcacttcacggcacggccaaaaaaagaaagagcttcgctcggttggccctcctaggcttccgcctactttctcttctcttaagtctacaacaagtgggagaggcaggattcgaacctacgtagaaaaccttcaacagatttacagtctgtcgcttttgaccgctcggccactctcccctccccggggatnnnnnnnnnnnnnnnnnnnnnnnnnnnnnnnnnnnnnnnnnnnnnnnnnnnnnnnn

SEQ ID NO: 19005 - DNA, 1466 bp, Oryza sativa
atacgagaaaattgcacttcacggcacggccaaaaaaagaaagagcttcgctcggttggccctcctaggcttccgcctactttctcttctcttaagtctacaacaagtgggagaggcaggattcgaacctacgtagaaaaccttcaacagatttacagtctgtcgcttttgaccgctcggccactctcccctccccggggatacgcccccctcaaacaaagggttcctgaataagaaggaccttcgttcttaagttaagaagagcagatgggaactattagatttgctagcgttccgggagaataaataaggtcatttagtaagttcataacaatttctgtaaagcaaggggcaaagcttctacgacagcttccccctcattgccatcgtcggccttccccagctcccctccttcgtcgcttctggctaagcatctttcggcggaggaaaggaggcgactagtcgcttctggcgaagcagcgagttcatgagcaagtgaatgaacgagctgcgagtgaagtgcaacagtcgtaagtaaggctcgccgtgttcctaaaagaagtgaccatcttttcttcccttctactgacactgagcgagcagcaagcataggcaatagagtcagcttacggggtggggcgcaagcaagcgttttcaggctccgctagctagcgtactcttctgctatcaatgaaaccgaaagaaaaaaccagtgccctttcgtatagatcgagacgcagtactttttctttacttcttccatactaggaagaatggaaggaaatccttcgataacacttcttccttatttgaagaaatgatatccgacgcccgtggaaactctttcatttcaaaaaagttcttcttcttaagaagcaaatagcatttcctattgatttgtctcctggactagactagttatgtagattcggaattatccgtcgctacgctgttcccaaggactagcaaaatcgaaatagcgaaattcttgggtcatctcaatgggttcagaaaccacacgtttctctggatcatcatagcgtacttccacatatccactcagaggaaagtcttttcgtaatggatgaccctcgaaaccataatctgttgatatacggcgtaaatccggatgattgatggaagaaacaccagacatatcccatacttctcgctcccaccggccggctgatggaaatggactgactaccggagatattcgtgttacttcgtctgcacttgtttgtacacgaatgcgtgagttataccgagtactcagtaaattatggacaacttcaaatcttcgttttcgagagggatgatccactccgcaaatatcgatcgaaacttgaacccttgtataggtatgccattttagaaagcacaacaattggaatgggtagtcaggattggtataagatctattcccatggttcgatcttttcattttatgtacccatttcttgggt

SEQ ID NO: 19006 - DNA, 145 bp, Oryza sativa
aaataggaagaacgtaaatcttccacctctggaaagcgcctacacctaatggcttaagccgctgttcccatttcctcgctgacccatcatgcgaaaggtacgccgttagagtgagtgcgcccgcgctccgctccttcgactgatt

SEQ ID NO: 19007 - DNA, 489 bp, Oryza sativa
  unsure (1)..(489): unsure at all n locations
nnnnnnnnnnnnnnnnnnnnnnnnnnnnnnnnnnnnnnacctgaagtcatttggcgttccccttttaacttacctactactgtaccagcggggatatgatctaccccagacatacgcaatgctttagctaatacacggaaatgcataccatgatttttctgtctatcaataactggatgcattgctcggagaatgtgaagaaatccgccgatgttgtggcaataatgagccacactagcatttggggcgaatccccccgattagctgacatgcattacaataggaacccctaattacctggcacatacagcttttttaatcatatcttcggatgtacctgcaatcggatacaagtaatgccgcttaaaatcaccggcttcggcctgtgatttataaatagctattgcaaaaaaaacaaaacggtgcctgcttgcttcttccttaatccgggctgggcacgtactccacaattgaacttagtttggctag

SEQ ID NO: 19008 - DNA, 508 bp, Oryza sativa
  unsure (1)..(508): unsure at all n locations
nnnnnnnnnnnnnnnnnnnnnnnnnnnnnnnnnnnnnnnnnnnnnnnnnnnnnnnnnnnnnctttaccaggactcactagaaaaacacctaaatccggaagtaatctgaaaaagcttaacatggtggttaaccgtattatgaaagacggaaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgttcgggtcgaaatatggctttcaaattaagttccgaattagtagatgctggcaaagggggtgggggtgccatacgcaaaaaggaagcgactcatagaatggcagaggcaatagaagctcttgca

SEQ ID NO: 19009 - DNA, 693 bp, Oryza sativa
ttgtaggaactacccgtaataacgagcttgcaaaatggatctgtttatcataaagagattcgttgttcctgaccctgcttcaccttaattgttatttgaacaaaaagatcacaataaacttttggtaaaagttctgtcttggtcggagtggggatagcatttctcttctgcatatctatggagttttgcaaaacccaaacacctcagagatagatatagaggtaggaatttgtcgaacgaaccacactccttcgtagacgtcaggagtccattgatgaaaaggggctggggaaagcttgaacccaagtcctacagtgatggatataagcgcaattgaaattcctggggagttatacatttgtgtattgataagaccgttcacaatttcttgaagctcgatctcccccccagatgaaccatatagccaagagaaaccatgaaccagaatagaagagcttgccccacccatgagtaaacatacgtttcatagcagggtcgggggaaagaatggtggcagtaccaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcagg

SEQ ID NO: 19010 - DNA, 673 bp, Oryza sativa
  unsure (1)..(673): unsure at all n locations
nnnnnnnnnnnnnnnnnnnnnnnnnnnnnnnnnnnnnnnnnnnnnnnnnnnnnnctatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccggtatcgaggacctcgttttaaaaaaatacgccgtctgggagctttaccaggactcactagaaaaacacctaaatccggaagttatctgaaaaagcttaacatggtggttaaccgtattatgaaagacggaaaaaaaatcattggcttatcaaattctctatcgagccgtgaaaaagattcaacaaaagacagaaacaaattcactattggttttacgtcaagc

SEQ ID NO: 19011 - DNA, 716 bp, Oryza sativa
accgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggtgtagtgcttttatcccctatgctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcacaccatctctataataag

SEQ ID NO: 19012 - DNA, 1157 bp, Oryza sativa
  unsure (1)..(1157): unsure at all n locations
ttccccatgggtatctggtaaccacgtatgtaggggtataatcggcaattgtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagatagtcaggaaccttcttttgacttgaccagcttacttgtatagtatagtagtaggcctttgcttctgaacgaccttacgaatggatcaactagaaatgaatcggtgtcataaacgaatttagctaaccgtagtagtaaattgcgtgacaccaagcaatcgatcaaagccaactcaaaagaaagcccatcccttcatccaacgtgaaaatattctcaagaagaagccaaaagaaagagaggtgaaacagagtagagagaatcgggtgcttccagtgattagttatcagaaagcactgttttccagatcggattcgatcacagtcccataagcagtagggaccacgagtgagcatgagcctatttcgtgatcggctagttgctcaaaaaatcgtataaaaatcaagcaagaaaacgtatgcgctttagcaacaaagcgctcatcccttgttctttcgcgctagttgctcaatccgttgcttgcttctcttctgtcttggaaaagtgaggatttcctatctgatccaagggaaggaagagaggtggaaagtgttgctgtgtcaaatcgagattgtgtgggtgttcagtctaccgctcatgttcgacgctatcgaaaatcatgcattggatggatgcccgggcattgagaaggaaggacgctttcagaggcgaaaggccatggggagagagagcgtctgtgatccatggatctccgatcgggaaaccgtatnnnnnnnnnnnnnnnnnnnnnnnnnnnnnnnnnnnnnnnnnnnnnnnnnnnnnnnnnnnnnnn

SEQ ID NO: 19013 - DNA, 644 bp, Oryza sativa
  unsure (1)..(644): unsure at all n locations
nnnnnnnnnnnnnnnnnnnnnnnnnnnnnnnnnnnnnnnnnnnnnnnnnnnnnnnnnnnnagcaaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagctggtacttgttgttgcaccaggagctgttacgctaggcgcgccagcatggagattttgtacccattgagcaaagatcggttgtaattgtatggcggtatccgaaaacatatcttggggacgacctaaagcactcatggtatcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccggcaatccacatgtggtgtgtgaacaaagaaaggtgtgtaccatagtcagtagctaggtatggataggggggcatagagtacatatgatgagctaccacaatgg

SEQ ID NO: 19014 - DNA, 657 bp, Oryza sativa
caacccctttgcgggctccgtagcaggaaattatatattctgtcaaagaaagtccctcgcgtaaattgctttgaataggtaaatcaatcatttgtccttgaggatccgccattaatcctcgcatacctactaattggtgtacctgcgatgcatttcctctagctcctgaaaaagacattagatagactggattagaaggatctgttatccgaaaattcgaattcatttcgtgtttcaaatattcacttgtagcataccagatttcaacggattggcgtaatttttctaccgcgtgtacagccccataataatagtgtttttccaaaagaaaactctgttgttccgcatcttggactaaccatcccttagagggtattgttaaaagatcctcgattcctaatgaaatcgatgtagtagtggcttgatggaagcccagcgtttttatttgatccagtatatgggatgtatatcccattccgaaatgctctattaatctgctaataagtcgtttcatagcagttccatctatctctttattctgaaagaccagattggcccgttccggcataaataagtaccccccttttcggctgagtataattcgacaattgctgagtaggattcgacaatgggcctgagtcagtgattcgaaaactt

SEQ ID NO: 19015 - DNA, 1685 bp, Oryza sativa
  unsure (1)..(1685): unsure at all n locations
gtccaatttgaagttgttgatgtttatattggtcaatcataaaatagaaataagaaaagaatttatatttattccgatcaaacttcttccctattaacctggaagttcttctgagatacaaggaaatggttcagttctagagccaaagatcgtagttctcgaacaagcactcgaaaagattctggaggatcctcgtgattaggtactcattttccccagatcgtagcgttaagtatttcttggcgagctataagatgatcagatttataagtaagtatctcttgtaaaatatgagcaacaccaaatccttctaaagcccaaacttccatttctcctattcgttgtcccccttgcttggctcttcctctaacgggttgttgtgtaacaagtgaatagggcccagtagagcgtccgtggattttctcatcaacttgatgaattaattttaagatataggacttccctattagaacaggctgttcgaaggggtctcctgttcttccatcaaatattctgctttttcccgggtactcgggttcaaatacccacggaatgtttgaagtcattacccttaaccgtaaggagggggatgcctaaggctaggcttgcnnnnnnnnnnnnnnnnnnnnnnnnnnnnnnnnnnnnnnnnnnnnnnnnnnnnnnnnnnnntttagggagagctaatgcttatgcttattgggtattttggtttgacactgcttcacgcccaaaaagaaggcagctacgtctgagctaaacttggatatggaagtcttctttcgtttagggtgaagtaagaccaagctcatgagcttattatcctaggtcggaacaaattagttgatagtgataggatcccctttttgacgtccccatgcccccccccccccgtgtggtgtggcggcatggggatgtcaaaaggaaagggatggagtttttctcgcttttggcgtagcaggcctccctttgggaggcccgcgcgacgggctattagctcagtggtagagcgcgcccctgataattgcgtcgttgtgcctgggctgtgagggctctcagccacatggatagttcaatgtgctcatcagcgcctgacccgaagatgtggatcatccaaggcacattagcatggcgtactcctcctgtttgaatcggagtttgaaaccaaacaaacttctcctcaggaggatagatggggcgattcaggtgagatcccatgtagatctaactttctattcactcgtgggatccgggcggtccggggggggcactacggctgctctcttctcgagaatccatacatcccttatcagtgtatggagagctatctctcgagcacaggttgaggttcgtcctcaatgggaaaatggannnnnnnnnnnnnnnnnnnnnncccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccctgggaaataactccgatgggcagaaaaagg

SEQ ID NO: 19016 - DNA, 6461 bp, Oryza sativa
  unsure (1)..(6461): unsure at all n locations
nnnnnnnnnnnnnnnnnnnnnnnnnnnnnnnnnnnnnnnnnnnnnnnnnnnnnnntctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcctcttatggctagatccaacctcctggtccctgcggaaaggaaaaagaatttcacgttcttcctttcaggaagggaggattagggaagtcctattgattgctgctttctccagaccgccgggaaaagcatgaaaaaaaggctcgaatggtacgatccctccgtcaccccagaatgaaagggtgatctcgtagttcttggtctgtgaagatgcgttgttaggtgctccattttcccattaagtaaacctccgtagaatgtttttggtccttaagtaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagtaagcgggtggtacttcgatcgcggcccctttcctttactttcttttttgttaagaattgaacaaagaatttggggaagaaaacatctccccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccatcgaaccttaagggttccagaaccctccttttttgctagttttcggaaacggaaaaccctgaaccaggagcagtataaattctactgcccgccttttacaagaaaattggtgataaaactccactacagtttgttcaaaatgcaccaatcagaatcccttgagaatattcaagtaccctatttctaagatatttctaagagaagaggtacctgctgaaaatcgcttcaacaaatctgcttaagaaaaattgcaaagttttgaactcgaaggtttttccaagggatgcctgttaaaaattgtttcaacctctcaccaaaacagacaagaagtatatcactgaaaattaatacccagccatacgggtatatgaagggcgcgaattcgtttataccccacccaattagaggaaataaaacataaatggagaaagttttcatgataagatcagcccataggagaaaaaagttcctaaattttcagaccgttctgagcatgtgaaaagtcaatagcctaaagataaaaaaccctatactttgtgcaagtgattagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtggagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattctcatcttcattactactaatagtaattttgtgcatatagaatgctggttttaagaactattaatatagatgaatagtagttttcctctagcattaatagtacgctaggtaaacttattctatattggtttgatcttattaagaatcttttgtagcgagatcatctgaaaaccaatttttgccatgcacgttcagtacattttctggtcacatactcacattggtagatttctgttaggatccaaagagcaagaacaagaacacacacgcaatgatagggatttgacaactaattggtagtctattgctctaatccgacaggattaagccttccgccgccttcgccgcctagttgccagttcataccatttcatcttgggttcccctgttttatacaagtatcaggtacattacccactctctctctctctcgaattcgcatcacacacgcaacagccagctgtacagtgccaactggattacacagcccattcaggcccatggtaacgggggttgggcttcatcgttcttgatggcctaactggcacttgagtattggtctgaatgtcctcctcctcatcttggcgccttatgccctcagagtcttgatcatcagtaggttcttcatcagcttcaggttctccttccttctcctcctcttcagctggaacagccatgtcaggtaggcacctgacaatcccctccccttgaattttggcttgtccccaagccaaagcattaggaaaacgtgtcttcaaatcctccagatcttcccaagttgcttgttctggcacagtatgagaccagtgaattagcacctgagtaataacagaattacctttcttgactagtctctgatcaagaatagcaagaggaagctgccaggaaaccacttcagagggcagttgaagaaaagctggttgcgtaaagcccttggctggtttcaaaagagaaacatggaacacatgatggacagaactagtttcaggtagctgaagcttatatgcaactgtgcccaatttgtcaataacttggaaaggaccataatatttgaaggccaacttgtgattagctcttggggctactgaactttgaacatatggctgcaatttcaggtatacccaatctccaattgtgaattgcctaaaacttcttttcttgtcagcaaaatgtttcatctgctgttgtgcccgatggaggtgttgctgcactaattgctgcatgaacttcctgtctcgtagccatacagacaattctggaatagcacagtctctactgctgataccaaaatggtttggaggataaccatacagcacttcaaaaggagttgtgcccaaagaagaatggtaggtactgttgtaccaatactcagctaaatgaagccaggaataccatttggaaggagtagaatgaacaaaacatcgtagatagatttccaagcattggtttaccctttcagtctggccatctgactgtgggtgataagcagaactgtagtgcaatttggtaccagctcttagaaataattgctcccacaattgactagtgaatattttgtctctatcagaaacaatagtttgaggcaacccatgtaacttatagatatgaaacatgtaagcttgagctacatcaattgcagtaaatggatgtttaagggcaacaaagtgtgcatacttggaaaacctgtcaacaaccaccagaatgcaattataacctgctgacttaggtagtccttcaatgaagtccaatgagactgcttgccaagaaccctcgggtacaggtagaggttgcaaaagaccagggtactttagtctgtcaggtttggcctgcaaacaaacctgacatctttactgattccttaatcattttcttcatgttaggccaagcaaagagctgtttaatcttcctgtatgtgacaggaaaaccagaatgtcctccaactggactggcatgtaattctcgaataagttttaactgtagctcaggattgttgcccacccagattctgttcttgtaccgaatgattccattgtcaagaaaataatgaatgtgtttctcaggatgaatggccagagtagatagcagtttagctgcctgtgcgtccttctcatatccctgggttacttccataagccattggggtacactagaagagatagcgaagatttcagaatttgaatcttgaaattttctagaaagtgcatctgcagccgcattagaactcccttttctgtaacaaattttatactgcaaccccagcagtttggtaaaggccttatgctgccatggtgtatgtagcctctggtcatccccgtattttgccacatacgtgggttcggtcctccaaggcctgttagagctctnnnnnnnnnnnnnnnnnnnnnnnnnnnnnnnnnnnnnnnaaataggaagaacgtaaatcttccacctctggaaagcgcctacacctaatggcttaagccgctgttcccatttcctcgctgacccatcatgcgaaaggtacgccgttagagtgagtgcgcccgcgctccgctccttcgactgattgttcgcatcggatctcaggttctctattgcactccccgattnnnnnnnnnnnnnnnnnnnnnnnnnnnnnnnnnnnnnnnnnnnnnnnnnnnnnnnnnnnnnnnnnnnnnnnnnnnnnnnnntttctcgcgtaaaagcgatcatcattcgaacacgccgcgttttactgggaaggatcgaaccatgggaacgaatgaacagggctatcaccttctttggccggatcttccaatctttttagaaaaccagttcactgcgcgccccaccccgtcatcagtcctgtgttgcctatgcttgcgccccaaaacggttgctgactttgtacaactccgtagggcgcgctacggcaacacagcctacgcttgctgcttgctggtttttccatcatccaatccacaacaaatcgaatgaaaccgcttcggatttcttttgatgaaaacccttgttccgctcnnnnnnnnnnnnnnnnnnnnnnnnnnnnnnnnnnnnnnnnnnnnnnnnnnnnnnnnnnnnnnnnnnngcttccttcctttagctactcagatgtttcagttcgctaagtttgaaaagtccaaagagcgcagactagccacggagcttggatacggtttcccgatcggagatccaatgatcacagcacctccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatatggggattcttatggttccatttaagaataagtatgccatacgccccgcggggattgtagttcaattggtcagagcaccgccctgtcaaggcggaagctgcgggttcgagccccgtcagtcaatggaaccatactaaattagnnnnnnnnnnnnnnnnnnnnnnnnnnnnnnnnnnnnnnnnnnnnnnnnnnnnnnnnn

SEQ ID NO: 19017 - DNA, 1530 bp, Oryza sativa
ctatccgtaatattttagaatattgtggaattagagaaatttgcacactttctcatttgattcgcgaggagctggaatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaactgtagctagagtagctatttccatagctgccagcaaaatgcccatacgaagtcaatttcttcggttagaaatataacccccccaaaaaagtagtattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagatgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatgcaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgtttggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcataaggttttgggcggaatgggaattgctattctttctacttctcgaggtataatgacagatcgagaag

SEQ ID NO: 19018 - DNA, 6937 bp, Oryza sativa
  unsure (1)..(6937): unsure at all n locations
nnnnnnnnnnnnnnnnnnnnnnnnnnnnnnnnnnnnnnnnnnnnnnnnnnnnnnatttgaaggataccaaagattcaaagggttaggtttttctttttttttctagggtaaaaaattcaaagttctaaaattcaaacaaagacacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtgcagtgggtttgcaatgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtccccgcttagaaaaggtcaagcggataccgttggtattgccttgcgaagagctttacttggagaaacagaaggaacatgtatcacacatgcaaaatttgggagcgtgccgcacgaatattctacaatagcaggtattgaagaatcggtacaagaaattttactaaatttgaaagaaattgtattgagaagtaatctctatggagttagaaccgcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaagaaaaacaaaaaaagaattccattgagttgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaagaaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattccatttctactctatgggatcttacggagcctcttcatggatgacatggttgaggtatgatcatagaaaatattctcctcaagtgaaccagcctatccttactagacaggggacttacgtgttgattggatatggagacacctttggtcgtgaattctaatgtggcagatccaactctctatctgcatggccaaatcaataattcaagtcgcacactcccataatccgccttcttttctttcgtaaaattaacttcaactatttgtattatttgtatcacaatagttcggagttgaagagaagtatctaaatgacatgtcttattttagaataacccatgtttgtagcaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagacccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacacacaaattttcaacggatattagaaaaaaggttcaaaacttcgtcagccactgggttgggtcgatttgccttgaagatatgaaataagaaaaatccagaatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttctnnnnnnnnnnnnnnnnnnnnnnnnnnnnnnnnnnnnnnnntctctctatctctctatctccgcgaagcttccaccggcaaaacttccactctctgcccgttgagacgcaacacgacagatgcgagatagaatgacggttcctttcccttaggttgtatcgaactgtgtttaagtgctaacgatcttttgtcaccggctaatgacactgtcaccgtttggtttactcccaaggggtagaaagttaaacttccacgtgacgtcagctctcaaaaaatttgattagggaattactgattctgatcaaacctctaattgcatgcagcgttctcttaccaacccggcaacgactcggtgctgctcgtcgacaagagctcgtacgacgcctgcaacacgaacacgccgatcgacacgttcgccgacggcaacacggtgttcaccttcacccggtccggcccgtactacttcatcaagcggaacaaggacactgcaaccgcaacgagaagctcatcgtcgtggtcatgggggagcgccgcggcaatggcacggcgccggcgccggcgcttgccccgtcgggccgcaccacaagcccgaactcgccaccgtagccgccggctcctccgtcgggcatcgagatctcgcccacgccggagcagtcgatcaacgccgcggcgcgccccaaggcggcgggcattgccggcgcggccgggctggccattggnacgctgttctatgcactcgtttgatacgttttgttgaaatgaccgtgttgatgtggatcaagcataacacactaacacagtcacacggatgctttgcttacagagaaagatgtactcattgttggtttgattaagtttgttgctaatatgtgctataataatgtaataagtgttcctattcaatgtgatataatcgattgataattaatcaattcattgttgttgtggtaaaaaagagaaactaaacaggtttcttttaggagcaacaattctttaggagggcatatatactatgaaaaaatgaagaaaaagatggttgtttttcatgtctattttcgaaaaatatccaaccacctattttctaaatgtatcgattcacatgtcgaaaaagagaagcattgggccagatatgggtaacatattatggtccaatacaagaatgaatcaatacatagattgtcggcatttttctcgacttttctatgctcccgcaattcgtggaaatcttgtaatattttgggtccatcattttgatcggcccaaaaaaaaaaagaggccttttacggtgcttggaaggtacctcatgtacttcctaagatacttaatatccaccgttgatgctccaaagggcattttagggatagaaaataacttaagaatcactaatattctaactaaccctcctgattttctgtcatctaattaactttctcacatagccattagccgcttaagactaactaattttctatatctcgctgttattggcatcgttgcagcaatctacacatgcttttactactgatttgaaaccattttttttaatcgagatgaacgaatggaaaggaatatatagatctttcttttcctgcattctttcataatcaagatgaacgaagggaaatgagtacataatttataattattgatcaactacctagttgtttttgaaagaaactgcaagcattattcttctgtcaacaaaatataactgtcatctgagtttatgggatagagatactaactattcaaagagaacacagcgagaaagagggagatgtcaacgatactacatccatcaaagaataaccgttcatttataaaataatagatgcaaaattacatatctaatacggatatctgacattccaagcagcgatctagccaggccaacctgtaattctgctaactattgactcgaatataagcgcgcataatggcccatcacaatccaactaatatgacgtcttggtttttatggccatatttggcggagttcgtatattcaaattaagctgctttagattataatctgaagctgggccaaatatggccttcctcctactaacctagtttatcggtcgcattgttaaaacggctttatatttcattcaacatcggtgtctgaaaatcatttcgtacatgagnnnnnnnnnnnnnnnnnnnnnnnnnnnnnnnnnnnnnn

SEQ ID NO: 19019 - DNA, 1412 bp, Oryza sativa
cagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttcttcgaataagaaccgcttgatgatcatttattgaatcggtgtaatgactcgacaaaatcgagagaaaaaaagttgttttttgggcaaacaaaattggaaggaagaaattttcttcaccccgtaggaactacgagatcaccccaaggacgccttcggcgtccaggggtcacggaccgaccatagaccctgttcaataagtggaacacattagccgtccgctctccggttgggcagtaagggtcggagaagggcaatcactcgttcttaaaaccagcattctcagaaaattcagttgccgcgagctccactgaaatttgcactctcccctgttcccggagagaagtagagaccatgtgcaaggagtaggaagtcaagatcatgcatcctcgttgacgaaataaatgcagtattttagtgattgttatgacaaacgtgtatggtcctgttcagggtggatcgatcaggaaattaaaatatgcatgtagacatgtagtacgtactacaatgcagttgcgatttccatttcttaatttcgcacaagaattatttaactatgattctgttcttctgcttaatataactgggacgcgactacgcgtcggtcgtccgacgggaagctagggaaatcgtaatgtcagcgtccgatttacgtgcaaaactattttaaactaatttttttcttaaattacttatctaaataatgatccgattgcaccattaaattcattacaattaaatcttaaaaacaagaccacacatggatatattccgacgaaaaaaaaagcttataattgaattatttttaaatgttacacgatgttccaccaggtatatcgaaattgtttcgctaagtagttcgaaaatgtttcactcgtttaaatagagtattgtttcaccctatataaaaacaatgttttagcaaatagcgaaagaatgttttagttcactgcaacattagatctatacatagtgaaatattgtgagtacactaggtataacatttttcggtggaacaaaaaatataccaaagtcccttaatatggggtttccaaaatatgtgggtttttttgttgcaatgaaatgtttcattcactgcaacattagacattgtgagtacatgaggtgaaacattttttgtggaacaaaaaataaatcaaaatcccttaatagagagtctacaaaatatgtgggttttttttgttgcaaaagagtattttaataaactgcaacattagatttataaatag

SEQ ID NO: 19020 - DNA, 1083 bp, Oryza sativa
  unsure (1)..(1083): unsure at all n locations
ctcggtaccccagacatctgcagccatgcgtgcgcaacagctcgtgcatgatcagcgtgatcatatcgagggacgaagcatcggttctctctatgcatattttgcttgcatatatcatatatgtttacctgacttggacgatatgtcgttcacgaggtcggccacggcgtcgttctcgtagcgcctgcagctggcgcgctcgctgccgtgctcggtggcggcggcgtcgccgtagtgatccttcttggccttcttcttcttcttcctccagaacctcttcttcctccacctcttcttatccggctcggagtccgccgccgaagtcgacgcttcctccttgccacggacaccggaagatccaatggcgctggcggacgagcagcgacaggtgcggccgccgcggaggagcgtcttgccgttgcagcatctcttcatcgccgatgtcaacaggtccatcgcgcgaatcgacgcgagagtggggaaacaccctcgagccgatccgcgggtgaaggccgggcgaatttgttgggatacttcaacagcgacgcgggccacaacttgtggacgggatccgttcttctttcctggaggtagctgggacttgggaggccaggatccaaatttggcaaagccattgtttgctgttcgatcggtcctgtgtgtctgcatgatggcagttaaactggtcatatgaagtgtcgaccgggcactttgaaaggtcttcacgagaagtaggaatcttgcatgaatgccttatagaaattccccttgggtaacctttttttaatgatgaaaatagattacatatttagcttctatcataagacatataagctataaatttgccaaaaaaaaagtaaagataaaaacaactcaaataagaaacaaggtgatggaacaaatccccaactccctttagcaacttaggaaaagaaaaaacaaaacaaaacaatcttagttgtgttcttcctccttctttcccaactcatctccctctttttcgcgcgcacgttttttaaattnnnnnnnnnnnnnnnnnnnnnnnnnnnnnnnnnnnnnnnnnnnnnnnnnnnnnnnnnnnnn

SEQ ID NO: 19021 - DNA, 509 bp, Oryza sativa
  unsure (1)..(509): unsure at all n locations
nnnnnnnnnnnnnnnnnnnnnnnnnnnnnnnnnnnnnnnnnnnnnnnnnnnnnnnnnnnnnnctgtatccatgattcaaaatttccttgccaagcgacatgaaacagatttccggacgtccatagaaagattattgctaattgcccaaagtgagaagcaaaaatgttctgataaagacgttcctcagtaatatcatcatgactttcgaaatcatgtgcggtagcaataccaaaccaaatacgacgagtagtggggtcctgagctaagccttggctaaacctgggaaatcttaattccataatgcctttcaaatcctcctagccactatcctactgcaataattctcgctaagaagaatgcccatgttgtggcaattccacccagaaggtaatgggttactcctacagcacgttcttgtataatgctcaaggctctaggctgagtagcaggagcaacttttaatttgttatgagcccaaacgatagattcaatcaattcttgccaataac

SEQ ID NO: 19022 - DNA, 709 bp, Oryza sativa
  unsure (1)..(709): unsure at all n locations
nnnnnnnnnnnnnnnnnnnnnnnnnnnnnnnnnnnnnnnnnnnnnnnnnnnnnnnnnnnnnataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaatcccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaaaacaaaacggtccctggttgcttctttcttcattcgggctgggcacgtacttcgatttcgaacctaatttggctagattcgaatggctttttcaaattaatacgacatctcttgatacccttcacttctattggtcagacagattccggcttataagtggtactggaatatgggtaaaatt

SEQ ID NO: 19023 - DNA, 936 bp, Oryza sativa
  unsure (1)..(936): unsure at all n locations
nnnnnnnnnnnnnnnnnnnnnnnnnnnnnnnnnnnnnnnnnnnnnnnnnnnnnnnnnnnnnnnnnntcattatgaatgtataaaccaaaactgtgaaaacctagaaatatacatacccagttaaggtgggatatgattgcatcacggtgtctaaggacacgatctaatagatcgttgtatcgagtcgttggatcatagtctcttaccataaaaatggctgcatgtgcagcagcaccaactattagaaatccgccaatccacatgtggtgtgtgaacaaggaaagttgtgtaccatagtcagtagctaggtatggataggggggcatagagtacatatgatgagctacaacaatggttgtagagcctagcatagctaggttaagagataattgagcatgccatgacgttgttaggatttcatagagacctttatggccctgtcctgtaaatgggcctttatgagcctcaaaatatctttcaggccatgaccaataccccagttggtcctatacatatgacctgcgatcaggaaaagaatagcaatagctaaatgatggtgcgcaatatcgctcaaccatagaccgccggttattggatctagccctccgcgaaaactaagaaatgctgcgtatttggaccaattccaggtgaaaaaaggggttgctccttcggaaaaactaggataaagttgagccaaaaggtcgcgattcaagataaattcatgaagaaatggtatctccttaggatcaaccccagcgtcaagaaattgcgttaatcggtaaagatacatggattttgcgcccacacccaaaaagagacccaaggtctaataaccctgctaagtgatgattcaacatggattctacgtcttggaaccaggctaattttggagcggctttgtgataatggaaccaccccaccaaaagcattaacgat

SEQ ID NO: 19024 - DNA, 2842 bp, Oryza sativa
  unsure (1)..(2842): unsure at all n locations
nnnnnnnnnnnnnnnnnnnnnnnnnnnnnnnnnnnnnnnnnnnnnnnnnnnnnnttctacgtcttggaaccaggctaatttgggagcggctttgtgataatggaaccacccagcaaaaagcattaacgatgcaaaaatcaatgcaccgattgcagtacaatagagttgtaattcactagttattccggatgctcgccaaatctgaaaaaacccggaggttatttggattcctcggaaacccccgcctacatcaccattcaatatttcttgccctacgattggccaaactacctgagcactgggtccaatgtgagtaggatcacttagccatgcttcataattggaaaaacgggcaccatggaagtacatgccactcaaccaaagaaagataatggagagttgaccgaaatgagcactaaagacttttcgagagatctcctccaaatcacctgtatgactatcgaaatcgtgagcatcagcatgtaggttccagatccaagtggtagtatcagggcccttagctattgttcttgagaaatggccgggtctggcccattcctcaaaagatgtttttacaggatccctatccacaacaatttttacttctggttccggcgaacgaatcatcattaagtcctcctctttccggacaagacatacaaagagacccgccaactttttagtgaacctttgaaagatagatattatgattagtccttttctttactatctaccgtccttctatttttttttagttattcactggagcaattatatattgaagtcaatctgaggcaagtgttcggatctattatgacataaggattgggtgcctaacggactttttttatcttggatttctccacgtaacaaaaaaacctttttttaatttaaaaagctagtctattttttttaagagtataagtccctatctatatctactttccttgagcataatatagatttttttattcgattccaaattccaagataactcattagaattattaataagatggtcctgatatattagcaatatttatattgcccctttttattcgctttattacttctattctagaccctatcgtttatccttatgaaatataatataaaatagaaggcagaggaaagagatataatgaaattcttgattcgatcttccgacctaatttatttgattaatggatcaacaaccaaacccccattttctgaaaaaggagagtggtcttattcaaattcaaagcgcttcgtaatcttcaaccagttctgtgcttcaatataatttcccggagtaagcgctatagcttgtttccaatactcagcagcttgatcaaaccaagcttctgcaatttctgaatcaccctgtagaatggcctgttctccccggtcggaataggtagttccttcccctagaaccgtacttgagagtttcctacctcatacggctcagaaattgctatcttaatttcccttgtcttaactgaattcgatttctcaaaaatcgatccaatttcttcttgggttacgcagaagaagttaattacctaagtttcaaaccctaaattttgatcaataatcagtttgatcttttctcccacctgcagaaaaatgaagcatagatagacctatatccttcgtccgaattttctgaaaggtaactatctcggtttcatatatgaaatttctatagaatccttgaaaaagactttttccccataagcaagaaaaaagaacttactatctttgggatctgatactacaccgctgcttaatcccttagtggatcggctctattacataagcggattcctaaattttgccccatatcatgggataagtaagcagttttttttagttgtatcgacccagtcggtcactaattgatctttacggtgctttctctatcaatttgagaactctatccatagagtagtataggccatactttctttcttcctattttgattctcgtgaagtgtcctttcttcctacagctgatagggcaaaatcgttgttttgacgatccctatgtagaaagcccccttttctagtaaatactagaaaatttgatcctttcttatttttctttctatagtggagatagtcgcacgtaatgacagatcacggccatattattaaaagcttgtggtaagaaggggtttcgttctagtgcccggaaataatattccaaagcctttgtatgctctccattgcttgtgtgtataaggcctatgttatagagtatataacttcgatcatagggatcaatttctagtcgcgtagcttcataataattttgcaaagcttccgcataatttccttcggattgagccaacatccgttacggtcgttcgttctattcaaaaaatctccgttccaaaaccgtacatgaggttttcacctcatacggctcctcccttctgtacatagtactaagcgaaaaaatctagagaataaaaatagaattagttccatctcattatggaccgaaaggggctggtatttttccaagaaatctctagccaaccttcccacaagaggtttttcttaacaccaatgaattctattaatgctagaggaaaacgatagctccaagaatttctttgttctcaacgcctcctatttagaggaattagccacttcaacgatctttgatggttataggggtatccaaagtacaaacttgatggttgtttgttatcccaaccattcttcccagccctgataccaatcaggaaagggttaatttctaacaaagtttttctcttgttgattcctatttctaggggtagggcttttatcccctatgctacctattagtactaggagagtaggatta

SEQ ID NO: 19025 - DNA, 1430 bp, Oryza sativa
  unsure (1)..(1430): unsure at all n locations
nnnnnnnnnnnnnnnnnnnnnnnnnnnnnnnnnnnnnnnnnnnnnnnnnnnnnnnctacctattagtactagtagagtaggattagcctgtaatacagaacctatcctgtaggtgtaacctttcgctcaatactaaaatctacaattgaagcatccgaggccgcgtcagtcgaggatacacgacagaaggagttgttagttcacctcaccttccctaagcgtgggtttcccttactaatttggttttctctccgcgaacccccactctttctcgtaaaaccggggtgtaggtagggctaaaaaaacaaaaaaaagagtcaaatcacaccatctctataataagtaaatgcccttttttccccggaggttgtcggaattattcgcaataaaatattggctacaattgagaaggtcttatcaatgaaatttccatttatacgggatctaggcataattcccaacccattctatcattctatatagaattcttttcattccttcacaaaataacataaaaaaaaaaacaaatccattcaattcttataaatcgatccctatgctccaaatggataagagaggtatttctgctcagcccaaattctctctttttccttctgtttgaacaagaagagatagaaaatatttgactaagattggatttcattccactttcctatttcttttctcaacaacaacttctctcatcaactatttcgcattttcaaagtcattaatcgtcccataccctattttctatttgattgtatggggtaggataccttatgcaaacagaattctagggttccttttttatcgaataagaagaattcttccattctctttttctttggtttggggaaaacccaaactaaaacttttcgagggagcggaattcctagtaaaaaaatcctggacccgtccacttagaaagtattattattactaatttactcatgggtaaattagtaataatttacattgaaaatgaattaatgttaccccagccacaagtcatccccgtccgaaaaggtttacttaagtatttcatggtgtatgtagaactcaacatctcagtaatttgcttctcaatttcatctttaagggctggattatgccggtaaggcctgagattgatgggtttagcaccaggtataaggttgattgtatgatcacaggctcttctaggtggtagtccttcaggttcttggaaaatgtcatgaaagtcctgaataatttccttgacagcttcaggtacactggaattctcttcatgagtaacagactgcagctgcactaagtagcttaatgatcctagtctgttcaacccacacaactgatgattggtgatagaggagcattgtactgatttnnnnnnnnnnnnnnnnnnnnnnnnnnnnnnnnnnnnnnnnnnnnnnnnnnnnnnnnnnnnn

SEQ ID NO: 19026 - DNA, 1338 bp, Oryza sativa
gctagtaggtacactatagttggacatcattctattacttttgataccaaagatgggttcagacctttttggactggcagacttaaccccttccattgcttcctcttgtaacagagctatagcacaggcagtatccagatcttgtggtctttgtactaataccactactcttacttcatccttgagcccttcaatgaacttagtgacaaaatagacaggaatcagagaaggatcataagcaatcatttggtgcatcaacccatcgaatttttccacatattcagatacagtaccagtttgcactatgtgtatccactgcctaatgagggcctgatgtttgtctttagcaaatctggtacaaacagcatcacataatccattccaggaaattccccccatctgagatcttactgattgtaaccaaaatgcagcattgcccacaaagttcagagtagcaattttaacccaattaacaggatgagtaccatagacatcaaaatactgttcacaattggccttccacatctgaggattatcaccattgaactgaggacaagtcatagggggtacactgccactaacatccagggttccactgccaccagaatttctagcagaggactcgcaaaagtaattaggggaggaagtagggttgggatctcgcataccaggggtaagaggactgaagcctcttgcagcagcagtaaggaaaaaccaatatagaaaaagatcaaagagtcgggcggaaaaaggggagagctccccgttcctggttctcctgtagctggattccccggaaccacaagaatccttagaatgggattccaactcagcaccttttgttttgagattttgagaagagttgctctttggagagcacagtacgatgaaagttgtaagctgtgttcgggggggagttattgtctatcgttggcctctatggtagaacccgtcggggaggcctgagaggcggtggtttaccctgtggcggatgtcagcggttcgagtccgcttatctccagcccgtgaacttagcggatactatgatagcaccgaattttgccaattcggcagttcgatctatgatttcgcattcatggacgttgataagatccttccatttagtagcaccttaggatggcatagccttaacgttaatggcgaggttcaaaagaggaaaggcttgcggtggatacctaggtacccagagacgaggaagggcgtagcaagcgacgaaatgcttcggggagttgaaaataagcatagatccggagattcccaaataggtcaaccttttgaactgcctgctgaatccatgagcaggcaagagacaacctg

SEQ ID NO: 19027 - DNA, 6371 bp, Oryza sativa
  unsure (1)..(6371): unsure at all n locations
atgtcaaaatgcatcggtaggggagcgttccgccttagagggaagcaaccgcgaaagcgggggtcgacgaagcgaaagcgagaatgtcggcttgagtaacgaaaacattggtgagaatccaatgccccgaatcgtaactagttctagtaaaaagatatgatcatgctccttttttcattcattctcctttagtttttttctctatctagaagtggaatagaataacccggttaaagggtaatgatctttctatttctcttcttttttatttagaccttttttctatctaattttatccacttagtctagctatctagtttatctaccggctcgaactcgaatttgatcgctttccatatttcacaagctgcggctagttcaggactccatttgcaagctgatcggataatttcattaccttcacgagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcttgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaatcccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctgtttgcttcttccttcatccgggctgggcacgtactccgatttcgaacttagtttggctagattcgaatgccttttcgaatttaatacgacatctcttgatacctttcactcctattggtcagacagatccgggcttatcaagtggtactgaaatagggtaaaattcagtttagtagaaaggaaggaagcaagtgaagaaagatgggatcaaattgtgaatgttcttggttcgcatcttgctttttgggcgtggtttcgcaatggagctagaaagattggtcaactacttcttaaacccaagcaagctactttgactactttacctagcccaagccagacttcaaacttactttctctatttagctcttaagcctttttctaccgaccgaacatgaagaagctcacggaagaagtaagtcattacggttggcagggattgactttccgttgaagtattttcttacctgttgtatagaagtcttcgtttcagtcctcctagtggccattgctcctagtatgagtagttgtgatgggctgcgagttcccggggtgacgagcctttagcatccagattgggcaatacgagatagattgatttacttcgaggatagtctttcttttccaagcgagaaagtgcaagtgtttctattttcacaagtgaagatattgaaaagcatatccgaaagcaaagaaatattacctgggcgttgtacgcccttcttgtttttgaatcacggaaatgcggaggttttaattagtgcttacctgcagtccaccctttctttgaaccttgtcaatgatcgaatttacagatatgaactgagtgccatttgatgagtaagatcgaacaagggagagggatatggaaaggatgaagtaatgaaagaggaagtcattgctagtagtaacgacttgtcacgatccattggttcatatagaatccatgtcctaggtctatcaaaaaacattcttttcactaagcgtatataataaaatagagtgaaagggtccaccccgaaaccaagggggtactaactaacagctgagtcctctccgaaccgcaggagatagttgcccatcatacggctcaccaacttcacttgcctctaaggggggctcgctccgggcgggttcggatcacttactatacacggccctacgaaggggttaggagcgttttcaagatgattctttctttgtcgagacgaaaaaggtcttttcgatttcaaaatgtgagtctgttttgcccactttatccatccccctctatcaaaatgatcaaaaaggcatttaaaatgcttcttattcccgtgtttgatcttatccatctctgccccgcttccatgtgggcagagacccctgtagagaatgaagaggagccaaggatcttactctcaagagtgcttcgataggctccactctctcccctgaataagtcaggctccgttagcctgggctgagatggggataacgagtcgacgattgaagcccccaacgttctgccagacactggacaggggtaagctctgtaaatgtgtagagccaagtgtagtgtggtgtagtagtaggcacttctaggccccttcccggctactggatcactccagtgcttcgggtactacggaccctctgccatccattgcagcagagccgtttcatgagcgggggggctaagcgcagttctttgaatcaaaggttttatgaaatcgaaatcgattcttttttagatatctggatagatggatggatctatcttgatattcagatatcttttgcaatcagccccaaatccttgatttggccaggaaacaaagcactgctttgggcccaggaagcgaagggaatgagctcggctgcttctcctccacacttctttatttctccgtgccccttccgcatgcgcttcgcgcgccattggcgctttgctctcctcttatttcttcattggagggttcggatggacttcgccgttctttcccaacgaaaatggaaagggctgtatcacatcgagatgtcgattcgttttccgccccaaatgagatggggaattagtcacctctgtcccttcatctttatgaaaggaatcaaggcccggcccggctcgcgtcgttccaacaaccgacggggagcacctcagtatacgatcgcgcgcagtaactgggagtcctattacacctaaggccaacttccattcaccaaacccaggttcatctcgtgtagtgattgtggactcgtacaaggatatggagtcgacggttgatgtatcagactcgaccctgtctttcgtagcatgcattcccatctgtgttgcaactgattcggtaagctacgtgtctggtgcacggaaaactgccttcggtctcccaaccttactcatggcaaccttccggccgcccaacaacctataacgctagtcactactcccactggggctaggaagtaagccccacaacccaaagcggcgaagaacaaatagaatttgctacaaaagccggctaacgggggtattcctgcgtatgagaacattgtaatggagaaggtcatagccaaaataggattcgttttggctagagcgcccaaatccgctatatatttgacacgggtttgccgtaatgctggaactatggcgaatgcatctatcgtcattgatgcataaataaatataccaattagtagtgattgaattccttctatggttccacatgagaaaccagtacgaatataacctacatgtccaatcgaactatgagctagaggtcttttgactttcgtttgggccatggcggccaggggatcctctaagatcatagaagcaatgctgcagaaaaagaagatttgttgtaatgtacccccataggaagcaacaatagaaacacgtgacatatttgcagaaatagagattttaggcgcaatagaaaggaatgctgtcaccggggtgggtgaaccctcatagatatcaggtgcccacatatatagagtcaaaagagagattgagtccgagggagaggggggttttcttggggctcgagagattgaatagatagggccccacaagttgttaattcgccgctggggaattcacacaaaagggaaggacttattctcaacgaaaaaagtgctctctgaaccgaacatgaaagttgttttccatcagacggctgttcacgtaactccactctcggcttggattatatatccatttggtccgctcccggccattccacacgctgcctagcagagacgtggttatctgaagtggattctctcttttgtagtagatgccgaacctgctgctcagtgggcgggcgcagcagctacatggacccctttctttatgttgttgccagcgctttcccgggccgagccggaattctttattagaacgtcggcaggcaaagcccgaaggaaggcagctatcccctcggccttcttccttttcgatgaaaaacaaaccgacatctcaatctccgaaagcgttttccttacccggaaaatcccccccccttcgtcgagcctttcctttagtggtaagggatatgcactttatctgaacgtcggcaggcattccggaattctcctttttgggccccgggtgaacataggctcaaacatgattggaggggtcctagctacgccatgcgttcaatacaaaaaaaagcctctgggaagctgcagggattacaaaaagagggtgctttcctgtgttgcactgaaaaaaggacaaaggagaagacgctcttcgactttctttcttactcccgcgcccgcctaagcccggcccggccccgcgttagaggggaagattatcaaagccgaaaaagacagacggaggggagcntgcatcttattctcttcgcgagaacttcaggatcggagaagcattcggaaggggcgaggccttcatttcgttggcaaaagcagaaacgatccaatccattcggggcttcggggaacccaaaaacgaactctgtttacttttttcatagatagatgatatatataggaataatatatacatccctttactttagatgtctatgtatctattttttaatcatctcccgattatctttttttttctagttcgcactgctctttctctctaaattgcatcaaagaaaatagagagagagcagatggatcctatcccctataacgaacactcatttctatctattgatagaaaagaaagatcttcgtcacggactttgcctttgttctattttttttagatttgaggaattcctcatatccaaggcagctccccacaaacaccccacccatacgactatgccctcttttgaatcgacagtagattgggcttcatagctactttcattctaaagacgaatattagtcaataggcaggcttctttcagtagcaaacatattcattttcaccgggctccgcgcacctttggtacttcaggagggcaagctgttttatagtgacttctttcttagggtagggcgacgaatacttcaaattccggaaaggggtcgcgaagctaaagcgaaagttgtagaaagccgggagaaaaagcgaaagcttgctcgaaacggcctataccctaaccctcggaagcgaagacgcaaagcgtcacttttcaaaaggaaggagtgaggctgactgaatccatccataaaaccgtcaaggaaacgaagttcgttccctttcatcaagtgggtaaggtaggcgaaccacttaagctttgccttagactgacggaacaaagctaagaagtaggctgaatggaaaaaggaaagggacaagggcggtcgtcgcttggcgcgaaggctgctggttcggtacggtactaaaggtcctcggacttccaggcggtttttcttttgggctgctgggaacccttggatctcgccaatacagcctcctatggttttcgttaccgagatatcttttctttttcccagggattttttgggtaatcagctcccatgctgcaaacagtcaaatctgaaccttgctgtttactataataacataccaataacgaagcggtatttgcttataaaaaggattcgatctataatcgatcgaagtaaagggtcttcctttgtggtgataaattgcctacttaactcagtggttagagtattgctttcatacggcgggagtcattggttcaaatccaatagtaggtaggtaggtagaaaaattactagatagcattggccctacttcgcttcgctatctaataattttttctaccccttcttccctttttctttgtatcaactaaaccggtgggttg

SEQ ID NO: 19028 - DNA, 1437 bp, Oryza sativa
  unsure (1)..(1437): unsure at all n locations
nnnnnnnnnnnnnnnnnnnnnnnnnnnnnnnnnnnnnnnnnnnnnnnnnnnnnnnnnaaaaattactagatagcattggccctacttcgcttcgctatctaataattttttctacccctcttccctttttctttgtatcaactaaaccgttgggttgtcttcaattagatgggggaatccaattaacagcctcgactcgtatcctagctcgtctgagagctaccttcgcttcaaccaattctttcgtaccctcagctctactcacgttagcttcggctatttcaagtgcctgttgagcttcttccggatcaatgtcactacccagttccgcatcatttcctaaaatgatgatctcattattaactattctggcaaaaccgctccacagaaccgccgttaaccattgatcgttgaggaggcgtattctcaagggacccatatctacagctgtgttaatgggggcgtggtttggtaatacgccaatttggccactattagtagataaaatgatttctttcacttcacaatcccaaataattcgcttaggagtcagtacataaagatttaatttcatttcttcaatttgttctcctcttctaagtttatagctttcgtgctagcttcatcgatgttacccaccaaataaaaagcctgttcgggtaggccgtctaattctccggaaaggattagttgaaatcccctaatagtttctgcaagaccaacatactttcccggagaacccggtaaaacttctgccacaaaaaacggttgtgataagaagcgctcaatttttcgtgctcttgctacagttaaacgatcctcctccgataattcatccaacccaagaattgcgataatgtcctgaagttctttgtaacgttgtaaagtttgcttaactctttgcgcagtttcataatgttcgttgccaacgatccgaggttgtaacatagttgaggttgaatctaaaggatctactgcaggataaatccctttggaagctaatcctctggaaagtacggtagtagcatccaaatgtgcaaatgttgtagcaggagcagggtcggtcaaatcgtccgcaggtacataaaccgcttggatcgaagttatagatccctttttagtagaagtaattatttcttgcaaagaacccatttctgtactaagagtaggttgataacccactgcagagggcattctccctaataaggcagatacctccgatcctgcttgaacaaaacgaaagatattatcgatgaatagaagcacgtcttgcttattaacatctcggaaatattctgccatagttagggcagtcaaaccaactctcatacgagctcctggcggttcattcatttggccatagactagagctacctttgattcctcaagattttggtactgccaccattctttcccccgaccctgctatgaaacgta

SEQ ID NO: 19029 - DNA, 1495 bp, Oryza sativa
  unsure (1)..(1495): unsure at all n locations
ggcgaattcgagctcggtaccctttctatctactattatctaaaaatagtcaagttattaatgactggacgaaaccaagaaataaccccttatgtgcgaaattatagaagatcccctttaagatcaaacaattccatcgaattgagtatgactgtatgtgtgatagcatctactataccaggaatatcaatgaaccccattcttgcaattgctcaggataccctcttttagctgctaggtctatttcttagttcaagatccctcttactaactggaataaaagaattagtagatctgttccgcccaaaataggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaataggtgtaatcagacctgcttttgacatatctatcctatccttatttgggtaccatatgcacctctttgggcttctattgaatcgagaaattggattgtacatctttttgattttgatacatataaggtgtcctacggataatgcaaatcgaagctatttgatgtctgactcaggcctatatgaccgatcgatcgaaatactccaagactccacctttgtcatatattccatatatcacattagatagatatcatattcatggaatacgattcactttcaagatatcacattagatagatatcatattcatggaatatgattcactttcaagaaatatagtgaaatcgtctttcccattctaaccaaggatatatgtatcaaaatcgctctaatacggtcccgaatatgcaacggatcggcgtttttatttgcatcgctcctattattactaaccaaggggaaaatagataatgagcatgaggtaacaattccatattgatccgaatcaatccgtatgctcccatctttaataggattcccgctaaaagcatacatgtactgtaatgcgcttccccatgggtatctggtaaccacgtatgtaggggtataatcggcaattgtatggaacaaaaatccatcttggctagctattcgggaggacttctccatcggatcagaacatgaattgaagggcatacttagtagatgcagatctaggtactcattcttcctcagatggggaatgggccaagccgatccgttgttggcactgaaagtgcatttgctagtttgaaagaagctgaatccgggtgggattcaaaatgattcttatgtttcgtagcatgcagcgcagactcacttggtaaatagccttccctaaaagaggcaaggtgctcacacatgaaattccctttcttcgtgcactcatttactagnnnnnnnnnnnnnnnnnnnnnnnnnnnnnnnnnnnnnnnnnnnnnnnnnnnnnnnnnnn

SEQ ID NO: 19030 - DNA, 11653 bp, Oryza sativa
  unsure (1)..(11653): unsure at all n locations
nnnnnnnnnnnnnnnnnnnnnnnnnnnnnnnnnnnnnnnnnnnnnnnnnnnnnnncaatattcgggggatccctttcccgaacccatacgtgtttcggtcggtcttattgtaaccggtttgtcgggaaatatacgtacccagatttttccaccacgacgtgcatatcgggtcattgctcttcgtcctgcttctatctgcctcgccgtaatccaagtgggttcaagtgcttgaagagcatatctaccaaaacaaatacaattgcctcggtaggattttcccttcattcttcctctatgttgtttacgaaatctggttcttttggggttatagtcgatggttctctcttagttccatctctactgcaaaactggacatgagagtttcttctcatccagctcctcgcgaatcaaatgagaaagtgtgcaaatttctctaattccacaatattctaaaatattacggatagatacacattaataggaaaggttagggtttttaatattgaatttattaaaatactaaaatatatagtcaagaaagaggatctagaatatatctagattctcaccaatgttttcgttactcaattctatcgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaagaaattctacctcattctaatttagtatggttccattgactgacggggctcgaacccgcagcttccgccttgacagggcggtgctctgaccaattgaactacaatccccgcggggcgtatggcatacttattcttaaatggaaccataagaataagaatattcgcctgtcctactctaagaaatagacgaatcatatactacatacccccgtatcgtatgggggtatagtgagaatgacataactagtatgtcgcgatttattatcgctaaaaatagataataatccacctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatggatttaactcatattcacgaagccctagatttttgggccgagctggatttgaaccagcgtagacatattgtcaacgaatttacagtccgttcccattaaccgctcgggcatcgacccaggaaagaattattctaggtttttgataatctatgattaacctcctttcataatactccctacccccaggggaagtcgaatccccgctgcctcctttgaagagagatgtcctgaaccactagacgataggggcatcactagacgatagggcggtatacaaccgctcctcattatactataatgatagtatgagcagttttttggaattgtcaatatactcgaagagtataactagatccaaagcaaggagtccttcctacttttccattatgcttttgtaggattttttttagttgatggttaggttaattcacggatcatcccctactttttagggaaattcgtttataaaggatatggaggtgctgtgatcattggatctccgatcgggaaaccgtatccaagctccgtggctagtctgcgctctttggacttttcaaacttagcgaactgaaacatctgagtagctaaagaaagganaatcaaccgagcccccgttagtagcggcgagcgagagcggaacaagggttttcatcaaaagaaatccgaagcggtttcattcgatttgttgtggattggatgatggaaaaaccagcaagcagcaagcgtaggctgtgttgccgtagcgcgccctacggagttgtacaaagtcagcaaccgttttggggcgcaagcataggcaacacaggactgatgacggggtggggcgcgcagtgaactggttttctaaaaagattggaagatccggccaaagaaggtgatagccctgttcattcgttcccatggttcgatccttcccagtaaaacgcggcgtgttcgaatgatgatcgcttttacgcgagaaannnnnnnnnnnnnnnnnnnnnnnnnnnnnnnnnnnnnnnnnnnnnnnnnnnnnnnnnnnnnnnnnnnnnnnnnnnnnnnnnaatcggggagtgcaatagagaacctgagatccgatgcgaacaatcagtcgaaggagcggagcgcgggcgcactcactctaacggcgtacctttcgcatgatgggtcagcgaggaaatgggaacagcggcttaagccattaggtgtaggcgctttccagaggtggaagatttacgttcttcctatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagttcattaaagcaggaaaatgaaaatggaaaatgttttaatgtttgatgaccagcgtactacttgccacggtcctttgtttgaaagtcagtgagtgagcccatccgtattgtcttcatgccagaatgggaactaagagctgcggcttttgatcccgggaggagcagaatggctatgtgccttttgtccgtcctcacctgtacacttgtgtgattagactcccctactttcctgccagaatcggttgcctgaatacctttatcctcaccggaaaatagagtctacctttttcagttatcaaatcgactagggatagcctattgatgtgaagattaacttatagcatcagtacttttattaatcctcgaggggcgaatggcggatggtcggcaatgaaaaaaatagcacttcataggtgatccgagaatagctagagtgaaagttttcctaaagacgcaagagcttgatcgctaggcgggtcggtagaatctatggaccgaaggttccacgctacacttacgaaggacaaggctattcgaaatatgtaagtcggcgaagtcaaagagtccttttgaaggggttgtgcagaacacttacttttggtttatgagcaactgttatccgctgaggccccccatggtatgcggatattttccattatttggtcactaatgagctacctgcaggtttgtcaaaggctaaaagggaaaaggcgcgcagcggtgaagcccattactctgtatgggatgatccttacctttggtggcattgtgcggatcaggtgagaagaaagaacttccgataatgaaagaaaggccttttagcaggcaactgatcaaaagctattcctcttagccctagtagccctagctatctaatgcatactttccaactggccctggcctataacggcaaatcactggcgcatgacttgaaattgagttagttagagagcattaattacatcacaaattccacctagggattcctctataaaaaagagtaatctttttctttatgtaactagagatgtagcgacgagccagcttggatgtgacgagcaagtatttataattacgcatgaaagctagtgtacagaaatatcccgggggaaaagaataagtatgcttcacctatctttcaaagggcatgccaggtaataagctagaaagcaagtagcccaggaggaaagcttctaaaaaagagttgtcagaaaagttagcccgatattgaatagttgcttggttaaaaacaaccaacactatacagagcatacagccggcatttgaaggaaactaaagaagcaagaagaaggacctttctggcgcttgtagtatggccctttcttcacatctaattggtctgggataggtgcttgacttaattacttccagcctgatagatggcgttcattttcttataagcacctctctattcaagatgcattcaacatgggcagcagattaagtgatttattattgtcccttcttctagaggaggtgatacatcatattgtgacagtccatattccatgctttgctggtgagaaagataaactacttaggatccccgacaaccatgacatcttctcaacgagatccgcttttgatgttatcagaaggccaacgggtgattccactctcctcgctagcgtcgatcggtattctattacgaaagagcctcttcttccccccaggaagatgggcataatcatattcatttcattttcaggcgagctctttgcctatcgactacgcttgccgtattgcttaacggcgtactctattccgcctacagacaagtcctatacttagcttccttatttgattattggtcttgttgttctcggaacttgtgcctaaggctctcactcgcgatactcaccgggcgatagatagtcacctgagccaagaaagtagatgaaattgagaatagaatgagaatgggctttcagctttcatagatctttcctctcaaaagaggtgttacctaatccactatgtcctttgtttaatactgcggtaacctggaatttcaaaccttttttctaccctcgccacttctttcgctgaccctatccacctcctttgcggaataccagatcaagagatgaattagcggatcacagggctaagtcgaagcatgccagaaccttctttagtagtgagccgtaccgactagctcctagcaagggcttcaagatcacagtaatgcttgccaaaactttccttgggtacgaatgtcatgttcaaagcaggtttctctagacaccttggaaaagatcactgacgagctcaatctcaaagtgtgaatgaaattatcagtttcatcctctttatgagcctgagatcatatgggtcaacaattctcatttcttagttatagaaagcccttctcaaggaagtgagccactcaatctgagccagcggattctcattcagctgtgccggtgcgcaaagcaagcacgcttagacaacgatgtccaatctttggtctgcccattaagggctgactccgctaggcaagaggactactactgggattattctattactaattgatgacctgggctcttctttctccactacagatattgactgacctgttgatagtatagcgggggcagtaaagaggaaaggaggaaaaagaagtagagttaggttctgttcttgtgtgtaagccctcggtcgattcgtctgctcattcgcagcgtatgattcttatccaattgcttcttctgaaaacgcggcgtcggttaatctttcttattctcccttcggggctcctcatgttgctactaatagaaacagttcggaccttgctcatacaatcctcgggactactattggttaatctttgtcctccctagggaaagtaaacaagacgagactttttgggaaagacagggttagcgccctttggttggcggaagcgagaatcatcttttgattttttgaagttcaatttctatcagaggacaatatgaatattataccatgttccattaaaacactcaaggggttatacgatatatcgggtgtagaagtaggccaacacttctattgacaaataggaggtttccaaattcatgcccaagtactcatcacttcttgggtcgtaattactatcttgctaggttcagttatcatagctgttcgtaatccacaaaccatcccgaccgacggtcagaatttcttcgaatatgtccttgagttcattccactaaaatacctttgaatagcgctgaagatatcattgctataaattgaaagaatagagtgagatttgtatttgaactagctaaggcatacttcactgaactcctgctttccagtctgcgcttcgcttcctctcggtcgagtaagattcccttagctttgatttgcttccatctttctaaactctgttgtctcggaaaagaaagtatcatgttgctcctcggaaaacgcgtatagtagtctcattggccaaagtaaagtcgatgggacgctccagtgtatgcgttactgtactgggaagctagcattttattttgtcatggcgcaaaagcagatatggtccggtattcccttgttccccgtattggttatgttctttattcctcgtctagcagaaactaatcgagctccgtctgatctccctgttccgcatggcatgaaaaaaccaatcaaatcttcgtttccttggaaaaaccgaggccagttgagatcagtctccctttctaggagcagagcttaaaaagatgggaaattccaatgaatttcgatcacaatcatgtggtaataatgggtttgaatcagagagactcgatctggaaactcctcaatgattataacgtgaactcgttgaagagaaggagacaagcagaaatagacgctttttttgaaccatttgagagggcgcagcgtatccgtttcaataactggcagaacggaatagagttgttagatggggctgaatggaggaacggcgatatagttatccctggaggcggcggaccagtaatttcaagccccttggatcaatttttcattgatccattatttggtcttgatatgggtaacttttatttatcattcacaaatgaatccttgtctatggcggtaactgtcgttttggtgccatctttatttggagttgttacgaaaaagggcgggggaaagtcagtgccaaatgcatggcaatccttggtagagcttatttatgatttcgtgctgaacctggtaaacgaacaaataggtggaaatgttaaacaaaagtttttccctcgcatctcggtcacttttactttttcgttatttcgtaatccccagggtatgataccctttagcttcacagtgacaagtcattttctcattactttggctctttcattttccatttttataggcattacgatcgttggatttcaaagacatgggcttcatttttttagcttcttattaccagcgggagtcccactgccattagcaccttttttagtactccttgagctaatctctcattgttttcgtgcattaagctcaggaatacgtttatttgctaatatgatggccggtcatagttcagtaaagattttaagtgggttcgcttggactatgctatttctgaataatattttctatttcataggagatcttggtcccttatttatagttctagcattaaccggtctggaattaggtgtagctatattacaagctcatgtttctacgatctcaatttgtatttacttgaatgatgctataaatctccatcaaaatgagtaatttcataattgaataaaaacgaggagccgaagattttagggggcgggagaaaaggtcaagtctaagcgacatatggcacgaaaaggaaatccaatttcggtaatccgaagcccaccttaccttaatccattttcttgaggatcttgcatttgttcgttctctgccgacctattgtttccatcactcctgttgcttcttcctttctctatccaacccgagctctatcgcccatggctgaactcttctctgcagcctcatcgccaacaaaaggtccacatccttcaatcggcatgtactatggaatggctttaatgtttctatatccggaagtagggaatctcgtgcttgcatatctaaatctaagttttgagacagacctttcatgggttcaaagaaaagaagagtacgagtgggtgatgtgattgactaataggaaagtgataggagttgtgatcgggtttctttctttttttgccaaggatattcttattcactgctcagagaaaatgaaaaaaaacaaactaggattcttccgaactcaactccgtggccaaaaccatcttctcactctgacccccacatatcagatcccagatgcataggaaaagcggtatcaagaatagtagtataaagaaagatagtacagtactcaagtaaatgaattcgcctaaggatcgatggaaagatcaaggtccccgtgaaaaagtagatactagatcgatatgatactctcatctctggagtaacttcttccattatgctgatctctaggtccgttccatcatcatcgtaatagtatggtcccaggtgtccgagctatagatcaagatcatatttagtcacatttctaccggtgcacttctcatgaaataattccctttccaaggaaaggaaaacaagaactcgaatactcgtaatagcgatcccgatccacctacttttttctattctttgattcgaaacgtgctaaagcacaagccatttttatgcatggggcataagagtggacaatctatgttatcgaaggaagtaaataacaacacttcagcgtttaggtctaccttcagtaaaccaatagttttgcagcattggaatttgagttggccaggtaaggtcctctaaaaagaaaagaagaaactacttagaatagataaatgccattggttttctcgtactatacgatctttttttgttttgttttttggccatgattgtgctgctcctgtgaaggctagtgggaaagctcaccgttcgttgtgatgagtgggggccttgtatctgtattcggatcagctccttaacagagtttcctgcttgaaccctggctgggagctgggagaggtgtcccactacaggtgcaaataaaccatttgaccttacaggggaaaggaaacaaaccactcaataatcggtagaaattcctcctactgaacagctttccttttctcgccttaactactacttcaaagcaaggcggaatatcacgggataggaatgaaagaacttcttactcaactttctagctatataaaaatagttagcaatatgaaacgagtaacttaagccctagtaaaaggctactctttgaatcccctctttaaggcatataaaattagtactcttcctgagctagcttaagcatatcttgagcgagtgagttgtatttccctccatcaagttctaagcgatcaaataaggtccttgctctcgagccaatgccaataccaatagagagggtctaaacgaaggattcaaaggaggttaccggttaagggcaaatgcaatctctaagccagttggagaagaaaggtaatcaaagaaagtttcagttggacttaccctgccaaccctaccctaatttcataccctgcggttttcgttcctctattgatatttcgttcctctccttacgtcgagcgacctggattattctgagcacttcgcacttctgaaaatcgtataaaaatgtgtggttccgaatgagataacgcgcaacggctttcgcgctagttgctcaaaaaatcgtataaaaataaagcaatcaaaaggtgaaggcagggcagtgggcgtgggactgtaaatcctttttcgttcgctgggcctgggccctttggactctaaatccaaacggagtgagtggttcgattccactttagaacgaaagcaaatgcaagtgaaacgagacgagaatcaaagatttttcagtgccgctaaaaccagatctggaaaagtgttcagtgcatcctaatctgaatctgcgaaacctttctattctaagacggctaagtcgagggcagacacaacaggtcccgaagaggttcgaaaaggcgtacatgagttcctcctacataaggggctcattggttgtcaaccaagtgagaggggtctaataaagctgaaggatgagtatagataccttcagccgagatcgcttgggaggcatagccgcctctaccaggagattctctcttatttcttaagaaagtatgaattgccatagaattcttcgaggcctgattcaagatctgaagtatgaattgaacattggttaaaaagaagagagagagatggcgatggcagtctctctctctcttctttttaagggatattattgacaggcaaaaaccgtttttgagaatgataatacttcatggtgtatgtagaactcaacatctcagtaatttgcttctcaatttcatctttaagggctggattatgccggtaattacttacctcacaagttacattaatttgcttaccgtcagtgtctcgactcttgactaccaaagcattataaatataaggtaacttgcccgggggaaaagtgacatccagcacgggtccaataatttgatcgatacgccctgtacttttttcttcaattgtagaaaccccgggacgagaagtagtaggattggttctcataattatcacataattttcaaaaaaaaggaatttatcgaaattttgatttttttcttgttgaataatgccaaatcaacaccaaaaaaatatccaaaaatccaaaagtcaaaaggaaatgaattagttaattcaataagagagaaaaggggaccagcacttgatttcgttgcccaaacgaatcccattcaatcgtttactcatggaatgagtccgtcggaaagttcaatcaatctttttttcatatacattttgccttttgtaaacgatttgtgcctactctactttcttatctaggacttcgatatacaaaatatatactactgtgaagcatagattgctgtcaacagagaattttcgtagtatttaggtatttccactcaaaataagaaaagggggtctattaagaacttaataaggattagaagttgatttggggttgcgctatatctattaaagagtatacaataaagatggatttggtgaatcaaatccatggtttaataacgaagcatgttaacttaccataacaacaactcaattcttatcgaattcctatagtagaattcctatagcatagaatgtacacagggtgtacccattatatatgaatgaaacatattatatgaatgaaacatattcattaacttaagcatgccccccattttctttaatgagttgatattaattgaatatcttttttttaagatttttgcaaaggtttcatttacgcctaatccatatcgagtagaccctgtcgttgtgagaattcttaattcatgagttgtagggagggacgtatgtcaccacaaacagaaactaaagcaagtgttggatttaaagctggtgttaaggattataaattgacttactacaccccggagtacgaaaccaaggacactgatatcttggcagcattccgagtaactcctcagccgggggttccgcccgaagaagcaggggctgcagtagctgccgaatcttctactggtacatggacaactgtttggactgatggacttaccagtcttgatcgttacaaaggccgatgctatcacatcgagcccgttgttggggaggataatcaatatatcgcttatgtagcttatccattagacctatttgaagagggttctgttactaacatgtttacttccattgtgggtaacgtatttggtttcaaagccctacgcgctctacgtctggaggatctgcgaattccccctacttattcaaaaacttt

SEQ ID NO: 19031 - DNA, 12880 bp, Oryza sativa
  unsure (1)..(12880): unsure at all n locations
ttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgattccataaatctacgcagttgcccaagaattaactattcttcttaatcaatgatttcttatatagagagaacggccctcacaaattgcaaatactaatttgttaagaatcaatcgaattgaagtcatagtgtcatcgttggctggaatcgatatattcgcgagatctgggtcacaatttgtatcggctaaagaaatagtaggaatccccaaaatggcacattcccgaagagctatatactctttttgctgatcgaggacgatcacaatgtcaggcaacctcgtcatatatttgatcccgccgagatatctttgcaaggtagataattttctcttcaagattgccacatctctttttgggagatggtggaatttttccatcttttcttctgttcttaagtctctaaattgagaaagtctagttttagtaatcgaccaattcgttaacataccactgaaccactttttattaacataatgacaacgagcccttattgcagctgatgctactaaatccgctgctctttttttggtaccaacaattaagaagctttttccctgacttgctgcatcaaaaactaaatcacaagcttctgataaaaaacgggtggttctagcgagatttgtaatatgagtacctttacgctttgccgagatgtaaggggccattttaggattccatttcttaataccatgaccaaaatgaactcccgcttctatcatctctttcaaattgatgttccaatatcttcttgtcattttttccacacttccttttgattttttcttttttttcatcctacctttccattacgaaatttctttcttttcgaagattaagaaagagccgaaatagcttgaaataaataataattgttccgatggaaccttctacatggtataagcataaccttaatgaattaactaaacttctttttaaattaaaataaaaatagaaaatctaacctcttagcgttctaaggtcaaaaatctagtttaaagtaaaaaatctgctttatgtatccttaaatcatataaatggggtaaatggtgattctgatgtctcatagaaattgtttgttacgtcagaatcagaagaaactaattctgtatggagaaacaaaatatctctcatttccgacgcaaatagttttttttttttgaatttcgaaataaaggttcttgtcttgtgggtaacggtgcacaaatttttggaatccggtaccaacaggtataatcccccccagaactacgttttctttcaggcctttcaaccaatcaatacgacctcgtaaggcagcttttgctaaaactcgagcagtttcttgaaaacttgcttcagatatgaaactttgggtattcagggaaacccttgttattcccaataagattgcccgataatagatcgattcatccaaagcccgccctgctcgctctgctcgcaatagtccaattaattccccaggtgaaaaaacattagacattccatcttcggaaacccgcacttttgatgttacttggcgtataataatctctatatgtctattatggatctgtaccccttgggatcgataaaccttttggatcttattaaccaaagagatacgactttgggctatggttaactcagctccaatcaagaatccccaaggacccccaagaattcttggtatacgctcattccaatcctcaattctcctttcgagattcggcgatagtgaatcaattgaacgcgcttcgaagatttgttctacttttggaagaccttgcgttatgtcactagatctcgctttttcgtatataaacgtaactaacctatcccctttgtaaaggatttctccataatgaccatgaacagttgctcctgtagtggccaaataaggcttagctgctcttataacaaaggaatctatatttacaatgaaaatttgacctgatttttttatgtgcgatttaaatagacatacattttcgcaaataaattgtccaaggtgaatttttgctgatgtctcttcccaagaatcatgagggagaaagtgccaatttaactggaatggatccaacatgatgttactatcgaaatttgaagtcctttgattttcatttattaaagagtgtttaagtccttgaagtactttgaagttttgtttcaaattgtcaaggagcaaatgcttttttaacaggatctgattatacgttagtaaatagtaagatgaagaaaaattcgatatactaggtgcaatagtacctaagagtcccgaaaaatttcgaaagagccccaaaaattttggaataggaattctaggattcgattcttttaccccattgggattttttgaattcttaaaaaaaccaattcgagaacagttggatgccgacaaaaccatcaaagattggtattctttatttcgattcaacaaggtaccaatagcttcttgatgttggctaagtgattgaatcttcgccttggaataaaaggaattggtattggtgcgatctaacctattatggagaatcagtcctgcacttctgctatcatacctttttcgtgtatacgaaatagtggatttgattaacccaattcttaggaaatcgcgaatcagaccatttgctcttatctcaacaagggaagcacgagcctcctctttttcttcttgttcccaattcaatactaagcaagttcgaacgaattgactattcgtatgataaattctttgagttaacttgctattttcatgagaaataaaattgacaagtcgaagttggagattaccctcttcctgcaagagatcctgtgggaaaagtgttgctaaatttttactataataaaccgaggtaaaaagatacaaattcttcctgttcccggtaagaaatatagtgaaatcgtctttcccattctttcccccgaccctgctatgaagaaagacgttcatttcttaaaatatcccatatatgtggggggaaaccgaggaaggggacagatctatcctgatggtagcaagagtaacaatacggtctataatgcaacgtcaacaggtgtagtaagaaaaatactgcgtaaagaaaaggggggatatgaaatatccatagtcgatgcatcggatggacgccaagtgattgatcttatacctcccggtccagaacttcttgtttcagagggggaatcgatcaagcttgatcaaccattaacaagtaatcctaatgtgggagggtttggtcagggggatgcagaaatagtgcttcaggatccattacgcgttcaaggccttttgttcttcttcgcatccgttattttggcacaagtttttttggttctcaaaaagaaacagtttgaaaaggttcaattgtacgaaatgaatttctaggtcccgggatttcttaccatcaagttggtaaaaagccgcgatttattggcgattgctagaattctctatgatccattttggaaatcttttttttgtttagactattttttgtttgcgagatgtcttgtctgcaattccttatttctatcatctcatgcaaaacgaggagaatgcaaggcaagggcgagaacaataaaaggaacaaatccttttaggagggattgctggtcttcttaatcctctattgggcacaagaaaaaggcttttttgcctttttcttgtgtcgattcttcttgtattgtatcgaaatatgaatcttttttcttcctattcggcaaagattactatttcttctttatttgggtctgtctcttgaacctcttttgcttaggttcaggcgatgtagtggacaaaaagagggaaagaaaatatggcgggggacaaattttttgtgaccaaatagaattgcttgacttgttcaattaagttcaatttagaacttacagaaattttgcaaaaaaaacggatactcttccattgaaggctgttttttatttttaggctagttgagtagttttaattaaggttttattagtttattactctaaattaaatcaatgatttacaagagacttcctccggggaataaaatattggatcctcgattgatcctttctttctcctcgcttcataaaagtgaattaatttcattggcgagggggttataaatcaactgatggattacttcactaacattattaacaaacaaaattaacaaacaaaacgaataaatagagggattctgaccatcagagcaaaggctttctctttgttatttttacaaatcaaaataggaaacccgtttgtaggttatggaatagattaaaaaagtcgggttataagagtaagaattccgcgggtcctttccgctctaatcagataaaagggggtaaggacccgctaagttcctattttttcatgtttacaacctggtccctccaattactatagagatgaacccaatccagaatatgaaccgtaaaagaaaacacctattaaaccaatcacagcaataccggttacagtacctatcagccaaagaggaattcttccagtagtatcggccatttcccctactttcctccacattttatcaagtggtcatgctagagacaaaaacagtcatggatagttataaggatggtatccttccaaatggggataagagaattcttactactctctttctttctctcaattgaagaagtaattggaaaataaaacagcaagtacaaaaatgagtaataaaccccagtatagactggtacgattcaattcaacattttgttcattcgggtttgattgtgtcatagttctatagttggaatttggtttatcgttggatgaactgcattgctgatattgattctaagaaaaaaacagtaggtacagctagtccgtgaacagccagccatcgcactgtaaaaataggataggttcgatctatggtcattgagggcctcctaaaaggatctactaaattcatcgagttgttctaaagaatcaaaacggtcggttattaacggaattccttgtcggctttctgtgaaatactcgtttggccgaggacttccaaacacgtcataagctaaacccgtactgacaaataaccaacccgcaagaccgtttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggagccttggaatggtcttaactgaatattcagccaaaaaaaaaagaaggaaaagattccattaagacagttatgagtttgattgagtttcccctacttgaccaaacaagttccaattccgttatttcaactacactaaaagatctttcgaattggtcaagactctctagtttatggccccttctatatggtaccagttgttgtttcattgaatttgcttcattaataggctcacgattcgactttgatcgttatggattggtaccaaaccaagatcaagtcctaggcaagcggacctaattttaacagccggtacagtaacaatgaaaatggctccctctttagtgagattatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttacaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaaagaacgcgaatcttatgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactaggaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatcccttttttctgtgccaggaaccagatttgaactggtnnnnnnnnnnnnnnnnnnnnnntgctctaccaactgttctatcctgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttcttttcctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaacaaaatatctcaaaaaatgtctataatgatggactgaaaatacaagaaattcgcatgttctctttattatgttttcgtatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaattttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagcttaacatggtggttaaccgtattatgaaagacggaaaaaaaatcattggcttatcaaattctctatcgagccgtgaaaaagattcaacaaaagacagaaacaaatccactattggttttacgtcaagcaatacgtagagtaactcccaatataggagtaaaaacaagacgtaataaaaaaggatcgacgcggaaagttccgattgaaataggatctaaacaaggaagagcacttgccattcgttggttattagaagcatcccaaaagcgtccgggtcgaaatatggctttcaaattaagttccgaattagtagatgctgccaaagggggtgggggtgccatacgcaaaaaggaagcgactcatagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccaggaaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgttattcgtattaacagctactctagggggaatgtttttatgtggtgctaacgatttaataactatctttgtagctccagaatgtttcagtttatgttcctacctattgtctggatataccaagagagatctacggtctaatgaggctactatgaaatatttactcatgggtggggcaagctcttctattctggttcatggtttctcttggctatatggttcatctgggggggagatcgagcttcaagaaattgtgaacggtcttatcaatacacaaatgtataactccctaggaatttcaattgcgcttatatccatcactgtaggacttgggttcaagctttccccagccccttttcatcaatggactcctgacgtctacgaaggagtgtggttcgttcgacaaattcctacctctatatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaacgaatcaaatcagatggttctatttctcaacctttctgacttgctcctacggaaccaaggtcgaaaggattgaaaaagtcagtcattcacaaccactgatgaaggattcctcgaaaagttaaggattagtagttctttttcgaaatcgatttcgaaaaagaatggattcggtcttatacatacgcgaggaaggtaatcaaaaaagaaagaagacaagttcttctttcttttatcacttaggagccgtgcgagatgaaagtctcatgcacggttttgcatgagagaaagaagcgaggaatcctcttttcgactctgactcccccactccagtcgttgcttttctttctgttacttcgaaagttgctgcttcagcttcagccacgcgaattctcgatattcctttttatttctcatcaaacgaatggcatcttcttctggaaatcctagctattcttagcatgatattggggaatctccttgctattactcaaacaagcatgaaacgtatgcttgcatattcgtccatagggcaaatcggatagcattaatagttgagtctgaaatgaattttctcaatgtatttcatttacacaaaattacttaacattaaagacactgttttacctactccagctcccccaaatagtccgatttttcctccacgccgataaggagctaaaagatcgaccaccttaataccagtttcaaagatggataatttcgtatctaactcgataaaggcgggcgcggatctatgaatagggaatgttgcactagtatctacaggacccaaattgtcaacaggctccccaagaacgttgaaaattcgtccaagagtagctccaccgacaggaacactgagaggagctcccgtgtcaatcacttccattcctctcatcaacccatctgtagcactcatagctacagctctaactcgattatttcctaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttagtttttttcagaatcctatttttgttcttatacccatgcaatagagagcgagtgggaaaaaaaaggtaactttttttcatttttcccttaaaaaataggctttcttggaaataggaatcatggaataa

SEQ ID NO: 19032 - DNA, 1490 bp, Oryza sativa
tcctatttggaaggttgcaatttcttaaccgcagcagtttccacccctgccaatagtttagcacactctttgttgctactatggggcccggaagcacaaggggattttactcgttggtgtcaattaggtggtctgtggacttttgttgctctccatggggcttttgcactaataggtttcatgttacgtcaatttgaacttgctcggtctgttcaattgcggccttataatgcaatttcattctctggcccaatcgctgtttttgtttccgtattcctgatttatccactggggcaatccggttggttctttgcgccgagttttggcgtaccagcgatatttcgattcatcctcttcttccaaggatttcataattggacgttgaacccatttcatatgatgggagttgccggagtattaggcgcggctctgctatgcgctattcatggggcaaccgtggaaaacactctatttgaggacggtgatggtgcaaataccttccgcgcttttaacccaactcaagctgaagaaacttattcaatggtcaccgctaatcgcttttggtcccaaatctttggtgttgctttttccaataaacgttggttacatttctttatgctatttgtaccggtcaccggtttatggatgagtgctattggcgtagtcggcctggctctgaacctacgtgcctatgacttcgtttcccaggaaatccgtgcagcggaagatcctgaatttgagactttctacaccaaaaatattcttttaaacgagggtattcgtgcgtggatggcagctcaggatcagcctcatgaaaatcttatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtg

SEQ ID NO: 19033 - DNA, 5193 bp, Oryza sativa
  unsure (1)..(5193): unsure at all n locations
ttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctctttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactataccggttttcaagaccggagctatcaagcactcagccatctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtatttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatgttagccccctttgcaccccactcaaaaaaagagcactacagcggcgggaatcgaactcgccaacagggttccctaacccggggattcaccgaaacaaacaaccagcaaacagcttttaaagggaaggagatagactgtgcctttctttcatttattttttcttttctgcaaggtagggggccttgagagttcctcttgtggtagcaagttacttcgcaacctgctcaatttggccttatagggtcgggaactaatgaataaaaagggttggataccgcccaaccacccagccctctaccatatctagacaaatagaatagtccttttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaannnnnnnnnnnnnnnnnnnnnnnnnnnnnnnnnnnnnnnnnnnnnnnaggggttatagtcgacgttggttgattattattaacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgagaaaagaattgggtttccaccgagctgaaacaatatgctgatggttctagtaaaccaaaactaccgttttttagctatttggcttccatttccttttttaacaaaagaagatttagttacgattggaaataaatttttttgtatctttatccatagatcctttactcatattttaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagagcatataggcccgagaccattaccaaaagttcttcccaataatcatattgggtatctgttcccttccttttcctattaggatggggcatgttggattttccatatccatataccattacagaaaaagttttcatttattgggaaagaatcaatgacatacaatgcattacagacgtatgatcattaccctttaaccgggttattctattccacttctagatagagaaaaaaactaaaggagaatgaatgaaaaaagacagagtttggaagttagacccctttctaagactctctttcaaaaaagaggacattttgaaacttttaacaggcacaatcgtgagtcaacaagtgactcgaaatgctcgtaagaaaagagaattgattttcaaaatggtagaactagatgacgaagttttctataaccttgatgaagaggtagttttagtttacgactccgatcaagagcgagaagtctttcatttcagattggacagctatagaatctggacccatcgtagagacgttcaaaaggctcctgatgataagaatcatactttcacggaactccatggggctatgggcttcaacgcggtagacgttttgttccgaatttttctggagcaaacctccgacccaacgatacaatgaattttttctattcacaaagaaaaaagattcggaatcgcaatgctactatacgcacccggaggaatattcagaattatattcttatataatccatttttgcgcggggtcttactaacaggacttcgctgcacgagacgaggattcgtcgaaaagctaaggtcatccggtattttcataccctttgggggtggtatatggccttacaaagtctaaggggtagtatgagatctgtagtaggtaaaagaatttgtcccttgattgagtatgctattttccctcctttaccgcgcattattgtatatgcttctagaagagcacgtatgcagagaggaaattacagtttaataaaaaagcctaaaaaagtttcaactttacggcaatatcaatcaactaaaagtcctatgtatcaatccttacagcggatttgtggggtccgagagtggttgaataagtattgcatgtggaaggaagtagacgaaaaagattttggattcgaaataggtgcattcgactaggtcgtactttgaatccaatttcaagttcgattagaaggatagaaaggccgcgaggatcggaaaagaaaaatcaaatctttttaattgcttctccttttttgctattttcttattatttatataatccattcgattcttttttttttagaatactaaagtattctaaaaaaaagtattctatactataaaaaatctttttttgcaaactcaaaaatacaatagtcaatattcgttataatagatatacttaattatatcataagaatcttaagatattttttgaatagatcaaatcgaatagatagaaatagtaaatttgaatggagacacctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatatggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatnnnnnnnnnnnnnnnnnnnnnnnnnnnnnnnnnnnnnnnnnnnnnnnnnnnnnnnnnnnnn

SEQ ID NO: 19034 - DNA, 754 bp, Oryza sativa
  unsure (1)..(754): unsure at all n locations
cctattctatgatggattttaacttaccctctattttcgtgcctttagtaggcttagtatttccggcaattgcaatggcttctttatttctttatgtgcagaaaaataagattgtctagaaccgacgggaccgaattttctcaatgtatttccacacaggatcataatatggatcttttgtagtgtaagtaatataatatggtatgttatgtggctctttctacacacaaatgcaaacccgctatggatggggattatggatgcggatataggctacgagcataaatgcatgcatatgcggaaccgggtatagcgagtttttttaagtggatcaacaaatactttttgaatagaaagtcaatgtatctaaccaattattttacaggagtatctagttggcgaaggcgatttcagaatcaaaaaaagtaaagtcaaaattgtcgcgaccgggaaaattgccttttcccgaacgctagtgtattaatccccgtcccaggaaaagccggggtacaccatacaaacatgatataaaagacacatctttattacatcgataatatttacattattacaaaggcgcttcaggcctgacaatcaaaaataaacagcagcggactagcgggcctacggctccatcttcacaggcgctcaactggggtataagccaggactccacctaagacatcttctccannnnnnnnnnnnnnnnnnnnnnnnnnnnnnnnnnnnnnnnnnnnnnnnnnnnnnnnnnnnn

SEQ ID NO: 19035 - DNA, 925 bp, Oryza sativa
  unsure (1)..(925): unsure at all n locations
aaaaatacaaggtttttttatttgaaattaaaaaaagaaaattgggagaaaaaaattatgccagaaaagaaaattgggagagaaaaaaaattccgagaagaaccaaaaattctttcgaggggttaagttatggaagcccaccccacggaattgttccgcgttcgcttagagaatgacaccatcatctctgggctatatttcagaaaagatccggtctagttctatacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttctttttttttctagggtaaaaaattcaaagttctaaaattcaaacaaagacacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagnnnnnnnnnnnnnnnnnnnnnnnnnnnnnnnnnnnnnnnnnnnnnnnnnnnnnnnnnnnnnn

SEQ ID NO: 19036 - DNA, 737 bp, Oryza sativa
  unsure (1)..(737): unsure at all n locations
nnnnnnnnnnnnnnnnnnnnnnnnnnnnnnnnnnnnnnnnnnnnnnnnnnnnnnnnnnnnatagaagcccaaagaggtgcatatggtacccaaataaggataggatagatatgtcaaaagcaggtctgattacacctattcctaatcctaaatagaatgtaaggacgtggggatttctatgtaaacagagtatcctatttccataggctcgaatgaccccttctcataataagaatgtgcacggtctggtccggtatggaatgaacttataatctgatgatcgagtcgattccatgattataagttcattaccctagcgcccattcctattttgggcggaacagatctactaattcttttattccagttagtaagagggatcttgaactaagaaatagacctagcagcttaaagagggtatcctgagcaattgcaagaatggggttcattgatattcctggtatagtagatgctatcacacatacagtcatactcaattcgatggaattgtttgatcttaaaggggatcttctataatttcgcacataaggggttatttcttggtttcgtccagtcattaataacttgactatttttagataatagtagatagaaagaacgctcgtaaggagttctattgaaaccaagaaatataggcctgcttgccatccacaccagaatagatagagttttccgaagaaaactgctagtggaagaaagcctcctatggataagag

SEQ ID NO: 19037 - DNA, 697 bp, Oryza sativa
gggtaaattagtaataatttacattgaaaatgaattaatgttaccccagccacaagtcatccccgtcgaaaaaggttaccttaagtatttcatggtgtatgtagaactcaacatctcagtaatttgcttctcaatttcatctttaagggctggattatgccggtaaggcctgagattgatgggttaagcaccaggtataaggttgattgtatgatcacaggctcttctaggtggtagtccttcaggttcttggaaaatgtcatgaaagtcctgaataatttccttgacagcttcaggtacactggaattctcttcatgagtaacagactgcagctgcactaagtagcttaatgatcctagtctgttcaacccacacaactgatgattggtgatagaggagcattgtactgatttaggtaatattccttggagtctgacaagttttccttggtatagaaattccatccatttgttagcccagtctacctgcattggactgaaaagttcaagccaatccattcccaaaatgatatcataattcccaagtggtaacaccctgaaactgttacagaactgatttccttgcatccaccaattacagctggaaatctcatgagtacatttcatagttcctccatcagcaatcctaacagttaatggagtttgtaacttatgcacccctggtaacctcaaactg

SEQ ID NO: 19038 - DNA, 708 bp, Oryza sativa
ccgaataggtattgatacaaattactcgagatggattgggatacatattcgttaaaaatatagctagagtatgatttattcatctaagtagagaaatctctaaatagagacacttctttttagagaagggtaaaaatctctggttcttttctttatggtacagaagaaggtgagattaggttcccttttcttcatttttgcatttcttattccgctattccgaatatttttttttctttcttatcttatcttactttcctagttgttccaagtaatgcgcgcggtacaaagttcgtggtagggaacttctttgagtcatcgtattttctgtttatatgaaggaaatgaatatgtgattttccaaattggagaatcgaaatgaagcccttttttgctcagtctatctggacccttttgtataataggaattaattccaatataataggtattctgtttctagacgaaacagaacgtcaaaatattccttgacttgaataaaatcaggagttgtgttgtataagtgagcatgaatttcttatcattcaatgagcatcttgtatttcatagaaattgggggttatatagtccttacgtaagggccagcctatccaactttcaggcattaggatacgtttaaggcgtggatgataataataagagattccccccatatcataaggggatcctctagagtcgacctgcaggca

SEQ ID NO: 19039 - DNA, 238 bp, Oryza sativa
  unsure (1)..(238): unsure at all n locations
nnnnnnnnnnnnnnnnnnnnnnnnnnnnnnnnnntcccgtagtagcggcgagcgaaatgggagcagtctttaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaagg

SEQ ID NO: 19040 - DNA, 581 bp, Oryza sativa
taagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcggctat

SEQ ID NO: 19041 - DNA, 1100 bp, Oryza sativa
  unsure (1)..(1100): unsure at all n locations
nnnnnnnnnnnnnnnnnnnnnnnnnnnnnnnnnnnnnnnnnnnnnnnnnnnnnnnnnnnnccagagtaaaactattcgaatagccgtgcccgcggttatgggcgatcgaccagaatcaccgtgattagtctcatacttaataaatcgacccaatgcactgtagttcaggtgggttggttgggcctgttcaacgtggtgtagcgttgatcagtggagatttaatattactttaattactcaacagttttacccttttgctcaataaaatgttttacaatcgcctttatgcaaatagccacaagccatccttatatccccttgcacgcctgcatcgttggtgtggcttgctgagtacggtggttgtactcagccttgctattatttccccctttttagaagtgtagtgcttctgagctgaagacgaagttagaagaccaaggctcagaccccagttgagttttgcctgtggagtggagctgaagccccgctaggatcgcctttttctgctgctgtcgttctctttcggtgtgaggactaagtgcctcttctgtaagtatttttacgctttatttacgtttggaactgtttattacttgtcattttgtgtaccttagctagtcctggatagggattttatacacaaaaatagtctggaaatttggcctaaatttctgggcgtgacaggcggttggaaggtattaccgacctttctaaccgccataaccatcattacctgcctatttaaggagctcactctcttcatttcttcacacacttcaagcaacagctatctcatattctctcaagtttagtttagtagtctcaagctagtggagtaggaatagaatagaaatcggagtccggaagtcttcggaagagttcgggtatggctctagtagctctccttttctcttttgtaagatttgtactttatttagaatatttttctttatacaattctggtattgaaatactttctgagtatattgagtatatgaatgccaactttattttatgttcatgttatactgattatactgctaacttatctagnnnnnnnnnnnnnnnnnnnnnnnnnnnnnnnnnnnnnnnnnnnnnnn

SEQ ID NO: 19042 - DNA, 873 bp, Oryza sativa
  unsure (1)..(873): unsure at all n locations
nnnnnnnnnnnnnnnnnnnnnnnnnnnnnnnnnnnnnnnnnnnnnnnnnnnnnnnnnnncttataatctgtttcctataagtattgctgactgtgtctgtaacgaaatttcacggcaaatgaacaattgctgcagctgagatacgcagcaggagtgaaggacatgctggacaggtacttcaaaggggaagacttcccggtgcagaactacatcgtcaaggaaggtcagctcgcgagccagtaccagtaataacccttccttgtgtgttgggtgtccatcctgtggccaccttcccgcagtgaagggaaacagagattcggataggaaccaaaacaccttgtgttgttgttgttgcctgagtgttccctgagaaactattggacaccggaaataatggatgcctgccatggcaaccatggctccgaagaataaaaagccctcggattaaacagttcagttcagttcgtctatgtatgatcttttatgtgctttctgctctctgtttttgatgtgaattttctggtccagtactccagttgcacataacaattgtacttgtacctgagtacctccatgccaggggccgggggcaccctttgccttactgcctcggcagtcggctggagggctgcagtctgttatctatggaatctttggttagttgttgcctaaacttgtccttaaccaagttgtgacatgttgcccaaacaatgtggttaatagtagtagttatctaaaggacgtaactacacggctagtggtagctggtttgtctaaaccagctaccactccatctataagaggcaccatccacctatacttcaaatacaattctcttaaactactcatccgatgtacgattcgattacaccg

SEQ ID NO: 19043 - DNA, 1260 bp, Oryza sativa
gaaatatagatggaaatgttataagctactgagaaagtaacatttctttttgtgccacaagtgcatagtatcacctccttcagttcattgcttttcctgtcactaaacatactaacttcaaatcagctgcttacattttggtgagcttgtgtttctatccttacggaattgccattctttaggatgggataagacgagaagtacaaaccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtctacctacactcccaagggcatattcacagagatgtaaaggtaatattgaatctccaccattctattagagtggaagcataatatgtagcagcacagaatttgcataatgcgttgcactggactcaatatgaaattcaatcacatttcacctgtccatgttttagacttagagacattgggatgacacatgattaatggagagacatgaggcatcacatttttgttgctcctgtgttatattgagggtacagctaattgacagccagtgtgatttaaggcttgggaacaatcactgactcgcatatgcctcaccttgggatggttatgcacccagaagtttagtgccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatg

SEQ ID NO: 19044 - DNA, 561 bp, Oryza sativa
  unsure (1)..(561): unsure at all n locations
nnnnnnnnnnnnnnnnnnnnnnnnnnnnnnnnnnnnnnnntttatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatccgcgatgtccgccgacgaggatgccattcaccttctgtcccgggggtccgtctagcaacttgccgagaaacaacccgccgccggaaccgggtatatgtcc

SEQ ID NO: 19045 - DNA, 725 bp, Oryza sativa
  unsure (1)..(725): unsure at all n locations
nnnnnnnnnnnnnnnnnnnnnnnnnnnnnnnnnnnnnnnnnnnnnnnnnnnnnnncttcggattactgcatcagattgggagtcaagatctgctttgcctcggttcctcacgctcagagcaatggataggtcgagagggcaaacggcatagtactccaaggaatcaagacccatgtctacgacagattgatgtcacatgacaagaagtgggttgaagaactcccctctgtactatgggttgtgcgtaccacaccgacaacgtccaacaaggacacacccttcttcctcatgtatagctcagaagccatgctccccactgagctacgacatcagagcacacgagtacagaagtactctgacgaggatcaagaggagcagcaaagcgacgatgtgaatctactcgaggagcatcgagaaagagttaccgtcagagcagccagctaccaacaggcccttcgccgataccacgagaagcgcatcagagcacgcacgctttcgatcggcgattacgtccttcgatgggttcaaagccaagcagggcgtaacaagctctcacccaagtgggaaggaccatacacgatcacgcaagtcttgcggccagttgcattcaagattgcagacgacgatggtcgcgagttaacaaattcctggaacattgatcaattacgtaaattttatgtataaatcaatagtatccatactttgtagacatcttacgacttcat

SEQ ID NO: 19046 - DNA, 603 bp, Oryza sativa
  unsure (1)..(603): unsure at all n locations
nnnnnnnnnnnnnnnnnnnnnnnnnnnnnnnnnnnnnnnnnnnnnnnnnnnnnnnnnnnnnnnnnaaagaaattcgagtagcgcgttgaaaagtaggacctgcattctttaacccaaaaggcattgaagtataacaataggttcctacaggggtaatgaacgcagttttttcctcatcctccctagccatgcgaatctgatggtaaccagagtatgcatctagaaaacacaaaaggtcgcaccccgcggtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcctccagaagtctcgccacctcctcgcggatgaaggcttgacgttccggggcctggcgccgcactttctgccggaccggccttgcgctcggccgtacggcgagacggtgctcaatcacctccctggggaccccgggcatatccgccggtctccatgcgaagacgtcagcgtttgcccgcaggaaggaga

SEQ ID NO: 19047 - DNA, 755 bp, Oryza sativa
  unsure (1)..(755): unsure at all n locations
tagtttctcagggaacactcagccaccaacaacaacacaaggtgttttggttcctatcagaatctctgtttcccttcactgcgggaaggtggccacaggatggacacccaacacacaaggaagggttattactggtactggctcgcgagctgaccttccttgacgatgtagttctgcaccgggaagtcttcccctttgaagtacctgtccagcatgtccttcactcctgctgcgtatctcagctgcagcaattgttcatttgccgtgaaatttcgttacagacacagtcagcaatacttataggaaacagattataagaccaatccaaatgcccacatataatctatgctagacataatacaagcaggacccgttgccaatgtagtgagaaattgaccgccgaatctcaaccctatggctgaataaagcagttgtgcatatttaatctagcttggagtaaaaacatcttatatgattttgatcttaagaaacaattattgatgaatcaataaagtggcccttggtttgtactatgtatcatgcaaaacatgcgctgccatctgggtaactaagttactcatctcactagctgacatattgctctacagttttgttaaagcattgtgggggtacccacagaatcagattctagaattttatgctccaatgccctaagttaaagtagaaaacatannnnnnnnnnnnnnnnnnnnnnnnnnnnnnnnnnnnnnnnnnnnnnnnnnnnnnnnnnnnnn

SEQ ID NO: 19048 - DNA, 699 bp, Oryza sativa
  unsure (1)..(699): unsure at all n locations
gaattcgagctcggtacccgggatgcatggtatggtattgcggacttgacagaaccgctgaatgtacgatcgaagtgactcgtcgtcccttcgctgtacagcgtgcaagtccgcttcctcaccggtgcgcggatatgtgccctggaagttcatggtgaactgttggcacaaatcctcccaggagtggaccgacgcggggggcaggttcattagccaaccccgcgcttgccccttcagggccatgggaaagaaattcgccatgaccctgtcgtcacccccggcggcctcaatcccggtcgtgtagacctggagaaactcggcggggttgacgctgccatcatatttttcggcgatggtgggccggaaccttgggggccaacggacattccgaagactcgccacaaaggctctacagccgacaccaccaaccgggggcacggagggctgattcccacgtccatgtcgaggtgacactctggacgaggaagcgccctccgttgcgtgggcagcacttcggtcattgcgccggcgcttgatgctggcgcgggcgtcctgctccccacgcagatcttcccgggtcgaaggagtcgacgaaggagtggcagccgaacggagaacagcggctgccgctcgtcgtgccctctnnnnnnnnnnnnnnnnnnnnnnnnnnnnnnnnnnnnnnnnnnnnnnnnnnnnnnn

SEQ ID NO: 19049 - DNA, 5429 bp, Oryza sativa
  unsure (1)..(5429): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggagttagtgggggataactttatagtaagataggattatattaagtgggttgcaactatatatatatatatatatatatatatatatatatatatatatatatatatatatatatatatatatatagaggtttgaacctagaggttcggatctcatctcatccgttatggaaaacgagatagttcattagtacataattattaacttattagtacatgattaattaagtattagtaaaaaacataaaagttaatataacttttttatagaaaatatttttaaaaacatattgttcaaccgtttagaaagcccgcgcttgagaaacgatgggccagggtttacgattccgacaggcccttccgtttcgggcactggcggaattcggaatttcgcgaaatccggtggaaaactagtaaatttcgaacaaatttcataaaccaaaatttgaataaaaattccctaagtttgccgacaagttcttgaaaaccggtcggttttggcgaaatttcgatcactaatccggtccatctaagtgttttcctttttttaattctttattcttttctttcctgatgtaagtttcagtaaatacacacaatacatcatttttttggaaaaattatatcccaataggttctatgaatatcatagtatttataagattttatttgattttttttctttttttatcaattcaaatttaaatttggatgaaacttctcgaaatctcatacggtttctactttcgagcctcgtcgaaatatcgaattttcgcgaaatccgaccaaatgtcgtcggaatcgtaaaccctgcaatggctataagctgagataggaagcgcggaacatagctaggaaagagaaggatacgtacctgcgcagccgtagatgcaagcgcgcggccgagcagctgccccgccgccgacggtgccctccacatcgccatggaggaaaggatatgaaattgagctcagcaacggcgagcaagcgagagagtggcacaagaggcagtgagtgtgatggaatatcgatcagtattcagtgcaggcaagcagccgactcgatcgatgcgatggaagtggaagcctggattggaagggatggatatttgtagctccgcctccgccacctcgcgccgcccgcgtggtggcccctcggctgctgcgaccgtgcagtcagcgtagtgcatacccccagggccttgcctttgtcaggtaaaacctgagcataggtggattcatggaaaggcaaatactcgcgtgaaaggtgcgttctaatctatattttctcaacttctttctcgttgtctacatacacgttttttccaaattattaaacacgttttttccaaattattaaacagtataattcctctattccaaattagacgtcgttttgactttttttaacgcttaatcattcgttttatttaaaatatttgtgcaaatataaaaagagacaagttatacttaaaatacttttaataataaaataagtcacaaacaaaataaataataattccttaatattttgaataagataaatagtcaaatattaaataaaacttaaaacgacaagtattttgggatagagttaattttttaaaaaaaactattaaaaggtatctttgaaattttatattaatctatttttctaaagctttttaagctaatgattaataataagccactctattttacttgcttctttagagaaaaggttcataacacctactgccacagaccgacatccgtgacatgtactcaacaggccagggcccagggccagtgaaccaccgagtccaaggtaaaagccatgaggcgctggccgcctgtaataattgttctgttccatacgtctctcgcggtcgttccaatcgaatggctcttgtttcacaggaggaaagctaagaattgatttttgattcctagctaggaggaaagctacgagacacatgcaggcaaaacctaaaaacgcagatgccacgaggtgttagccgccctctagctagtatggttgtttcaatctgtttgctgtaactaagggcagggcccgtttagttcccaaaaattttttctaaaaacatcatgtcggtgacatggggccgggggtatcgtgactagaggcttggatagccgcggtcacccacgtggcctgaccccctcggggggggggggggggtcgggcccgagggtaacacggccacccctccctcggtctccccgaggggtcgggccgcccctgtttcggccccgagggctggggcgccccgaccccctgtggttttggcgccacttgtgtgggttaggtgagcacagcggggctcacctaaccgcatttatagcaggttggacgagcgcgccacgccgcatttaatgcggcgcagcgcacgcttatccggtccgtgaccagtcgcggtgtgtgaccgaccagtcagatcgcgggttaggtggcaacaggcggcctgtcacacgcctcgccccgtcccgtcggaatgatgagagcttcctggctctcgtccctagccggagccggcgtggtaactcctggagttggcatgtcagtcccggtcagatccattccaggcttcatcgcaaccatggcaaggaagtcattgtatgaagaagggcagacgtgtggcatgctaaactgacgcgtggtggacaagaatgaccggtttgtgactggtctaacaccggtcacgtcatcggcagacaaccgtgctcccacgttgcatctgcttccggcggagtggaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccacgggaactctgagagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttttcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctctccgagcgctagcggtgacgacggggagcaaaacccgcgccgtcgagctcgtactccaccgtccccctctcgccgaagtcttgggcgggaggaggcgctcgagagggtcgaaagatccgcgacttcgccgcctgcgggcgatggagaaggacggcgagacggggagcgtcgcctcctcgtctacggcgatggcagcacgccccagagcgcgctccaggctgcgggcgcactcctgcgtcacccgcccgtcgtccccgatccagagactccagcccgacgttggctggatgacatggccgacttggtcatgacggcgccgcagcgcctaggcgccggcgggcggtcctccgccaccaaggcctctggcgctgctaccgtcggctccgtgtcgtcgaggcggagggcgcggcgagcggcggccgttacccgccgttcgtccgccattccctcgtcaacgcctccgacccaagaagatgtgcgtggggggccagatgcccgcctcaatatcgagcgccggcgcaatggtcgtcatgctgcccacgcaacggagggcgcttcctcgtccggagcgccacttcggtccgggcacgggggccagccccccgtgtccccggttggtggtgccggctgtcgagcctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccctatggccctgaaaggtcaggcgcggggttggctaatgaacttgccacccgcgtcggttcactcttgggaggatttgtgccagcagttcaccatgaacttccagggcacatatccgcgcccaggtgaagaagcggacttgcatgcggtacagcgaagggacgatgagtctcttcgctcgtacattcagcggttttgtcaagtccgcaacaccataccatgcatccccgcacacgcggtgatctacgcattcagggggggcgtgcggcacaaccgcatgctcgagaagatcgcctccaaggagccccagaccaccgcggagcttttccagctcgcggactgtgtggctcgcaaggaggaggcctggacctggaactcctccggttccgatgtggcagctccggccgcccccgggtccgccgctcggtcagggcggcgggacaggaggaggaagaagaggtcggcccattccgacgacgagggtcacgtcctcgccgtcgagggcgcttcgcgggccacccgaaaggggaggcctgcgagcgacaaaaagaaggaggtcggcgctcccagcagtgagcgcccgaccggcaagtggtgttccgtgcacaacacctccctccacgacctcgcggactgccgcgcggtcaaaagtttggctgagcggacgaggaagtgggaggaggagaggaggcaggagcgctgtgagggcaaggccccggcggctcccacaggcaaccgtcgaggtgaggccaagcagaaggccaccgccgaggacgtcgacgatggcgacgatgacctggggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagtnnnnnnnnnnnnnnnnnnnnnnnnnnnnnnnnnnnnnnnnnnnnnnnnnnnnnnnnnnnnnnnnnnn

SEQ ID NO: 19050 - DNA, 901 bp, Oryza sativa
  unsure (1)..(901): unsure at all n locations
cttgcttgtatgaaacagcgcgcggaccacctcgccgcggcgtccaagcccgcgggtgccaacaagaggctcagcacctcggtcccagccgccccgaagcagcggatgatcacgtgcgacgaggtcccggtcaagaaggttgccttgggcgacggcccgtccaagaccacacgaatcggtggtcttctggacgacaaataggaagacgcgctcgtctccttcctgcgggcaaacgccgacgtcttcgactggagaccggcggacatgcccggggtcctcagggaggtgattgagcaccgtctccccgtgcggccgggcgcaaggccggtccggcagaaagtgcggcggcaggccccgaaacgtcaagccttcatctgcgaggaggtggcgcgacttctggaggccggattcattcgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcagggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccaaataggacgtaatgttgaggcctatgttgatgacttggttgtgaaaacgcgcaaccaagagaccttactctcgannnnnnnnnnnnnnnnnnnnnnnnnnnnnnnnnnnnnnnnnnnnnnnnnnnnnnnnnnnnnnnnnn

SEQ ID NO: 19051 - DNA, 734 bp, Oryza sativa
  unsure (1)..(734): unsure at all n locations
nnnnnnnnnnnnnnnnnnnnnnnnnnnnnnnnnnnnnnnnnnnnnnnnnnnnnnnaactctcgggagagggggactctcagacgactctgggaatacctgagctcgtagaggagagaaaggggaagaggggttctagagcctgaactctcttgctctccggctctctgtaactccttcacacacagatccaccagaacacaggagtagggtattacgcttctcagcggcccgaacctgtctacatcgcccgtgtcttgtgcatttgctctctcgcgaacattccacagatcgagggtgaagaacctcacttagcgcccccggccgaaccggcaaaggggggcctgcgcggtctcccggtgaggagccccacgctccgtcatctggcgcgccaggtagggggcgcgtgtgtctttctaagccctcgtcctctttcgtgtgcgccaagcttctcccgctcagcccaatggccgaacgggcagtggcgcacaacctctcttcgagcgctagcggtgacgacggggagcagaacccgcgccgtcgagctcgtactccaccgtccccctctcgccgaagtcttgggcgggaggaggcgctcgagagggtcgaaagatccgcgacttcccccgctgcgggcgatggagaaagacggcgagacggggagcgtcgccttctcgtctacggcgatggcagcacgccccagagcgcgcttcaagcttggggcgcactcctgcgt

SEQ ID NO: 19052 - DNA, 3485 bp, Oryza sativa
  unsure (1)..(3485): unsure at all n locations
attggcggtcgaaacttgatcgctaacgacagtcaacaccccccctccccccccccccccggcacgcgctctctccctgctctttgttgttttggtttttatttgacctccccgactgcagctccatcttgtctggtagcatcaaattcaaaagtatggggaaaacgcacgatgatcgcagcgaaggaaacatatgcgcccgtgagcactaatcctccatgattctctctcctcctttccgtcgttgggcggggcaactttatttctgcatcctctacttctcgatggtatcactacaagcagcttcagccatagctggatgactttctaggttttgtacccatgccttctgggcaggtaaaaagcaccagatagcttggagttccaacctaccatatcctttttgttaggagtttttaatctttcaatgagagggggataacttctatttggggaaggagtgacgttggcagtctgactacaactaccacatggggtgttgcaccttatcaaccaatacaccaactccagttttttgttgttcttgctgtgccaagaacaatattaaacctgcaattaatcgaagaacaagtaagaacaagttgataagaaaacagttcacatcccctgccaatgatgaaaccgatacacacaaagttggggttttgaatgaagtatctgggtgatctagccagcaaacacaattacagtgaagtagctgaagctaaatctgtatctagacaaaacgcaggttgcaaaaagaggctactaggggtttttataagaggaaaaacgacgaggcggggtggtgggagcaaaccctagcctttggggtggtgcgagcaaaccctatcctttgtggacccctgatgggctctactgaagacaaggcccaagcccaagtttctggtccaaacattgtttctattattctaggcagctccactcaaatttgatagtgaggctaggctcatttcaaagtagtcgacgatatctttacaatgagtactcatgaggtccaaacgaagctcgtatgtaaatttggtggccgttttaaaacacttaggacgatatatttttttcacacttaggagcacacaaaaaccaatcatagaaaaaataaactcaaatggacgaaatatgtgacatgtagaattttccaaagctctaccgagaagctttttgccttgaaaatacaatcttgcaagcagaatttagaggttctaatttcgctgaacccgacaaagcgggggagaattggatgtaactttttctgtagatgtccgtggatatattatttgcttgattccaagtttgtatgaaaaaattacgcctgttttaagaaatgacacccaaatgtaaaaaaaaagaacacaaaccctaacttttttttttggtttataggatgtaaaaggtataaaaaaaaggctaaagagtgttcgaaacctgatctcctttttttttttggaaggtgggggggggggaaaggggactatataagggctcacacatgctaacccccgctcgaacataaaccaatgtgggtggtagaagcgaaccgtggctagccttgctgcgtatgtgtcgaaacatgatttcggcaataataaaagggggtggcgctcgagacctaaaagtggatggatgcgaagacaaaggatttagacaggttcaggccctctcaatgagaggtaataccctactcctgtttggggatttgaatccgccgagtgtgtattgatctgacgatcaggttgtctcatatatatgccccctagagggcctcctgcccaccttatataggatggggggcaggattacaagatagaaaccttaaccaatacggtatcggtttcctaaatcaggactctaggccgttccgtaatatacaaggaaacgtaacacccaagtcatgatctgttacatattacatagatataagttatcccctataactagtcggataaccatgccgtgtgggtatggggtacccataatctccacagtatgcctactctttagtccatgggattttttgcctagcaagttagtgttggaaaaaaataagagtttacatatggaatttttatacacggcaattttatgtcatagaaatgaaactttcgatatataatctttgaacaaattaatttgtagcgaataaaaaaagaagaaaaaaaatctatagataagtttataaaaataaaacttgtatgtagaaacttttgatacatatgtaaaaatttgtactttgtgtaaaacttttggtatataaactctatgcaaaagcagattaaaaaaaacatttgtctacaaattttcacctaaaaatttgacagatgtaattatagtacaatcgtagtgtaattacactataacttgtatgtaaatacactgtaacatgtaactacagtgtaacttgtatgtaagtttcacgtaattttgaatcattagatctaatacaagatttgttctagtgaggaagaaaaaaatcacagcacacacatgtgtgaaaggatttgttcccacgacctccattttaccgaaatagcatgttatggagagatttttaaaagttatatacaagttactgtgtaagtataattgcatctgagaaaaaaaattatcgacaaatatatagcaaaattgaaaagagaaggagaaaagacaaacatgccaaatgtgtcatgaggcccgctacttatcggtccatcacttggtttcggcctttcatggcccactccaaaggaccaaaatcgaaaatatctcgaccatgcaaagagaagatggctgggcaacatgttcgtgcggctggcgctgggctcacgcacaaacgtttgcactcatgtgcaatcagctagtttgttgccataatttttgtgtatgtttgtttcgctatcaaaaccatgtcatgccacgtgtttttaagtacaactatatcatgtcacgtgtttttaagtcttaggatccagtgtcacaattttaaagctggccatgccacactttagataaggtaaaatctaattggagaaacctctccaattagtcttaaccagagacaccccacgtgctagtactttaagagttttggttgctattaatccattgagcaagtagggaaaatattcctatcatctatacttcaaataaaattttctcttaaattactcatccgatttacaatccgattacaccgttgtgttcgtaataattaaatctttacaacaagatctcacatgattatattttgatgaaaaatcacaaattacttttatgatatgtctaaattacttttaggtttcactaagttacttcttagacatataaaagtaaattcagtaaagcctaaaagtaatttacatatattatagaagtaacttataacaaaaaaaaaagtaactttaattaatgccttttttcattgaaaaaattannnnnnnnnnnnnnnnnnnnnnnnnnnnnnnnnnnnnnnnnnnnnnnnnnnn

SEQ ID NO: 19053 - DNA, 1628 bp, Oryza sativa
gtaaaaacattcttatatgattttgatcttaagaaacaattattgatgaatcaataaagtggcccttggtttgtactatgtatcatgcaaaacatgcgctgccatctgggtaactaagttactcatctcactagctgacatattgctctacagttttgttaaagcattgtgggggtacccacagaatcagattctagaattttatgctccaatgccctaagttaaagtagaaaacatatataaaagctgacctgtgcatcaattgtagtcccagagatatgaggggtcatggcatgattaggcatgtatcgccatgggtgatcctttggtgctggttgggggaaccagacatcaccaccatatcctgagaaggaagaatgaggttttcatgctaaaggaaatattgatcaagatagaaatattaatacggcatcattcttataatttttttttcaataggacaccaatattagttctctggaaggaaaggacatttagtagtttgtcacagattaaagaatcatggtaagagagctaatttacataggtgcagagaagttcttttatttttttaaaaaaagattcttcaataattgtgaacaacaagttatcatatttgacatacatactgctttactgggttagttgtcctggttttaagttttttcatatcacccctcttaaatgtgaagcatgataggctccaggaaaatgatatacttcatggatcaaaaagaaagatttagaccaaatctgatggcatgctagtatgcagtgtaggctataagaaatgaaaggatgatggtacctgcaacttgaccactagagcaagcgtctgcaaccgcctgggtatccatgattgctcctcgagcattattcacaatgattacacctttcttcatctttgcaattctttctttattaaacatacctctgaagaaagaatcatacaaagttcagataagtagatgtactatgtatatgattttgcaacaaacaagaatacgatcatcaggaaccttgttttctctgtaagaggtgtattgatcacaatgacatcacactttggaagcatagcatcgagatcctcttcatatttggccccaatttctttctcaagttctgggtcaattttaagtctgtcatggtacagcaggttgcagttaaagggcttaagacgctgaagtaagagcctgccaatacgaccagccccaacagtccccacagtttttccttcaagatcataagccctataggcaatgccagcaacattccattcaccatgaacaacctgctgatacccgggcaagaagttcctgagcaaaatcaaaatgcgcatgagctcatcttctgccaccgacacagtgttacttccggtaacctctgccacagttaaacctgctgcagcagctgctggcagatcaatatgatctgacccaatcccagctgtgagaagcagctcgaggttctttgccttcttgatcctttctgcgctaacataggctgggtggaaaggggtggtgatcaagacatgcatatcctcaatgtgcttctccagctctgacaacaagaaaagcatcagttatgtgcacaagaggagttaaaaggataggttcagagctatgttg

SEQ ID NO: 19054 - DNA, 1757 bp, Oryza sativa
  unsure (1)..(1757): unsure at all n locations
nnnnnnnnnnnnnnnnnnnnnnnnnnnnnnnnnnnnnnnnnnnnnnnnnnnnnnnnnnnnnnnnnnnnattttgcaacaaacaagaatacgatcatcaggaaccttgttttctctgtaagaggtgtattgatcacaatgacatcacactttggaagcatagcatcgagatcctcttcatatttggccccaatttctttctcaagttctgggtcaattttaagtctgtcatggtacagcaggttgcagttaaagggcttaagacgctgaagtaagagcctgccaatacgaccagccccaacagtccccacagtttttccttcaagatcataagccctataggcaatgccagcaacattccattcaccatgaacaacctgctgatacccgggcaagaagttcctgagcaaaatcaaaatgcgcatgagctcatcttctgccaccgacacagtgttacttccggtaacctctgccacagttaaacctgctgcagcagctgctggcagatcaatatgatctgacccaatcccagctgtgagaagcagctcgaggttctttgccttcttgatcctttctgcgctaacataggctgggtggaaaggggtggtgatcaagacatgcatatcctcaatgtgcttctccagctctgacaacaagaaaagcatcagttatgtgcacaagaggagttaaaaggataggttcagagctatgttgctatttaaatactgtagttgttatctgtcttagaactaaagcacaaaaatagttgctacatgtttttcaacaaatcgataagagatatgcaaaagaaaaaaaaagttcaaacttgaaacatgtatgcaacataggcacagacaagaatttgagttaacagaacagcatgccagcatgaatagagttaatttcagccgtgtgctagaggaaaccacttggctgccaaccactcaacacgtgaaagcatgactaccctaaccacatacatcaagaacctcctttccaccttccatcaaccagatgaatatcatccttaattctcctgatcaaaagataaaaataatcatcggcgaagttaagtaaacgctcatgtccacctatggcaactccatccacctctattcagcctgtacagggccaacactacaagctgggagatgctagctactcaattcatcatgtgtaagcggctccatgcaaatcatacaccatgcacaactaaaaaatgttggtagaaacttgagagaaagctctgaaaatctgaacatctctcgcggatactaccacttaccgctgtttagcccctccttgtcgtcggtgacaatgtagtgatgccccttggactcaagccattcgcggatgccgagagcgccctccacgcagccgacgaagttgggattcttgtcggcgtactcgccgcccttgtagaacacacccacgatcttcttgctgcctgctgatgtctgcgattcagagagggaaaaccaaaaggtataccattcttcagagttgcagcaactgagatttgttcagacaccgaaattcacatcacagaagagatcaggaaaaccgattgcaattgttcatcacccattcccgtacaaaaggggagaaacatctttttgggaggagaaaaaaaaagaaattccgggaggggacaaagcatactgggaatcacgaaattagggaggaatccatgcttttgaccaannnnnnnnnnnnnnnnnnnnnnnnnnnnnnnnnnnnnnnnnnnnnnnnnnnnnnn

SEQ ID NO: 19055 - DNA, 16191 bp, Oryza sativa
  unsure (1)..(16191): unsure at all n locations
agcgtctgcagttgctcacactattagaatatttattttcattttctggagtatatgtataagctacacatacgtggcccctggcggttgttagaataagacgaagccttgttggtgatcatccaaaacaatgtaagcacttattagcaaataatctggttttaatttgtgacagggactgaacaagtgaggacactagggaagcacgcacgcttcgtgcagctttgcgccatggagccgtggcagaaacagaaaggctgcgtgagtcacccatgcacgtaggccctgtttatttccaaagttttttttccaaacttccaactttccatcgcatcaaacatttcatacacacacaacttttctatcacatcgtaccaatttcaaccaatcttttaaacttcagtgtgaattaaacacagccgtagaacctccgaatgctcaaaatcgggcgcctgatgcggcgaaaaaaatggggcgcccatatgcgcgggccgcccccactatgtatgtccatcattcgcgccccattacaatcagtggcggatataaatttaaaatacagatggggcggcagagctagccctaattaggtaatggcacaatgcacacaaatcatagtcgccggctcacggcactggtacagcaacgcacggcatgaacattgagaaagttaacaacgaaaattggtagtcgaacaaacgtatattaattatatgtagagagaaaaaaaaaggagaaacgttgttagacaataataaggggaaccactttcaatacattggaggtataaaacgaaatgaaaaattatttagaggtttaagtgttttgctaaaatagttcaagtgagtaaaatagtttcttttaccaatttaactttattgtagaccgtattatgtgctaaagaaatagaaaaaaagtcaaattttacatatggccaaaatcagaaacggtcgaaatggtactactcatacagaaataatactcattcagtcaagaattttcataaatgttgtttatgccatggagcagtgtattgttgcaatggcatggagcccgggcagctgcccgtgctggccgggccctgcctccgccattgtgtttcactatgtatggatgagttgcagtggattttgatattgtttcgtaatttcatcttagtggacacgtggtttattgatgtacacggggtttaagtgttgcaatgattttaaatcgtttgttgcatatgttgaaccaaattatttcatcaagtgatcttactgtgtttcactttttttaacaattgaaacattctttcgctatttgctgaaacattgtttttatatagggtgaaacaacgctcgatttttttggaaaccgttgttttatatattgtagcaaaatatttcatgaggtgatttggttgtgtttcagctttttacaagattgaaatattttcgatctacttggtgaaacagcgcccgatttatacagaaaaaattgggcgcccggtttgtaggcgcctccacagaacctgcacaagcctcaccaactcttagtctaaagccatgagtctctctagccgcctctaattattgttccatatgcatctatagtgattgttccaatatggtcccttttgtttcatagccaaaacagttctccttcatctttttttttctattttttaagtagtattattgaaataaaaaaacaccattttgttgatcataaataggcgaattttgaggtccatttaacaaggtggcattctccctcttgtttcaaagtaaagaccactgctacaaaaccctaaatgaaactagcatctatggatttttttttccacctctacgtgatgaaaaaatatagtatcgacaaatttgaccattgtaggtatcggttctagaggaaaacccgacatcaatactatagataccggtttttttataaaaaaagaagggtacccataaaatagattgagccaagccgtccatatacaccacaccacttgcattttatcctcttcccacccggctgtctctttcgcacatcgttcgatccccatcccactcacacaaccccgccaccgctccagcctcacttgcgcttggcctcctcctcattgtctgtcgctcctcctcctctccgtctgccgcccatcctcctcctccttcctctccatccgccaaccctcctcctcctcctttcccttgcagcgcccctcaccacttcctcgccgccttcgagctatgtctccccaaccacgtcggatctggtcacctaaaggtctgaggccaccggatccggcctccttgaggtcagggctcaccggatccgtcctccttgaggtcagggctcaccggatccggcctccttgaggttggggctcactggatcactaacgtggatcaccttgcatgtgcttggggctggtgcggtctggctagaaggagataatggcgacggtggcggtcagtcgaaggagagtagcaagggaacgaaggcgacagatccaatgggacagtgagcctgatatgttgaacatgtaatggtcagccatggcgaaacatgtaactgtgaattgttttgatctaatctgtgattagcttgttcttgtccttttggtttgtgatgtgcttctttgttttttgatgtatgcatatgctcttgtgttcttgttgatttgcaatgtggatgggggggattgcagatggggctaggtgtcggttctgtctcgagaactggcagctataatctctataggtaccggttctggaactagcacctatacatataggtaaaggtgcctccaaattggtaacagttgggaaacccacacctataaggggttcccaaccagcacctatggggtgctctgtagtactggactcaaaatgcacatcattcgatagagtttcagaggaggttttcgatgctagcatattataaccctttagtgaaaaagatattttaacacatgagcttgcacttgacaaatacagatccaatagtagatacatgcacactaaataggatcaaaattgataaattattattagaaaaatggcatctataccttctatatagttggtatccactagcaattattacaagctaaagcttaacatgcaagtacgtcacattaccacccactagtgattattactattctaaagcatgttaactctcatgcaagcatgatacgtcatatagaatataatattgtagagctcaacatataaatatgtcaaatgatcttccttacacctttttcacaatatttaacatttagcatttctataatattttatattcatccatatattccagaacgaagcgcgggtatactagcaattgtaaagaagaaaaagtttgagtcaccacatggcacacactaagattatttaaaatatactgaatcattttgtgatacattgtagacattgatataaactgatagcatccaaaaaattaaaagccttgaaggtgaactcaaattgggctagtggtattttcttaataattttcccatgcaccaaatattttttaaaaaaatatttcaaattttaaagcgcaagaaattttattgctttagttaaaaccccatatttcaattttattaattggtctattcatggaacctttcttttagttcaaatattaaaagccttgaagatgaacatgtcgatgggctatacatcactaaatacgtacctatatatatgccatatctttaaggacgtaaggaacagctaatttgaggatataaatgaaactgagaaagagccaaggagacatggatttttatccaacccccaagatgggtaatagccctagtcatgtttactggaggtcagtgttgccatcatatatcaatctcttacaagtacaaactatcgggaggaaaacataatctaatataccaatctattggcgcagagctcgggaatggtggtcagcggctagctattgttaattttctcgggtattgactcaacgagattggaggtggctctagatctctcttggcttactagtttctaacacattctcttctctcctcctaggggacttacatttatacccttgggtgctcctttatcgaagtaaaactacaagacaagtatgcatataatcagaatagtcctgaccatgcctacaaaagactcaacatttctttccttatctgggactccttccctatctactttagactttatctatgtgtatgaaggtttgttttcgtataaaatcacttgatctatggtggtcccaccgagttaaatgtgtgtgtgtgtgtaggatatctcaaacctaggacactgatagaacaattaaaacctttatcaaagttttttttacaacagaataactaaaagaaactcccttatgatctcaagtgggctgaatacgacccacccctcctttctctctcctgcgcccatgatctgtctccacttgttgatccaccttcctcacctttcttctaatagaatttcagtatccaaacttatcgcattttggagtgccttttattttataacctaccaatgttgttactgtcaaaacctagacaagttttcatgctaccaaatttagtagagatcactattgggtataactcaaaaatcgatagtattagcaacaattggtaccaaaccattcatctagatagtactattcagttaccaaagggcaaaaaaagtggcataagttagaatttatttggctccatactttcgtttcgctacaacttgcaacaaaaataactgcctccgcagcccattagttgggaagaaacatagcatgcctgatagaggctagctcatctgtctatggtgaatgtgttgtatagttcctagtgtagttttagcaagtcaaggaaatattaaggaagaggttaaagaactactagaccattttgtcgacggtggatacccgtagactggatatagagggtattggggtacgctggtacgaggatctacgtgatacgacatcaagcaaatagaagacaaggattatactggttcaggccccttgataggtaatagctctaatccagttggtatgggattatatggtggaaaccacatattacaaagataatagcagaactcggtgatatcgacaataccgtagtcgagttggtccgactagatcacccggcaacttggctcctataggctccgacttcctaggttgtggtcgttgtgttggcggtgagattcgatgccttaggtcctcccgggggtcccttttataccgtgggtcagttgatctctaattagaactcggagatatcggaccccacacgatatagtaacgacccagttctgtccgagtaggactccttccatccgtggactccatttctgttacgtgacggatttccttaacgtgtacaggaaacatccatatacgcgcaggtataccgtatctagggatgacaatgggtcgggcacgggtagagcaaaaccatgcccgacccgatgcccgacattgcccacccaaaccctacccattagagttagcgggcaaaacttcgtgcccgtacccatgcccggcgggcgcgggtatgtccggcgggtacccaatggatctcacatgaataataacttaaaagatatgtaacttaacaaagagaaataaaatcaataatttaccaaattatcgtttatcaacaataatttgaattacatcacaacttagtatcagttagcatcacaaatgaactgagagaaatggtataagaattaagaaatgagtcaaaattagctaatacatatgtatcgggttgggcatgggttacccacgggtaaaaaatgaaacccacctattgcccataacgtcttcgggtctcgggcgggcgtgcccatgggtaaaaagtcacacccacgcccgtgcccatcgggtcgggtatccacggatacccggacccatgggtaaaattgccatccctaaccgtatcggtatacaacatacatccaagggtaaagggtataccttatccgtaaccctggcagtagcccccgacttctgcttaaatgaactcatgtgaccgatcgcgacttctgatgtcggaatcgttatcactctcaacaggtcgatctcggtatgagaaccgtagagacatagagttatcgataactttgcacgaagttcaacggtcatgagtgaatttaaattgaagtccgaaaactgctgcgcgtaacggatccagaaatttccagcggccttctctctcctttccttggaattcgcaccgtcggtagtgcatttatttaagggagttttggggatccattttgaagtccgtttgctgcaaaacttcccagcctccaagcgcccctcgtcttctccgctcccgcagaaaaaaaccctagctttctcatcttgtcttgttctccggcgatctccggcggtgatggatctcgacaagtccaccaccaccaatgcgtccctgaagaagctgtaggacgacggtttcctccttggtcgcgggaccatggagagagaaacaggaggtactgaacccgaacctgtcctgggccgcatggttgcggttgaggattacattctttgtggttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtctttgttgttcctgaggagcaaccagacaagattccggagtggaccgccaaacctgccctaactccctcccttcagtctttcatcgacattatcgatgacctccgagtacgcgggttgttggggtatgaagtcgctgccgacttcatcggtaggcggatccaaccgctccaggcccgagcccatatggcctttgattattcggggccaaaggacgcgacccgggtttctcctcggggtatttttcttgtatttcagatttcattctttatgtgcatgttcctcctgacttatcgagtgctggttctcgatcctacaggtttgaacagcgaaatcgtggagcgccgtgccagtcaagtgatgatcagcggtcctacaacggcgagcaacatccccgtccccatttgcaagaaggggaaggccaattgcatggctgcgatcaacgtgagtgtatttgacgactcctttacttctgctttcctgggatcgcattgtgacttcatgtatgcaggctctccctctgacggatgtcatcgggccgctcgcggaccaccaggcggcagcgtcgttaaagcagggcgttgccaaggaggcatccgacattgctgctgctgctgctactacgatgagtggcagcaacgttccaatattttgacctcatatcgtgccatcttgcttaggcctcggatgcgtctcccccgtcctagcgaaggcaaaggctggtgacgcttggcgagaagtaagtagatgttttggaagtcttgcttgcctgtcttcatgaaatcgcggaaatcctttacagggcggcgcgggcgaaggcgacgcaagacgggtccggcgcaacctccagcgcgtctcctgtggcgacctcgacggatgtcgtggtcacaactagggatcgggaggcgacaccgagtggaccagctggcggtcttgtgcccgctcggggcccgcctattgatgccctcacctggggggagctccaagctgagatggagcgcatcctccaggctggagctcgcggcgtgggccgcgagattgaggaagccagggtggcggcgtcatcggcaactcaacgggccgagtagctggcgtgctatctgttagagacctgcgaggacctcctcaagatgagggagttggtggctggcaatgaaaggcaacggcagggactcgggcagatgtcggagctcgagaacaacctgtcggagatccgcggctcgctgcgggtgtcttacaccggcctacaccaactcgccggggacttcggtgtgtcacgaccaccatcccggcaacccccgacgagttctcgctgacgtcctcgctcgcggagctggctgtggtgatggaggagatcccctccaaacatgcggccaggatcagcgaggagacgtcaaatgggatctacaccggggcgtgccacgtcctcgcgtgcgtgaagctggcgtaccctgacctcgaccaccagaggattctggatcagggggcccccaatgacacgcgcaagggcgtggtggaagaagtcggtgacttgggggagtctattctccccctttttgaagagtaggattttatttcccttgtactccttaatcaattatgcctgtaaaacttttgtaggttcaaactgcctttgtgtatgcagttatttccttcattttctttagcatggtgattccgagtactttgttgtcattgtagagatgttgatatcgaggatgtctagcagcgtgggcaacctgagtcgccggtagtcgttctggcacttgcgcttgagccgtatgtgccgcgggacgatgtcgatcaaagccttaggttggtacaacttccttaggttggtactttagtcttcatctcctttattcttttgttcgaatcgacttaatttgccgtgttctcgaaagaggagaacgacttgacttagtcatttccgtgttgagcagacctcgagagtgcgttggccgaccaagatcgtcgaatccaatattggaagacgaagttcgaggtaccgaactcgagaggacaatggtgaaagtgaagaaagaccaagccgtggaagcactccgaggtcgcgaggtgtggttcaactcgtacctcaggagctgttgtacagcgatggttggagtctgcagagagctccgagtaccccgttggaatcccgaggagtcggcggctgggtatatctcgtggttgaacggggcctgcgctcagcttgaaggcatcggcaagcgtatcgacgaggccctgaagcaggagtgtcgtcgatcgagccgatatgctggagggcacgtgctggcctgtatccgagatcactgcccgcagctgcacctcgagttcctccacgaagggttttcacgttctcggaggactcccgcagagatagataatctggcgaagtcgatggcaccgcttaaagagaaagtcttccagtccatggactggcgttggccttcctggtagtctttatatcctataaaaattatctcaaggagacgtgtaatatattttggagcaattatgaattgtaagaagtactcgtgaaatagaaaagggatctatctaactaagttttcttactctggatgtgctgtgtgagtgttttctcatttcgcgacttcgatcagtcacttgagtcatacactctcccaagcccccagccttgtcgtcggagaaacgttctcggagaataaggctcttggacccttgacctacctcagttgaaaaagcactgaccctagcccccagccgtgaagttggaaaacttagtttctgattggttaatacgcacggcgagaactcttacatgaccagatcttacatggtcgtttgtctctacatgatccgacaaggccttatccgctctgggcgtccccagccgaagttcccttaggttcctcagaggccttgtcaagacggcgtaaagggacatgaggataggtttcaacgctaggtgtcgtcgtggtaagggatcgtcgggaaagaacactttgatcgtagtctgtacctgaaatcaactttattgaagtcgtaagatgtcttacaagtatggatactattgatttatacataaaatttacgtaattgatcaatgttccaggaatttgctaactcgcgaccatcgtcgtctgcaatcttgaatgcaactggccgcaagacttgcgtgatcgtgtatggtccttcccacttgggtgagagcttgttacgccctgcttggctttgaacccatcggaggacgtaatcgccgatcgaaagcgtgcgtgctctgatgcgcttctcgtggtatcggcgaagggcctgttggtagctggctgctctgacggtaactctttctcgatgctcctcgagtagattcacatcgtcgctttgctgctcctcttgatcctcgtcagagtacttctgtactcgtgtgctctgatgtcgtagctcagtggggagcatggcttctgagctatacatgaggaagaagggtgtgtccttgttggacgttgtcggtgtggtacgcacaacccatagtacagaggggagttcttcaacccacttcttgtcatgtgacatcaatctgtcgtagacatgggtcttgattccttggagtactatgccgtttgccctctcgacctatccattgctctgagcgtgaggaaccgaggcaaagcagatcttgactcccaatctgatgcagtaatcctggaagtcagcaatgatgaactgggagccgttgtctgttatgatgcggtggggcaatctatatctgcagaatatccctttaataaacttaatggcgttgtcggccttgatttccccagtgggcgtcgcttcaatccacttggtgaaccgccacgaatagaaacatgtaggcgccctgtcctcgtgggaatggtccgagtatgtcgagcccccagcacgagaacgaccaagtaagggggatagtctggagcgcttgcgcttgtagccttgtgtgtttgctgtggaattgacaggcttcacaccggttaaccatgtcgcaaacgtctttgagcgcagttggccagaaaacctttgtcaaaaagcttttctgaccaaagtgcgaccggcggcgagtgacccacagatcccttcgtgtatgtcgaggagtagatgtttgccgtcatcgagcgagatgcatttgagaagtaccccgtttggtgccttcttgtatagatcgttgccgatcatacagtaaatcttggcttgtcgggttattttctcggcttttgcatcatcttcgggcaactcgtcactactcaggaaattgatgagtggggtctgccagtcatatgtggtctcgatgtcggcaacggcgcgttctgcctctgtagcccccgagccgatgtcggggacgactgtgctatcttcgccgtttgtggttttgtcaggatgtccaggaaggtgccaggttcgagtggctctcgtctggatgcacgccgtgctaggtcgtctggttcgatgttgtccttgcgatatacgtgtcggacttcgatcccgtcaaaccttttctcctgcttcctgacttctgtgaggtacttggatagctcggggctagagcacttgtagtctttgtgcacctggtttgcgactagttcggaatctcctttcacgattagtcacttgactcctagtgcggctgctgctcttatctccgcgagtagaccttcgtactcgactgtgttgttggttgccctgaagttgaggtgaattgcatgcttgaactggtctcccgaaggtgatgtcaagatgaaccttgcccctgctccttggctgttgagtgcgccgtcgaacgccattgtccatgtttcgctgtcggtttgactgtccggcctgttttcaggcataatccaatcagctatgaaatcggcgaggacctgggacttgatggctgttcgtggcacaaagtggacatcaaactggcttagctcgattacccatttcgcgatgcggccgacaacgtctttgtttctcacgacttcaccaagagggaaggaggaaacaactgtgaccctgtgggcttggaagtagtggcgtagctttcttgatttcatgattactgtgtaaagcagcttttggatctgtgggtatcttgtctttgcgtcatggagagcttcgctgacgtaataaactggtctttgcaccttctctctcgacaacaatgacggtactcacagaatatggtgtggcggcaatatagaggaataattcttcattaggttggggagcaacaagtacaggaggatttgacaggtagcgtttgagtgcgatgaacgcatcttcgacttcctgtgtccatacaaatttgtcttgtttcttcaacagagtgaagaagggttgtccttgttctcccatcctagcaatgaatctgctcagtgccgccatgcatccagttagcttctggatttccttgagtcttgtgggcgacttcatgttctcgattgccttgatcttctcgggatttgcctagatccctcttccagaaacgaggaacccgagcaacttgcccgatggtactccgaacgtgcacttctctggattgagcatgaggcgatatcatcagaggttgtcgaacgtttctcggaaatcgtcaatcaatgagtcgcttgtcttggtcttgacaacaatgtcgtcgacataggcctcgacattgttcccaagttgatcgttaagtgccccttggaccgtgcgttggaaagtatttcctgcggttatgagtccaaatggcatcttgacatagcagaatacaccgaatggcatgatgaatgttgtcttctcctcgtcctctttcgccatgctaatttggtggtagctagagtaggcgtcaagaaagcttaacaactcacaaccagctgttgagtctaccaattggtctattcgaggaagagggaagtgatccttgggacacgccttgttgaggtcggtgaagtcgacacacatcctccacttcccgttggccttgcgcaccatgactggattggctagccactctggatggagaacctctctgatgaagccagctttgagaagcttgtcgagctcttctcgtatggcttgtttccgatctggtgcaaatctccgcagtttttgttttactggcttggcatcgggtcgcaccatgagtttgtgctcaatcacctccctgggtaccccgggcatgtcgcatggctgccaagcgaacacgtctgcattgtcgcagaggaaggtgatgagcgcgagttcctatttctcgttcggtgatgccctgatcttgacggtcttgtcggggttggcgctgaagagtggaacgatcttgattgcgtcgtttggcttcggcgtcttgtttgttttgctcactttcttgggtggctcagctgtggcgggtgggttggacgtgtgctcaaccatgtcgaggctccgcttgtcgcactgcactgccagctttgcgttcccctgaatagtgattgttcccttcggcccaagcatcttgagcacttggtatgcgtggtgagatgcggccatgaacttcgcgagtgcagttctcccgatgatggcattgtatgttgtatcaaattcagcgacatcaaaggtgatctgctctgttcggaagttgtttgcttggccgaaagtcacaggcaacgtaatcttgcccaatggcttggacgatgactgaggagtgattccgtggaaaggttgatcagtaggtgtcaactcgcttcgtgggattcccaccgcgtccaaggtgctggcgaaaagaaggttgatggagctgccgccattgatgagaacccgtgcgaccttgatattttgaatagtgggctcgatcacgattggatatcgtcctggaatgaccccagtcttggggtagtcttcctctgagaattcgatcttctgttcggaccacttcatcttgggcgcagccccctgccatgtcgaacaaacttcgcgctccactttcttgtactctcgcttcgaagagtacgccatagaacctccgaagatgtgcgagacatggagatcggaatctgggtatgctgagtccgagtcctgagtggctgcttccgtggccttctcgactacacgtacttgcttgcccttccccaatgcgagttgctttgtgagtgattttttgaaaacgaaacaagcttctaaggagtgcttgtccgatttgtgtatagggcatcatattttcttcatgtcgtcgccttatgggtctgggtgtttgggcaggtccacgtattctgctgcgaggacttccgtttgagctttctttttcccactcttgcgactcttcttcttgcttgattccgatgcgtctttggctggtttcttctcttcggcttgtcgttcttgcgtctcagtgtgtcgtccatgtgagcgcatcgatcgacaatctcgaatagttttcgagcagttgttatccgtcttgtcgccaactcctgggtggtgtagtgatctctgacaccagtcttgaaagcgcggatcacggaggcatcggtgatctcggggatcgtatttctgcactcattaaagcgccaaacgtagtccctcaatgattcgcccggattctgtgtcaacgcgtgtaggtcgtcttcgatcgcgtggcgtttgtatgttccttggaagttagcgacgaactgctgccacagatctgcccatgaagaaatccagtatggtgggaggtggactagccatgaatgtgcagatcctttcaacgtcgccggcaaataatttgccaatgcgttgtcgtctgctccggcagcgtagaatactgcggaatagacctgaaggaactccttagggtcggtgctcccatcgtacttctctattgctcccggtcgaaatctctcaggccatcggacatctcgtagagcacgactgaaagctctacacccgccaccgggggcggcaggttgtcggcgatcgtatgtcctccgtggatgcatgtctaatgacgaggatgatgacgatgatgatgagtcacttggttccggggtacgattacgaggatgacttccgggttctcgagaatcttgtcgtcgcccaccgttgttgtcccggcgccgatctttgtcgtcgtcatcgttatggcgacgtcctcgaccagtatcgcccggcatccgctgttcgcgatcatggcggttatggcggttatcatggtcttggttctcgctcgggtgtcctcctcactcttcgttctctcgacgtcgcgaagagacgcgatgccgggaacggtttttgttctcacgcgcgtcatgcttctcggcggacattcaaatggtcatggagatcactggtgccgcgaggtggaggagtggcttgacgaggtgatgcccgttgcccgggtagttttccattggcaccgccagttggcggttgctctggcagtactccggtggcggcctcttcgaacgcgttactgaggttagccactaattcccgtagtcgttctgtccactctgcgagatcatcgttcagaacgggatcataaggggtttccctcagtattgcgttgatagccctgatgtgttgggctggtgtaaccacttgatcctctgcttctgcgttagcgcgcgcagacgtgctggtcccatcgatagcgaacacatcacgtggtgtactcgttgatgatgaggcctggtcttcgagcaagtgtagtactgacggctcgtggggatcgatgtcgattaccccgatgaatcgatctgagataactgtcgctcctcgttccttgtccgcatctctaagagagatctgtgattgctggaccttaggaggtgacgtcctcatggcgctgagaagaaccttgcagcttgagaggtcgtgattctttgtcttgtgaataggacaatagacatcacgggttagagaagtacgttgaattccacgctctttgcaggcgtcgagaaatacccagcaagcttgtaaggtgtgtttcctggttttgtggatatgacaccaggactttgtcgcctcggaagttgtccttgtcggctcgtgattctcgtcggaaggacaagatttggccgcattaggatccttctcaggctcggatgtcgtcgatgttccgttctccacttctgcgggaggatccttcgacatggagccgtccagggttgtaaccacggcgttctcgcttctggtcattgatggaccagttgagatcggcaccatggtgtaaaccaggaagacgatttcgccgacttgagtccacaccagcattgttgaagtagaaactccttggttgatgccggggttgacgctgnnnnnnnnnnnnnnnnnnnnnnnnnnnnnnnnnnnnnnnnnnnnnnnnnnnnnnn

SEQ ID NO: 19056 - DNA, 1159 bp, Oryza sativa
caagtgtagtactgacggctcgtggggatcgatgtcgatttaccccgatgaatcgatctgagataactgtcgctcctcgttccttgtccgcatctctaagagagatctgtgattgctggaccttaggaggtgacgtcctcatggcgctgagaaagaaccttgcagcttgagaggtcgtgattctttgtcttgtgaataggacaatagacatcacgggttagagaagtacgttgaattccacgctctttgcaggcgtcgagaaatacccagcaagcttgtaaggtgtgtttcctggttttgtggatatgacaccaggactttgtcgcctcggaagttgtccttgtcggctcgtgattctcgtcggaaggacaagatttggccgcattcccgatccttctcaggctcggatgtcgtcgatgttccgttctccacttctgcgggaggatccttcgacatggagccgtccagggttgtaaccacggcgttctcgcttctggtcattgatggaccagttgagatcggcaccatggtgtaaaccaggaagacgatttcgccgacttgagtccacaccagcattgttgaagtagaaactccttggttgatgccggggttgacgctgttgtcgacgaagcttgatgacatagtagtagaaccttgagcaccaagttcccctacctggcacgcccctgtcgacggtggatacccgtagaccggatatagagggtattggggtacgctggtacgaggatctatgtaatacgacatcaagcaaatagaagacaaggattatactggttcaggccccttgataggtaatagctctaatccagttggtatgggattatatgatggaaaccacatattacaaagggaatagcagaactcgatgatatcgacaataccatagtcgagttggtccgactagatcacccggaacttggctcctgtaggctccgacttcgtaggctgtgatcgttgtgttggcggtgagattcgatgccttaggtcctcccggggggtctgtcggtgacatgggaccgggagtatcatgactagaggcttgaggcagacacaatcgcccacgtggcctggcaccctcgggggacgtcgggcccgagggtgatgtgtggcccaactcttggtctccccgagggggggg

SEQ ID NO: 19057 - DNA, 7439 bp, Oryza sativa
  unsure (1)..(7439): unsure at all n locations
nnnnnnnnnnnnnnnnnnnnnnnnnnnnnnnnnnnnnnnnnnnnnnnnnnnnnnnnnnnnncgacaataccatagtcgagttggtccgactagatcacccggaacttggctcctgtaggctccgacttcgtaggctgtgatcgttgtgttggcggtgagattcgatgccttaggtcctcccggggggtctgtcggtgacatgggaccgggagtatcatgactagaggcttgaggcagacacaatcgcccacgtggcctggcaccctcgggggacgtcgggcccgagggtgatgtgtggcccacctcttggtctccccgagggggggggtcggaccactcctgcctcgcccccgagggccgaggcgccccgacccctcgcgtttctactccacgtgtatgagttaggtgagcacagcggggctcacctaaccgcatttattgcgcctcggctaagcgtgtcacgccacacgaagtgcagtgcagtgcactcgattatccggtctgtgaccagtcacagaccggtcaaatcgcgggttaggtggcgacaggcggtctgacgcacacttcgctccatcccgtcaagacgagagcttctaggcactcgtccccggctggagctagcgtgttacatcccagagatgacacgttaaccccgatcgatatatgccaggcttcatcccaaccattacaagcaagatgttatttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcagaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctggcaatctttccacatacagagagagcttgggatcatcaccctgagcccccggccgaaccggcaaaggggggcccgtgcggtctcccggtgaggagccccgcgctccgtcatctggcgcgccaggtagggggctcagcgtgtgttttctgagctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggttgccactcttcgtcgacttcttcgacccgggaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttctccaggtctacacgaccgggattgaggccgccgggggtgacgacagggtcatggcgaatttctttcccatggccctgaaggggcaagcgcggggttggctaatgaacctgccccccgcgtcggtccactcctgggaggatttgtgccaacagttcaccatgaacttccagggcacatatccgcgcaccggtgaggaagcggacttgcacgctgtacagcgaagggacgacgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcagagctttttcagctcgcggaccgagtggctcgcaaggaggaggcctggacttggaacccctccggttccggtgtggcagcttcggccgcccccggatccgccgctcaggcagggcggcgtgacaggaggaggaagaagaggtcagtccgttccgacgacgagggtcatgtcctcgccgtcgagggcgcttcgcgggccacccgaaaggggaggcctgcgagcgacaaaaagaaggaggccagcgttcccagcagggagcgccctaccggcaagtggtgcgccgtccacaacacctccctccatgaccttgcggactgtcgcgcagtcaaaagcttggcagagcggacaaggaagtgggaggaggagaggaggcaggagcgccgggaaggcaagtccccggcggttccttccggccgtcggcgaagtgaggccaagcagaaggcccccgccgaggacatcgatgatggtgatgatgacttaggtttccaagagcctggggccaccattgccactgtcgatggaggagcgtgtgctcacgtttctcgccggagcctcaaggctatgaagcgagagcttctggccgcggcccctactcatgaggcgacgcgccgggcgcggtggtcggaagttgccctcacttttgaccagaccgaccacccgccgtgcgttgcccggggagggcagattgcgatggtggtttctcccaccgtttgcaacgtgaagttggggcgtgtcctcattgatggaggagcagccctcaacgtcctttcccccgcagcctttgatgccatcaaggccccggggatgatgctccggccgtcccagccaatcatcggcgtgacgccggggcacacttagccgctaggtcatatcgacctcccggtcaccttcggtggacccgccaatttccgcacggagcgggtgaacttcgatgtggcggacctcagtctgccctacaacgcggtcctggggaggcccgtgttggtgaagttcatggcggcggtccactacgcctacctccagatgaagatgccgggccccgacggtcccatctctgtccatggcgacctcagagtcgcgctcgcttgtatggagcagcgtgcggaccgcctcgccgtcgtgtccaagcccgagggtggcgacgagaggctgggcacatccgcccccgccgccccgaggcagcggatagccacgtccgatgaggtcccggtcaaggaggttgcactgggcgacggcctgtccaagaccacacggatcggtggtcttttggacggcaaataggaagacgcgctcgtctccttcctgcgggcaaacgctgacgtcttcgcatggagaccggcggatatgcccggggtccccagggaggtgattgagcaccgtctcgccgtacggccgagcgcaaggccggtccggcagaaagtgcggcgccaggccccggaacgtcaagccttcatccgcgaggaggtggcgagacttctggaggccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccaccgcggggtgcgaccttttgtgttttctagatgcatactctggttaccatcagattcgcatggctagggaggatgaggaaaaaactgcgttcattacccctgtaggaacctattgttatacttcaatgccttttgggttaaagaatgcaggtcctacttttcaacgcgctactcgaatttctttgggtagccaattaggacgtaatgttgaggcttatgtcgatgacttggttgtaaaaacgcgcaatcaagagactttactctcagatctagcggaaacttttgagaatctccgctccgcccgcataaaactgaaccccgataagtgtgtgtttggtgtacctgtgggcaagcttctcgggttcttgatctctgcccgaggtatcgaggccaaccccgagaagatacgagctataaagcggatgcgccccccagtaaacttagggatgtgcaatgtgtcaccggttgcatggccgccctaagtcggttcatatcgaggctgggagagaaggcgctacccttatttaagctcctcaagcgctctgggccgtttacctggacggaggaagctgaacgtgccctcactcagctgaaggcatacctcagttctcctccggttttagtcgccccggagccaaatgagcccctgctgctctacttagcggcgaccccccaagtagttagtgcagcgttggttgtggagcgcgatgaggacgatcctcattccgcgcaccctcaccctgtgctgacttggcccgggagcgagcagggaggagaggcccccgagccgaacggtggcctaaggcccctgacgaccggagtcagccctctccccgctcgtcagatggtgctgggcgcccccgaccctcaggaaggccccgaggccactgcgggaaggctgcacctatcgccctctgaccccgaggctaactctgtaccgattcgacctgggagcgagcagggagaagaggcccccgagccggacggtggcctaaggcccctgacgaccagagttggccctttgcccgcttgtccgacgacgccaggagcccccgacccccaggacggccccgaggccactgtgggaaggccgcccctgtcatcctccgaccccgaggtcatcggcacagaagacgagtgcgccccgaggggccacttggacgaggagcgccccggggatatggcccttagcgaaggggatcggccccaccgaagggtgcagcggcctgtttactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgggtggtaaaatgggcaatcgagctttctgagttcgatttgcgctttgaaccacgccacgctatcaagagccaggccctcgccgatttcgtggcagagtggaccccagctccagagaccgtttcagtctctgaagccagctcggaccccttgcagctgcctcacgccgtccactgggtgatgcagttcgacggctccctgtctcttcagggcgccggcgcgggggtcacgttgacctctccgaatggtgacgtcctcaaatacttggtccgcctcgactttcgagcgaccaataatatggcagagtacgagggactccttgccggactcagagtggcagctggactggggatccaccgtctcttggtgttaggcgactcccagctagtcgttaaccaagtctgtaaggagtaccggtgctctgacccgcagatggacgcttacgtacgccaagtgcggcgtatggaacgccattttgacgggatagagcttcggcatgtgcccagacgggataacatgattgccgacgaactctcacggctcgcgtcttcgcgagcccagaccccaccgggcgcctttgaagaaaggcttacccagccgtcggcgcgacctgaccccttaggggagacgggtgtgcctgaccggcccccgaggcccgtcggagtccaggcctcgggacccgaagggagcgctccaagctcccttagattgattgcttgcatctccgagatccaagcatacctcacagataagactctacctgaggaccgcgaagggagtgaacgcgtccaacgcatttccaaacgctacgtgctggtagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcttttcgtcaaggattctattggccgacagctctcaatgacgcggtcgacctggtccggcgatgcagagcgtgtcagttccacgccaagcaaatccatcagccggcccaggccctgcagatcataccactttcatggccatttgctgtctgggggctcgatatcctgggaccgtttaggcgggccccgggcgggtttgagtacctgtatgtcgcgatcgacaagttcactaagtggcccgaggcttatccggtcatcaagatcgataagcactccgcacttaaattcattaagggcatcacagcccggtttggagtgcctaaccgtatcattacggataacggcacacaattcactagtgaactcttcggcgactactgcgaagacatgggcatcaagctctgcttcgcctcacctgcccaccccagaagcaatggtcaagtggagcgcgccaatgcagaaatcctcaaaggcctcaaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttgcaagaacgaatacggcgtgcggccctccgagccgcacgctaccagcagagcctgcggcgctaccatcagcgccacgtccgggcccaatcactctgcgtcgacgacctcgtcttacgccgcgttcaaacgcgtgctggattgagcaagctctcannnnnnnnnnnnnnnnnnnnnnnnnnnnnnnnnnnnnnnnnnnnnnnnnnnnnnnnn

SEQ ID NO: 19058 - DNA, 912 bp, Oryza sativa
caaaaccaagaccttcaatattctcaagaagcacggcgattcatggatcgaggagttgccagcggtgctctgggcgaaccgaaccacaccaagccgagcaactggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcagcgccacgtccgggcccaatcactctgcgtcgacgacctcgtcttacgccgcgttcaaacgcgtgctggattgagcaagctctcaccaatgtgggagggtccgtatcgagtgatcggcgtcccccggccgggctccatacggctggccacgggcgacggcacagagttgcctaacccatggaacatcgagcaccttcgtcgcttctacccctgagggggggtcgggtgtcaggtttcgggctcgggccaaccccgcacccccccctcgggtgtgcagggttggccgggggctgccacacatgcacattctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctcccc

SEQ ID NO: 19059 - DNA, 3149 bp, Oryza sativa
  unsure (1)..(3149): unsure at all n locations
nnnnnnnnnnnnnnnnnnnnnnnnnnnnnnnnnnnnnnnnnnnnnnnnnnnnnnnnnnaaaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaagccgaggggccgagccctcgaagctgtggacgatgtggtcggcggcatcccggacttgtgcgcgcgcgctgtcttcagtcccaggtgggaactcgtccagcgccatccacagagagaagttggggtccctggcctgatagctcgccaggacgagctccaccgctccttgggcgaggtccctcgaggatgacttgatggtcttctcgagttcctcggggagctgctggagagccccggccatcttcgagaggcgctgggcaaggcctcccaggttggcggcaggctttattgtctgccctttccagaggcccgcctgccgaccggcgcgatcaagacgggagactgcatcccagagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcgcgccctcgcgtccagctccttttcccgcgcctcgaggtcggcggcccgctggtccagcgcggccctctcggtgcggacggattccaaattgcggcgcgcctgctccgtcagtgccgcctcacggagggacaggctgtccgccaaccgttgcgcctcggcctcggcctcttcgagagcccgctcccgctcggaaagagcgtcctcgcggaggcggagtgcggactcctcttcggcgcaggcagactcgtgcgccgccagcgttgtctcccgggaggcgacggcggcctcgtggtctgccaggtccttcttcgcgacgcaggcgcgctcttccagcgccatggcgcgcgcctcgagggcctcctcacgccgccggagcgccgcttcggcctccgttgctcgctgctctcgggcggcggcggcatcaaggaccccctgggcggcgtcgagctttttctttagctccgcctcccagttcccgtgttgaaggcggagggtgtcctgcgcctcgttcatcaccgtggtggcgatgagggcagccccccgctcctcctccacctctcgagcgatctccgccagcgccgtcttacgggcctcaagatcagagacgtgccggcggtgtgccttgcggcccgcttccaccatggcctccaccgagtgccgcccttcctcgacacgcgcccatgcggcgtcgagctccgcacgctccgcctgcagggcctccacctgggcatttaacccatccaacaccgcggtgtttgcggcggctaaggcctgcagaaggggctctgcgctcagcggggcgacggaaggcgtggggaagagctgccttgaagaagacgccgcgcggctcggcccgccaatggacgcgccggcctcatcgcgggccacccccggacctgtttggtcctgggcatcgcccgaaggagtgggcccaagcgacgcgcccgcggcatcgtcgcgagccacccccggacctgtttcgtcctgggcatcgcccgaaggggtgggcccaagcgaggcgcccgcggcctcgtcgcgaactgcctcggaagtcgccgtcgcctcagcctggcgaacccaggcggcctcctcccgagcggcttcttcggcttggcgagctcgggcggcctcctcccgagcggtatcctcggcttggcgagcccgggcggcctcctcccgagcggtatcctcagcctggcgagcccgagcggcctcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatctctgaagcagaaggaaaaaccagaagacaaacaagatgggtaagagaaaacttgcttttgggatagaagaaaagcggttgtaatgagcgtgggacgaacctgcgagggggtcggttaaatgaccactttggaggggaaatcaggtttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagcttcctcttcccccgggcgtcggtagggcggttgctccccgagcccccgacgcggggcccagaagcacgaccccctccgggggtagattgatcccccttgcggctcccgcctgcgccgtcgtggcccttaggagcctgctcctctgaggccccgaccgccgccataatggtcaagatggaggcgcggtctggatcgctgcagagggggaggattccgtgggggatgagggacgcctccacggagttgagattcagcacccgttggaccaatatcttgaagtcctcaggagcccaatcccatctgactccctggtgggtccgaatgtagtcttcggacccggtgtacttccaaggcgccccgagcgcgc

SEQ ID NO: 19060 - DNA, 1967 bp, Oryza sativa
ggttaaatgaccactttggaggggaaatcaggtttccccgggatggttctgtctcccccatcttgcgcagccgcttcttcttgcgctccccctcgggctgcgatgttggcgcggcccctccgggcgcctgctgctggcacgcaccgccccgccccctcggggaggagatgggggaggtgttcctcccagcttgctcttcccccgggcgtcggtagggcggttgctccccgagcccccgacgcggggcccagaagcacgaccccctccgggggtagattgatcccccttgcggctcccgcctgcgccgtcgtggcccttaggagcctgctcctctgaggccccgaccgccgccataatggtcaagatggaggcgcggtctggatcgctgcagagggggaggattccgtgggggatgagggacgcctccacggagttgagattcagcacccgttggaccaatatcttgaagtcctcaggagcccaatcccatctgactccctggtgggtccgaatgtagtcttcggacccggtgtactcccaggcgccccgagcgcgccgctggagcggcgcaatccgacgacggaggtagtcgccgtacaccatggcccctgtgagcccctgggatcgcaggcccgcgaggcggtcgaggacggcgtcatagccatcccccaaatctaccggcgcccgccagctggaggcttgcgccgggggctgactcggaagtcggaggcgcgcttcgtcggcgaggggggtgtagaaccagtcgctcttccagtcatcccacttcttgcggaggacgcagggaatgtagcggttcaacaccggcccccgcggcaggaagtagcagccgccaaccaccgacggcggcgacaccgactgcacggtgaagaaccaccggaacagccgaagagatgggcgcaccccaatgaacatctcgcacagatgtgcgaagatggccaatgtcatcactgcgttgggggtaaggtgcgccatctggagatcgtagaactccaggacatccatgaagaaagaagaaaatggcggaaccagcccagccattgcaaaggggagaaagaagacggaccgccccgggtagtctggcgccgggcgtccctcgcccagcatgactatctcacggccggtggcagactccggcatgaagcggcgcggcaacccagcctgcttctcgctcgtgatgcgggaaggcggcagcacgctaccatcaagcagtgcggagccccgtgccatggcgccggacgaagaggagatggagagcgagcgcgtgtggcgaaagaagggtgcagggaagaaggagttagggcgcaagcggcgaaggcaagggaaatgatggcgaaaggaaggaagcaaatcccatcctcagtgcctttatacccttgccaacgctgtgcccggctcctcgtttctcgcgcccattatttcgccccctcgcttctcgcacccacgcttccactaaccccattcgcccgcttgcggcgcgtgaagtggatatgcggttgcggcagtcgagatagatcgtatcgtgcgtgcgttaaatacgctcgccgaccgaagcgacgttaccatatctccaggcgaagcaaatcggctcgcccagatttgtgcgctgctcaggtgatgtggcagtcttaaagagaccgcccattattgacagccaagttaccattaccgatgcgcatggtttgagaccgttgggtttctgcccaaccatggagaccggtcccacctgtcaccaggctttaggagtggcgtcacgcccggccacttcccatgagaagggcgatcgccctggcataacgccgggggctactgtcggtgacatgggaccgggagtatcatgactagaggcttgaggcagacacaatcgcccacgtggcctggcaccctcgggggacgtcgggcccgagggtgatgtgtgcgcccacctcttggtctccccgagggggggg

SEQ ID NO: 19061 - DNA, 16602 bp, Oryza sativa
  unsure (1)..(16602): unsure at all n locations
cacgaagtgcagtgcagtgcactcgataatcgggtctgtgaccagtcacagaccggtcaaatcgcggggttaggtgccgacagcgggtttaacgcacacttcgttccatccggtcaagacgagagcttctaggcactcgtcccgggctggagctagcgtgttacatcccagagatgacacgttaacctcgatcgatatatgccaggcttcatcccaaccattacaagcaagatgttgtttgaagaagggcaaacatgcacgttgctaaaccgacgcgtggtggacaagaatgaccgatttgtgaccggtctgtcactgctcatgtcgtcagcacacagccaccttcccacgacgtgctcgcctcaggcaaaagtggaggtaggtgtgtgctgtcccgtcaggaggatgttcggaggacgaccgtgcaaatctccgtccatttatggagagaagaaaagtccagtttggaaagggaggggtgcatgtggtatccccttaaaatataaaaggaggaccttgcccagaaaaaagggggggatggctgccagattcagaacctagaacaagggagaggttggctcacactttgtagctccttgatacatagatccaccaaaacacaggagtagggtgttacgcttctcagcggcccgaacctgtatacatcgttcgtgtttcgtgctctttcgatagctagcaatctttccacatacagagagagcttgggatcatcaccctgagcccccggccgaaccggcaaaggggggcccgtgcggtctcccggtgaggagccccgcgctccgtcagggtcccttttataccgcgggtcagttgatctccaagtagaactcggagatatcggaccccacacgatatagtaacgacccagttctgtccgagtaggactccttccatccgtggactccgtttctgttacgtgacggattacaggaaacatctgtatacgcgcaggtataccgtatcggtatacaacatacatccaagggtaaagggtatatcttatccgtaactctgacacatttattactaatatgaagagaaaatgaggaggggaagaaaacaaggaggatgaaggaacactattggtttagttaatgactacaaataaaaagaaaatgatgtaaagtggtctactacaccactctaaagctaaattcttttagggataaatttttgactaaattaacacttatttagggacaaagtgagtactcgataattccttaattatatgccacttgttacctcacttgacttatacatacggatctatgagagggatacaactaaattttttacattttaaatttatccgaatgtaaaacttcaatgaagaaggaaagatcagtaatttaaaaatgcataaaacattgaaaatacataaatacagtaactttaagcctatttctattagaaaatatgttttctctatcattggggaaatagtaaaaacattatatcgattctgttcatccctggaacatggcatataatatctcattatttttagaattattttgaatatttctacaattaatactccctccgtccctaaatatttgatgcctataacttttttaaaaatgtttgaccgttcatcttattaaaaaaatttaagtaattattaatttttttcctatcatttgattcattgttaaatatactactactactcaagtttttttaataatattcacaaaagtttttaaataagacgaacggtcaaacatgtttaaaaaagtcaacggcgtcaaatatttagggacagagggagtattactcaagcataacattacttgaaatgggaaatctatattgaattacaaaccaaacttccttttattactccagttatctatttatatttggtcggacacctcaactttgttgacactgtttctttggcaattatttggttcattatcatagttattatggctagccacaagttttactcatagctaggaccctatatatcaaaggtttgttgtagtgttggctgagttgcggctagcaaaatgcatttttgaaaaatgacagggtagcaaaatgcatttttgaatactagctgcggcaaaacgtaaccttgcccaaggtgtggtttgacaaagtaaccaaacaatatatatgccacggtttgtgatgggtccatgttgtaagattttgctcatttaattaccctttgttcctcgcgtagaaccactagtaacaatccaaatgttgtcatctgaatacgtgataccttccgcatagtaccagctagtatggctttacctccaagaatggaaagttcatttttcgaaaagaagagcgaatggatgtattgtgcacattgtattttattagtgttttaaaatagctgtataaaaatcaaatggaagggttataaaccaaggtaatatgactatgtgttcgcataaaactctctcgtttctaaacttggaaactaaagtggctcaatggagaaactaaaattgaaatactccccctttcagatttaagtcgttttgattcgatcaaagtcaaactatttcaagtttgattaagtttatggaaaaagtggtaatatttttaattcaagataaatatattataaaaatatttcaattgtgttgtaaatattaccatatttatctacaaatttagttaattttgaagtaatttgacattgatcaaagtcaaaacgacttatattctgaaacagagggaatagaaaactatcgtgtcaacaaaattggtttaagcatggtagcttgtaggttgtgctaacaaaattgcaacacgatgtggtgcctacctgcatttatctataagcttgtaagcaaaaagatacaccttttaagatgaaggagattgggcaacaaccattccattacataataatttgtttagatctccaactttgatctcatgatgaatgatatatagtaatataatcatgtagtccgtgaaatctatatactcctataaaaatgtctccggcatgagatggaaggaacaacaaacaatgaaacccacaacacatatgatttatgctactcattaactaaattacttgtagcgtgccattcatggaactaggtaaaataaaacaaaatgttggattgaaccaacaaatcatcatctgcgattatgtagctgttggtttgatttcacattgcacctagggcagtcgaagattgtcttagatactcaaacctttaatctcacaataaataatatatggtaatataatcatatcatctgaaaagtctatacaagaatatctctaacatgggatggaaagaacaactaaacaatgcaacccacgcacatgattttaccccacccatattaatggaactaggtaaaagtggacaaaatccttgttcagatcaacaaatcatcaccctctgttcagttacgtagcggttggttcgatttcacattgcatctagcctaaggtaacgtttggaacagagtactcaccatattattcatacgaattatctactttaaatataggaaggaataaattaaatattttgagacataaacctaataaagaggttaaaacaattgatctaaacaatatagtagaagaaattgtttttcttgagaaatactacctccgtcctattttagtgcagtggtgagttttcatgtccaatgtttgaccgcctatcttatctaaaatatttatatttttttttaaaaaataatcacacctaaagtactattcatattttattatctaataacaataaaaatactaatcatattttttttcaaataagacggacagttaaattaaacatgaactgtgtaaaatgcagtctttttaggacgaaggtagcacttacttctaaaaacgtggagcaaatggttgtcataatatgatgaataaagtggaaagcttttacaagtacggctagtgcaataattcctttgagaaaaatataattgtagggtcaccaagaacaacaggagctagcacaacacatcgcttggtttagctcagtggcagtgtaggccgccccgccggcgaccatgacgcgagaatcaatcgagatcctggtcgacaccacatgccacatgcagcataagcgaatccatcaccaagaaatattccccaaccaaacccaggggaagaaaaaaataaaataaaaaaacgaagtgagattaacttaactagtcaagttttttaatgacagaatcagcccatccaagtttacattctagttttaacacggatgctttcatgtatgattaattatttttttactgataggatgctttcatttatgattaattattcttttactgatagatgagttttactgatagatgaggcagccatacacctgttgctcataggtgcagagagtgcatgtactgtgtttgtttaaaataaaataaaataaaataaaaagcctctttcctgaaaatgtccggtccagatgccactcggccacagggcagccacagaaaatctcgcggggaagacccccactccaccttctcttcctccctcgacacctctccccacgttacgctgcctcctcctcctcctcgcctccctctcgtgggcgtcgtccccctccgccaccgccgccgcccgccgcagcagccgcagaaggggactccacctcctcccggatctgctcgatcgcccccgattctgtagcttctcctctgctcagatccgcccccttgcttttcatccagctcgtggcacccgagatccgctgccgccgccgccgtctctgcggtcctcctcccccctcgccggtggggaaccccgccgccccgaagcgcgttgcaggtaacgatgctgacgtggcatcggctcgcttggtgctctgcttgctcgctcgcggcgcttcgattccggggtagctcgactttttacggcctgatgccggaaagggcgtggcccttgtagctcaatcgtgatttccagattagagcttagtggctatggcttgcttgcttgctgctaggggacgacgagtgtataaccctgagctttgtgctagctcagcttagtagtattggcagagtgaactaaaggcgttagcgattcttgtcatggatggggcgattagcttgatcggagtgctgagtttagaaagaggagtttggagtatagcccgtcgtctaagtaaatgcctcatgtttccttgagcttgggtttgctgaactgaactgaactgaacggaagatccatttaagctaggacggtgtgatcgatcgttgagttgatgaacttggtctatggctagctggcttaagcgtggccttccaatcagtttgtattctcgtgattttctttttatgttctctatcagggcaagtaggttctgtagtttctctagtgttacagctgttggtttctctttcttaggtgtatacatgatgctgaatatgactaccttttatttgcagcgtgtactactgccggactgccaaagtacgcttgctgctagccatttcggtagcttttgtggtttctacttaactatcgtgtttggcaatacaacaccttggaccaaaggatgcttgaaagatagactggataattaagactggatgccaaagtacgcttgctgctagccatttcggtagcttttgtggtttctacttaactatcgtgtttggcaatacaacaccttggaccaaaggatgcttgaaagatagactggataattaagaactatattggactgtacattcgcctatagacttagtcatgctgctggttgttctctgtcgctgctacaaggtgttcgtgctattgccttctgcttctgtgtgctatggtaattgtaactctgtggttattgcgcatgatgctctttgaatttgagccatggagcatgcaaggagatttccaacagatcccaaagaatataaattatgtgaggaagttggagatggtgttagtgctacggtgtacaaagctctttgtatcccacttaatattgaagttgccattaaagttcttgaccttgagaagtgcagtaatgacctggtgagtgttttgtcctttgttcattttttgtgccaaatttcattttgtatagcattgccttgttgatctatttcccccaacaaaataatttctttttttacaaaagcaattttttacttgtattatatactttcctaattttaagcaatacaaatttcgaatatttatttgttttgtcgattctcagatgctctttgtgaacatgggttcacttttttcttgctaatcgctttctactgtactgtcctattactgctttatattcttgacatgcatgacattctattatgcatgaaacaagaagagaaacattgatgccaacaaaaataaatagatgtagctcatttccaaggatgtctatctcaacagaaggctcagtttgttcttgcagaatatttatgacatattgacatgattcgatcatttgagcagaacataccttgtatttgttaggggccattgtagtactattctaagttgtcactgtaacactttactacatgagagttaaacctttttaattgtaagttagttggatcagtgtttgtttagattctttctttttttaggttgcattattatggactcccctctttataagaagaggttgtgtgtcatttggattaagtaatggaaatgcgttagtttagtcttttcaacctgcacctgacattgcctggtgaaggttgtctgtcattcattaagtaatgaaaatgaattagtttagtcttttcaacctgcacccggcattgcctggttaccctctgtgtggtatttaccctgatgaaccaatattcaacacattttattttaaacatcaaatttttgagtgagtttctactgtcccaagtagaatggaagcacacatatgatacaaatttgtcaaaatatttacaagttaagcataacataatatccatgttttactttattggtgaaatgtggtagtgatttttatcagagcttgcgcatgctttctcattgtacgcaccttatgctgaaagtagattaataataaatccttgaagagtattcatgaagagtcctgttgaaaccaacaagtgttatagagtatggattatggaatacagttattagacagacatggtactgccaaatgaatagaatacgaacaaataattcgaattatactaattttgtgtttatcccaatatatgtttatatttgataattgatgcggttagagtattaaagatatcagatatctgcacacgttgtattgtcatattatgagacttacttgtaatactctcccgttatgatgtagaatccaatgaatgggatgggatagaaattcttatctgttctagagatgcaaggtagacaaagtagctggttttgccatctaattgggccgctagttatcgggctgattcaggatcgctcagtgggtttctgggcttagttggggattaccagtttaatcaagcaattgcatggaattggtcggttaatcaggtgaggtggctgttttggcattcacacaagctaattcctttccaattcgctggtttgtgatgttctcctctgcgactctgcgtacttataagcgtcaaagtaagcagccattctggccgatttttacgacattggttgagactaggcttcctacaatttggtcattctttccagaacaactatttttctaccttcagtgatatggtttgagtgctggatatcaggatatgttattcctgcaaatggcatcgttcaaataacttatcttaaaaaagtttgacttgtgatctttaagtgaactaacttttgtaacaatctaaacttccttacttgggacatggcttttcgtgttaagataaaaaaaattgtcctttgaaatatagatggaaatgttataagctactgagaaagtaacatttctttttgtgccacaagtgcatagtatcacctccttcagttcattgcttttcctgtcactaaacatactaacttcaaatcagctgcttacattttggtgagcttgtgtttctatccttacggaattgccattctttaggatgggataagacgagaagtacaaaccatgagcttgattgatcatccaaatcttcttcgagcatattgctcgtttacaaatggtcatcagctttgggttattatgccttacatggccgctggatctgctctgcacattatgaaaacttcttttccagatgggtttgaggagccagtcattgcaactcttttgcgggaggttcttaaagctcttgtctacctacactcccaagggcatattcacagagatgtaaaggtaatattgattctccaccattctattagagtgnaagcataatatgtagcagcacagantttgcataatgcgttgcactggactcaatatgaaattcaatcacatttcacctgtccatgttttagacttagagacattgggatgacacatgattaatggagagacatgaggcatcacatttttgttgctcctgtgttatattgagggtacagctaattgacagccagtgtgatttaaggcttgggaacaatcactgactcgcatatgcctcaccttgggatggttatgcacccagaagtttagtgccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatgattgttccagtatgtagttattgatacaaagtcatgaccatttgagatcacattgaaatacaaatctagtggaacaacttttatttcactaccctacaggctacatatgttagccaaattgttgaccaaaaacttaagaagtttgaagtttgaatgccagtcgttgcattattatattttatgtaaacatatttatgttaagattgtgtaaccccatactttttgcaggatggctccagaagttatgcaacaactgcatggttatgattacaagtaagttcataactggcaatctaaatctgatttgttaagctaccacaactgattaagttttccttttgtcatcatgttcaaaacatagagctgacatttggtcctttggtataacggcattggaactagcacatggtcatgctccattttcaaagtaccctccaatgaaggttagcactgaagtatagtttgttttcttattcttaataaatttccatgaggttagataacgatagcggtacatttatcacattgtaggtattgcttatgaccttgcaaaatgcaccaccaggtctagactatgagagggacaagcgattttcaaaggtttgttgtattcaccatgttccttttgtcgacgacttagactgtatattaatcataactgttcttttttgtagtctttcaaggatttggttgcaacttgcttagtcaaggatccacgcaagcgtccatcttcagaaaagctcttgaagcattctttttttaagcatgcacgtacagctgaatttcttgcacgaagtattcttgacggcctccccccgctgggtgaacgctttaggacattgaaggtgcaaatcactatttatgagatggcattcaatttgatttgacttgtctaatctttattatactcaattgcagggaaaagaggctgacttgcttcttagtaataagcttggttcagagagcaaggagcaactatcacaggttagatgctgctcttttgttctaagaaataatattgtcagaatactactctctctgtgactctgtcctaaaatgacttgatttctagccattccatggagtagtcagtgaaattttctagagatctcatgtcattggagttaacatgtgatgagagatctaggttttgcctatgttgaagcaaagactagagatagatatatatgttaaagttgttgatctgttcatccacatttcttgatttaatgatatcattaaacaaatagttttgctagcttgtttttcatcatttcctttctacatgtgctagattgagttgagttttattggatttattaactaaatggtgactgcatttctacaactgtggcaaatatatatatttttaaataataataagaactatagttagctaatagcaagctcatattttgaccataagtaagctcatatctcacatttatatattttactgtgtatttatatattttactgtgttgtatagaaatgacttattgtagtcatgaattgcacggtgcatatagattcaagtattattgaccaataggctattactgacttttgcttttcagaaagagtacatacgaggaatcagtggttggaacttcaatctggaggacttgaaaaatgcagccgcccttgtaagaattcgattcgaagtgctaaatctttactactgaaattttgaagtcatgagctataattaagccgtaacttttgtttgcagtgaaccttttctaatcttgaaattttgttcttccgcagatagacaatacaaacggaacgtgccatttagatggtgttaacagcaaattcaaggatggtttacaagaagctaatgaaccagaaaatatttaccagggacgggctaaccttgttgcttctgcaaggcctgaggtaccgaggtcccatcgtcttatttatgcaactaagaccccatgaactagctggaaacaacaaatctattgcattatagctttactctaaattttacaggatgagatacaagaggtcgaagatctggatggtgctctcgcctcttctttccccagccgcccccttgaggcactaaagttagtagtaaatccatgtcttttgcaacattttccaatcatgtttgaagaacctttgatattgtggaatgatgtggtttatagcttattgtttaaataatctacttgtcatgtttgaattgtcagaaccctgaacaataatttccttgctttttgaaccttcatttacattagatttatcaatatttcgcagtcaatctgagagtttggtaacttaaccccaatcaggtgatatggtaacaatggagccatgtttcaataggaaaaagaaaatcttaattgctaaatatattggtgtgaagtatcttaattgcaccacatttgtaataatgaatttgttgtgtactccttccgtcccataaaaaaccaacctagtaccggatgtgatacatcctattactatgaatctggacatacatctgtccatattcgtagaaatagaatgtgtcacatctgctcctagatttgttttttatgggacggagggagtagcttgcaaataaattagtacttgtagtgtgtgaatcctactgctccattctgaagtagtataattttgaactggagtggccaccttaaattgttttggttcgctgtattgatgtgctgtcaattttgcattttttgttctcttcgatataaaaaaattgtgagctgtgaagaatctttactgactacagtgacacagatcttgctttgatgtttgtggggatgatgatccccctactgctactgatttgagggagcaaccaaatatggaatctacatcacctatgcagcagttccaacaaattgagaatcataaaagtgccaactgtaatggtgaaagtttggaaagaagtgcctctgtaccatcaaatttggtcaatagtgggtcccacaagttcttaagtggttccctgatacctgaacatgttctttctccttacaggaatgttggcaatgacccagcaaggtgaattaatttcctttgttttctttatttattgttgaacagataacttatgattgtgttttcatctcaagtctgaagtatgtgcttaacttagtttaagttcgataatccccccaccccactcctacaaagagaacatataaacatgccttaaagtgaacagatttttttttgaatcaagtcattgctagttaccaaccaagcacaatgaccactctatttcgttgatgcaaactcttagatgatgcaaccatttgcagtggcatacagcaggctctgctgcagcacctagctgagcgctgagcttgcctagctcatgagtcatctcattcctctgtcaatgtgctcacttgatccgctgccacaggaggacaagttccactgcatcacatgctttcttttttccaaatcaggtcatcacgtgaactagtcagctgaccagcttacagttttgttggtggttagcaaacttgattatccaagtgattatttgcattaagctttgttcagttcaaaaatatattttaaaatgatttgatagattatttagcgcctagaactgaaacagtgttaaactagctcagtttgtgtggaccagctctctctgtgtgtgtatcaagtgtgtgggtggttgcatgaattcaagggttaattctctgtgttctgcagttgacagtctagtatttttttctttgattccttgataaatcaatgtttatagaaaacaagatggaccaagctgtggttctttttatttaagattaaacgagttgtcaggtacagtttcaaaagcttgtgcctagtgcctatgatactgtgctcaccttgtgccacaactttgtccctgtcattctgcctggtttgcattgcgatccttcatcatgctacacatggccaaactaggtcttgtcgagattggggatggtaatcctgctaggcggaaacgaaaaggatcagttctatacacatggattttacttcgcccatatgagaactgtagtgttcacttcaaattttgaaatacctgcatgaaaaatgtgggatcttagcatgcatttttttttatgcggatccgagtgacctgcaggcacaaactattgaaattggtcattattgtgagaagatttatattgtattgtgcattttagatagctatgcgacaatctcaattcaatttgtataggcaaagtactctttgccctgtaaaatcatgtttatgatatgctgaataggctaaaaaaactactatgggaatttagattggacctagaaaacatgatagaaccaaaaaaaaaaaagaaagaatgaagcatggatttacatgtacatatttgacaaaagtaacacttgtaaaaaaaacctttggttctttttcgtggcctcctactgtagtcttaatatttcactctcattttgcttcttatcatatcgtactaacatatcccatattgtctaatattctagtcggtgtaacacatgctattttttttttgcttcttttctgatttaggaatgagtgtcatcagaaaaatacatgcaacaggaaccgcagtgggcctttattccgccaaatgaaagatccacgcgcacatctgcctggtaagataatcatgaactctatcaactaacacgttacagtttttctttttttagaatagcaagaaaaagctttaaacctgtctcttttatttgtcattgatgtaatttggcttgttatgactgtttttgagagcagttgaacctgaggagcaatccgaaggaaaagttatccagcgaagggggcgttttcaggttacatcagatagtattgctcaaaaggtactggtttgttaattgagcagtcacatgaaactaacatggagggacgtcatatgcattgactattttgatcaatactccctccgtcccataaaaaacctagtaccaaatgtgacatcctagtactacgaatctgacacatcctagtactatgaatatggacatacgtgtcacattcggtactaggttcgttttttataggacggagggagtattaattaagcacagtatgttgcagttcaggactttgatttttaattatttatatttatgctaagcatgcctttaactgctacaatttatattatgtcaaaacatattcgaatatcatttaattgatacctgtagtgattggcaatgtttaagacttttgaagtggagggcaagaggacacaaatattttcttgaaacttttgtttgtttcatgattttcagctgctatatagcaatggctgctgaaatattatttgatcagtttgctagttgacttgcaaagagacaagcatgttttgcctgctctctgactgcaaaagaaaagatgcagaaatgggattctgttttctgattcatgttatttattgctgttccttcaaatttatttctcacagtccctgcatggtaatcctcaaaaggatttatcaccaatgctattctgatatcaatatttttgtcaggcttaattagtaaagtgcaaatatttttttcacattagtttgacaattacaaatgtcttaggtagcttcatccgcaagcagcagtaggtgctcaaatttaccaatcggagtaacacgatcaactgtccatccatcgacaattcttccaacactacaattcatgatacagcaaaatactatgcaaaaggtattcacacacttgttatttcacttggcaagaattgttcagaattttcacaattcttcgttttgacaggaagtgataagtagactgatttcttcaattgaggaaatatctggtatgtatgataaaattacttttgttagactttaaagagataatttcattagtatactgatgttatggttttaatggggcatgtttctgacagatgctgctgatgcaagtacaactggttcatctcaggtgtgtatcacgaactgtgggttatactgtcatttggtcttcaggtgtaaactttagatagttaagcagctcagagataaccatgccgtgtggtagtaatttcaattttaggttcattttaatgttgcacaaacatgaggtttcctcctatgtgtttattcagagttagtataataagtgcggatatatgtgcagccatctggagtgcatttcagagagaaggaactgcagtcgtacatcgccaacttgcagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggannnnnnnnnnnnnnnnnnnnnnnnnnnnnnnnnnnnnnnn

SEQ ID NO: 19062 - DNA, 13345 bp, Oryza sativa
  unsure (1)..(13345): unsure at all n locations
actttagatagttaagcagctcagagatacccatgccgtgtggtagtaatttcaatttagggtcaattttaatgttgcacaacatgaggtttcctcctatgtgtttattcagagttagtataataagtgcggatatatgtgcagccatctggagtgcatttcagagagaaggaactgcagtcgtacatcgccaacttccagcaaaggtataaaatatttcttgtaggagtaactttttgcatatttatgaatacttgactgaagtttatgaaatatttccagtgtcaccgaacttgctgaggaagttcagagattaaagctcaaaaacactcaggtaaatctatttttaaacttcaatttagatttggaatcatgaacaccgtgttattttgtctaaatattggatgtattctctacattacagctcgaggagcagatcaatgcattgcccaaaaaagatgaaaggttacgaagagaggatacccgacaacaatgatatgcacaatgcacttgtaacccccgctgtaaaatcagttccccaattttgaatttggttagcaaaattatttgtattttgttcgaagtcaggcctggtgtatctttgtaatttgtaattattttagcaaggtgaaattatagttattttcatttgtacaggatatttcaatctataccaaagttaaaagcttggtactagaaaataccaaatcatctttcctaagggcccccttgatttgttggaaaaatgtaggaattttggaggatttcaatcctatggggaaaaaaatatcctatgaaggtctttgaaacaaatgattgaattctatccaattctttaaaaatcctatggaatgggtaatcatatgtatatttggaaagttagtaagaggtttaactttttggaaaattttctctgggtctatctctctcatctgattcccgtgtttttcctgtggtccaatcaaacggttattcctgtgttattcctgtgtttttttttttgtgtttcacaatcctctattttataattgtattccttttagaattatgtgatttttctattcctctgttttttcatccttactattcaaatgggtcttaaaccagtagcagagtgcatatatataatggtcaaagaacgaacatacaagtattgcaatcaaaatcagtcatggcaaaagaagtatatctctaccatcttaaatgcagagttctccactcgtgcaatgtgtatgcatgaaaaagtaaccatcatctctctaattatatcagcttggcctattaacatgcgagcttttagtctacccctaatatctactattataaaaattaaaatatttttaccagtactttggtagatttgtatttgagtcgggttttaaagttcgttcgcttttgaaaatacagaaggagtcgtataagaaatcatttttaaaaaactagcaagcaaactcctaattaccgctcatgattttttagaataatatatatccaagcgaattcctacagtgaatttcaacttaactaaactgtgtaacaataacaagattaaaatattaaaataactttcacccgttgcaacgcacgagtattttcctagttatatcaatatgcgtctgatccattacaatgtgcgggcatataactagcaaaagtaaaaaaaaaaaaggattgtttgcaattgtggaggtagaactagttcagtaattcaatacgcttgctagcaaagcttgctttgtttttgatagttgcggcatgtcatgtcctgtcgtgattttttttacagggagtaactatatttacggcgtcatattttttataaaaaaaatagtcgacatgtatttacattataagtccataaattacatatgtgattttagtgcatctacaatgcaagtcctaaaattacatatgcaagtcctaaaattacatactaattatataactaagtgggggtgtaactatggtgtaaatttatataaatatataatggcttgtagttgttgcgcaacagtacgtgcgaaagctactcacacgaagcagcactaatcttggaaaaaatctgaccgaacaagaactgactgtaatgaggcagaaaaagtggcgagacaattctagcaaagccgttttgttatacaacatttactggtcgagtactacctttactcttttagcattaatatttaatatattcttaagtattgcaaaagaaaagtattgaacttgtataattaagtgaaagtatgcttcggttacatgagtataattaagtgaaagtatgtgaaatgtataatatgtggccttaaatttgaaaattcatagagacaactggtgtattttaccatgaatagtacttctctcttttttttttcggggatatgaatcgtacttgtcaaagagaaaattcaagccacagtactattaatgagattgaagaacactattaataggaaacccattagaaagctagcataatatatcctgatagtaccggacaataccttgtgctaactcgtgatgcttcactgagaagtttggtactggtcgagtactacctttactcttttagcattaatatttaatatattcttaagtattgcaaaagaaaagtattgaacttgtataattaagtgaaagtatgcttcggttacatgagtataattaagtaaaagtatgtgaaatatacaatatatgaccttaaatttggaaattcatagagacaactggtgtattttaccatgaatggtacttctctttttttttcggggacatgaatcgtacttatcaaagagaaaattcaagccatagtattattaatgagattgaagaacactattaatagggaacccattagaaagctagcataatatatcctgatagtaccgaacaataccttgtgctaactagtgatgcttcactgagaagtttggtagattcagaatttctatttcgtgaaattaatatattggttagcatggaggaaatcgttaatgatgccattgtggcctttcaaggtgagctagctaagagcgctgatgaaaatggcaatgatgctgacggaaagggcagctggcgtgtggccaaaatgaaacatgtagcttgctgctacattgatggggcaatatggattttttcctatgtatgtatctctatgatggtgtttgaatctcccgaagatgaagatgaagattaagtgtttcacgtaaaatgaggtggtaataacatgtgattaattaagttttaattattacaaacttgaaaaatggattaatctgatattttagaacaactttcatataaaaagttttcacacgaaacacaccgtttagcagtttgaaaagcgtgacactttaatccagaattttagcagtttgaaagattcgaacggggccatgtatgcaactatcatctgtaggactatggacctgttggctgtgtgctaaaccatatgtggacacgttgatccatggtatgaccttgtcatttgtgtgcgctaaatatattataggtgaactttatgtatgtatgcacctgttaatctattatatgtgcaccttcatgatatatgaaccataaatgttatgttttgtattttgtcggtgtgtcatatttgtcttgttttttttgtcagtttttgaaattttgctacctattaatcaagctaatgtggtatgtacatgagagcaattatgaaatcatattacttaggtcataattatcgaatcatattacttaggtcataattatgaaatcatattatttaggtcatagcaagttttgatgcactatctaccagttttactttggaaaaagctactagacagtttattacgctcatgttgttcatgttgagacgcccaactagacagtttattatgctaggttgagtgagcttctcatatgggtaagtttaactagcatctccgtgcaaactgcgcatagctgatcatctaagtgccttatggccctattgcaggtatgcatcagtaattgagctctctcatttttttcattcataatgatcgatggttaagatgatactatctatgcagagtctgatgatacaactgaaccttagtagtattttcttagcattcagttcttttttaacctagtagtgtttttctcctcatatatgtatgcaatcatatctccatgcacaggatgtttttcaaacatggttcatatgcagcaggacaaactgaagcacaaattaatttaggtgcaattgtaaatttaccactgctttcaatcgttattgcaagactgccactagaaaattgcaaaaataccactagaactgttattcgagtggcatctttgcaaaattgaaaaaaacggtggcaaatttacaaatgccccattaatttagaggcttgctaacccacggtataccgttagaacgatataatcattagtcggacacctcaaccctaatgcacatggcgggcacgcaccagcttgcgtgcatgtgctagtgctggtcgtggatactgtatattttttttggaagcaattcacatacacaaatacactagctaattcttactctgcgcatctgccatgcatgacatgacaagtgctcctcactcatgcacccatagattatatgaatgcctatccttttggtcacacataactacaaactcctctataattgcgtgcttagctatatgacatgttattgttattatagctatactcagtggttgggctggtacctcagtatcttatattatgatactattttttacatgtcaaaatatgattatctataatagtacctcgaaagtatcgtaaagtatctatcatgatacatgtgggtagcaaaccaagcacatatcagctggtatatgtgggtctcagttttaacatatacccagtctgataccaaggtatcacgtatgatacctattatctctggtatttgtggtactaagcatgatacatatatgtattatgttgatacctgtaggtaccgggtctgatacttatatgtactagacataatacctaggtatcggtcgtgatacatgtagttaccaagtctgatacttataagtatcgtatattatacccaggtatcagtcgtgatacatgtaagtaccagacatgatagatgtagataccagatctgatacttatatgtactagacatgatacctaggtaccgatcatgatacatgtagttacgaagtctgatacttataagtatcatacatgatatctaggtatcagtcgtgatacatgtagataccagacatgatacttataagtatcatacatgaaacctgggtatcatgtctggtacctcgtgatacatgtaggtaccagacatgatacctagatacgactcatatactcacgtattttaccttgaaacaagaccgtttatcatcaggtcacataggatcacatatagcaatagagaatcaagtcattttctcttgctcatggtcattggcaactttaacttcgatttgatgcaaatagcatcatcaaggcaggagtagtcattttttgatcgtgacaatagtagactagtagtgcatgtactcctcctatactactagtgcatgcaatagtatatggcaggcagtagtatagtacggagtactactagtactgtactagtagtgcatgcgcaaagagttaatccgtggggctcgtgggacccatgcgggaggagagatgggtggttcatttgcgacgctgggttggacggtttgatgccgtgcataatttgtactgtcctaacggtataccgttttatagcttttctcttaatttatatccccacacctcagaatcaggaggtaagtctttcattttcatctatttctgtacatacggtttccctaattaatctgcatcattgaatcacccttctttggcttcatcttcaattacttttagactttattggtttactttcataaattgataaatatctttggagtaatttaatttaatctaaaattaatttacatatatgataaaagtaatatttacaacatacatttttcatcgaaatataatcgtgtaaaatcttgttttaaaaatttaattgtaataaatataacggtgtaattggattaaaaaataatacctagtttaaaagatatactacctcctttttaatatatgacatatttgactttttgtgtccattcgatttattaaaaaaaattaggtaactataatttattttgttgtaagttgttttatcactaaaagtattttaagcatgatttatgttttatacatttgcataaatttttttaaataagacgaatgatgttaaaaatcaacgacgtcatctattaaaaacgtagggagtaagttttttttagctgcgctgatatcctttataactaaacagcatgcatcaccttgtctaatcacgaaccagtcgcgctataagactaatataagtgcgcgcacaataattagattttaccgtaacaattatatatatattaaactcctatgtttggtacagcatcaatacagaaaccgatcgcccccgtcaccgttgtgcgctgaaggaaaaatcagaatcggcgatgtcggccgacgaggatgccatccacctcctgtccggcgggtcgtctagcagctggcgagacgcagccgccgccggcaccgggtatatgtcctcctccggtgccggtggtgaggccaccgtgattgggctcggcgggtcgtccgacctcgccctgtgatcctgcagcaggtgcaccggcgacgcggaccggctcgacgccggcgtcgcgaagtcgacgctcatctgcgccaggaacgcgtccgcgtcccggaccttcttcttctccatcgccttcttcctccagttcatcagcgccttcatcgtttgctcctcgaagattgtcttcttcatgttcgatcccatctgcaagtgatggccaaaacacataccaacacaaagggcatctcatgggttcaatattgtggaaataaagaaaagacattttatggggactggtagtgaaactgaaatttcgaaacaaaaaaaaggttttggactgattttgaacaaattttgcaaaattccaaaaaaaaaccccctccttttcttaatagatgatgctgttaacttttggacacttgtttgaccattatcttattaaaagaattgtacaaatgcaaaatataaattatttaaaaagtacttttagtgataaaacaactcaaatgataattacataaatatttttaataagacaaatggtcaaaacgtgtgtctaaaaattaacagcgtcgtcaattaagaaactgctaatagaatttgtgaatggcttgttcacctgtgtgacgagcgcgtagagcgggaaggtgatgtagctgcatagcacctgaagagagatccccacaatgacttccacgatgctcagccaaatattttcatggaagcatttcttcagaccaggtgttgcctgtcacacacaaaacaaccagatcgatgaacaagctgtgtcattttttgtctcattagtcagtgcatgcatcacacttaatttgcttaagaactgataatggcaacaactaagcaagtagcatacacaccatagtccatacgaaatgcgccatctgaaatgcgttctggtgatcatcgatccgtcgtcccatcgatcagtagccacaaatggatggatgctatgttagttaattaggtgttaattgtgaaagataaagtactatttgtagttgagcagcaaggtttaggttttaaacatgtacatggaagagtgtcaggtgtatgaagaacaagacccagtcagggcggttgaaccagaagtacttgttgcttggttcaaccacaggtgctccctggatcacagtggccctgtcctgtatctcttgggccatctgcatgatcaccatctctagcttggtcccaactaacaagacgatctgagacaacggtggcattcacatgaatgtttgttcattagttatatgatcatattaattttcatgataaattaaagcataattaattatgttaactgtttctttggacagggaaatttcgctcttacgatgagaggaacaaaagagatccaaataagtgtgccaagacctacacgcggggaaaaagttgaaaaaaaatcgatggtgattataagaccaattcagaacaaggttttgagagtaaaaaacagaatgaaataggacaaggattaccgtggatatcgaggaagagtacaaggattccgacgaaccacagagggaggctgcaaaaccagccaaatgtgtcaagatccacatacacatacacaactggagactaaatatgtttctttataaaaaaaatgttgaatataagagtcctataattaataaagcgaggacggacctgatgccaacgacaactttgaagtcgtcctccaaagacctcttgatgtatttgtggaagtcgaacttgctattctgcgacaaatgcgcctgcaaaagagaagaagctaaaaccattactcaatgcacactcgaaaaaaaaacctggtctctgtttgcatcatcaatgttgaattggtcaggtttgattagtatatacattgatgaagccttgccgcatggtcaggtagtccaccttggtgacggacccaaagaactgcctgaagaatgctacctaacaacaaacacggcatgaatattttttttttcaaaaaatatggattgaattggaacagctaggccagttgcaagaataaaaaacaagcatgtattcggagattgataactcacgatccatctgagcccaggggtgcttgagaatgatcccagatgccgcttcacgaacgacgtctgatgcgtgaacctgaatcgtgaaggatctgcatggatcgatcatatttttcagctgatttgctcctcctctttcaagacattatcataaaggttctgaaatgaaatagttagggagattcttaattcactaccgattgcgaactgatactccaatgagttggtctgtgactcccacttcttccatttcttcatctaaaaccaagaaagaccaattattatatatttactggcaaattaataaattgggtttcttgtcgaaacaatccatttgaaggactgacaatcttgctagaactagagaaaacatgtgcatgagggacagaacgacaaactcactttgaggcgccctaaacccatggtgatgacgcagtaggtaacatggaacacggcgagcacgaagatgaaaatgtgcagctggtgcatgctctttgccgacatcagcgccaccttgccctgcagaaaacccaagaaaaatcaattatagttaaattagttattgcatcgaggttgtgcttgccggcagctggtgttattctcacatcgaatttcgagcagtagtccccgccgccggcgccggccaaggaccggcgatcacttgctgcttcttcttcgatggcatcttggcctgccttgcacggcaacaagatgttggcagccgacttggggatgcagatcttggagatgggcgcctgtgccacggtgagaagcagggatatgaagcccagcagcatcagctctgcaagtgcagataggacaagaaatatgagaactgcggtggttttctagtttgtgtgccatctaaataattatttttttaaaaaaataaattaatatatcattttacaaatatatacataaaattcaattcctaagttgaaaaaaaacaaatttaatgtatattaacagttaaacttgtttgttttgtaatttacagaagttaaatttaatcctacatgctcgtgaaatgatctatcacatactaatttgtattgttgttattttttaaaaaaatcataaccatttgaacagcatataatcaacgagggaatataaaaaaaaatcatgtaatgactcctccaccctaccttaaaaaaacaaattaacaaaaataatttttctttctcctttttggcctgattgctcgctcgcttgttaattctctctcaaaaatgagagttcaaaatcataaccatttgagagttaaaaatatttcccataagaacatggtgaatcctgtgcgcaacaatgaaaaatatgtaatgactctgactcggtccattgtgatgaactggtatggtttttctggtcatttatgattaaagaagattgctctgtctcggtcggctgatccagacaaaacaactcggtcgtcctcaaatcgctacatgcatgcaataatttagctattagtttattccttttcctcttccccgctttaaatattttttcttctaaactagttaggaactatacttataagccaaaatttgaattttaagagttgattttgagatttttcatcgaagtttatttttcagcctttgctgctagatcgttaagaacacatacataaaagttttatttacaaattatttttcgtttgcaaatataccgtttggcttattccctgaataagccaaccgatgggcatgttatccaacatacaatctaatcacaccgttatattagatgtaattaaattttacaacaagatatcacattattacattctaattaaaagaatatgtgttttaaaccgttaaaactcaatatttcatacataatagcagtatgtttgaacatatgtcttaagtgtgtttcacaaaattcatataactacttatctctaatctctctccacttcatccatctatacgtgtatgtatctagtaatcttcaaaatgatttttctcttaaactactaatatatatatataatccgatcacaccgttgtattcgttgtaattatatctttacaataatatatcgcatgattatattctgatgaaagaaaaacatatgttttaatctgttaacattagatgttttatacgtaacaatgatacgtttcaacgtgtctaatatgtgtttcacaaaatatttcattgtttgtggctgattttttttaacatatataacctaatatttcaccgatgatcaaccaaaaaaattagtcacccgaattttttttaagtaatcggacatccgactggtagtttcctccatgattaaatacaagtagtccccccttaaaaagcgaaaggaaactataaacggcttatttgtgacgtttgatttggaggacccagtcttgcgtaaaatacttgaaaaaatgacgagggaggcagcaaagtggctagaggggagcagcaatataatattcccttcttccctaaatgtttgatgccattgactgttttaaacatgtttgaccattcgtcttatttaaaaactttggtgaaatatgtaaaactatatgtatacataatagtatatttagcaatgaatcaaatggtagaaaaagaattaataattacttaaattttttgaataagacgaacggtcaaacatatttaaaaaagtcaacggcgtcaaacatttagggatggagggagtaagagctagctgagggtgagctgaggctgagggtgacctgctttgatcttgtcgagggcgtcgcccatggccttcttctgccgcctacggaaccactgcaatgcaagcagtagcgccaccacagggcgatcgatcgaccaggatcggatgttaattgagatgtcacaagaacacaacaacaacaacaaccaaattaactcgagagatgagcacaccgcgtgcgcgcgcgggtacatggctgaggttgtggaggccgtgctccatggcgacggagacgagcacgaggacggcgcagacgacggccaccgcccacgtcggcgtctccggcaactcccgcgatcccgatctcccacctgccatgatccgatagatcccctggtgcgtctcggggtgagctgactgggtgaccgctagcttagctctgatgcacttgacactttgacacctttgacagggggcggccggtttttattaaagagcgggggcgggccggggggcggcgggcggctgtgtcaaagcgcgtgcatcgccggccaatggctcgatcgcggcaggttgggcgacgtggtgagcccgtttctgaccaactcatcccatcctacgtaccggaaatttgtgcattcgtgagtagtgacgatctgccgggtacttaatccttaatgcataacagggtttacgggtcaacataagagggttgataggtcaaccaacttgcaactttttctatgagttacggtccaactaatatgattcgtatggagcaagtttaatgctatctccattcgatcttttttgtatttaggcaaattaaatttgttacaaggcactctaatttcatggttttagccggaagacttcgcaaaaatcaagttttaagggaagacactatcaaaaaaaaatagatatttgccgatgaacatcgcctctcttttttattgtttccatccgattttggagagagaaaattatgaaaaagcgatagggaatacccttggggcactacaccaagtatgtcaagtggcctctttcccaggagcccgagcacatctatcatattagttctagcactcacccaggaattaaatgtaccttcgaccaatcatatgggagcacaaggattggaagggcccacatgacagtccaaaacgactgaaattgacctaatccatagtgcaccgccatatgggccgacttgtcagacatagaagagaggtcctagctagaggttgtttgcttggttcggacaaaacagggttggcacccctaactgtcagcgttcgatcatgtggcgatctcctattggttgacgatggtggttgtgagtgtttaccgacttaactaccgacctacaaccgaccattaagctgctataaaaggatgagctaatttcacttccaaacacacaacaaaatagagtacaactcactttcatacattaggcatcattttagttgtgtggagaaaaagggtagagagtgagaaaggttccggaggagtgctggagttattggcgtgctctcctctcctgtacctcggtgaatacttctttaataaactaagtgttcgagatttccttttcgtacttaattgacttacgtaagtgaggtacattctcatcgtcgtgggtttgtcgcttactattatattaagtactctagtactagcactctccataaagaatgaagtttctacgcgagactagagtagtaattgataacttaggcgtggtgtctagattagtggttacctttgtttgttgtgtgcttcgtagaaaattaggtaggccggctcaacttggcagatcatgggagagccggtgtccaaagcaatcgatagagttttannnnnnnnnnnnnnnnnnnnnnnnnnnnnnnnnnnnnnnnnnnnnnnnnnnnnnnn

SEQ ID NO: 19063 - DNA, 7481 bp, Oryza sativa
  unsure (1)..(7481): unsure at all n locations
nnnnnnnnnnnnnnnnnnnnnnnnnnnnnnnnnnnnnnnnnacttgtcagacatagaagagaggtcctagctagaggttgtttgcttggttcggacaaaacagggttggcacccctaactgtcagcgttcgatcatgtggcgatctcctattggttgacgatggtggttgtgagtgtttaccgacttaactaccgacctacaaccgaccattaagctgctataaaaggatgagctaatttcacttccaaacacacaacaaaatagagtacaactcactttcatacattaggcatcattttagttgtgtggagaaaaagggtagagagtgagaaaggttccggaggagtgctggagttattggcgtgctctcctctcctgtacctcggtgaatacttctttaataaactaagtgttcgagatttccttttcgtacttaattgacttacgtaagtgaggtacattctcatcgtcgtgggtttgtcgcttactattatattaagtactctagtactagcactctccataaagaatgaagtttctacgcgagactagagtagtaattgataacttaggcgtggtgtctagattagtggttacctttgtttgttgtgtgcttcgtagaaaattaggtaggccggctcaacttggcagatcatgggagagccggtgtccaaagcaatcgatagagttttacctcaacttaagtacagttaattaatccatatgaatcctctctagcttaagcctatcatccgttgttgtccttaattgaattctattcttatatatatagggttggtatttgttaagatcatagataaatccgcaagcgcacagataccgctatagcctttcatctaggagtatcccaagggtacatatttgtttttctgctgggaatgcggcggtatacagagttgggttatatattcataaatcgtaaccatgctataattaatataccaaaaatctaaacatgggttaagataataataaatagtaggctagtgtgacacagaagattcgtctctaataatgatacacttggcagtgaagatggactaaagagatctaaggttcatttgtacttctatattactatccagtttacacttaacaaatacatgcttacaaggctaggacttacctctgcgcaccctggtacaactgagagaccactccctgctagcctgccaacatggtaatgacattttacaaactcttatgtcatacctagaagtggaggaatacaaaggacggatagagttgtcatcacctgccgcctaactcactttccgtggggtatacccgcatccaatggaatttaactaacctaaacaccatgtttatgctaataaataatgtcatgagttagagctagtgcaacccattagtattggaccgttaccatggcatagatcgactagcataatcaagtgaaacagttaaatgaagtacaatttgtttgtagaacacaaaattaataaactaatatatcaactatgaacactaataagtaaataagataattttttaatgcaactatagtcttacaagaagagtaaagtactgaagacataccggaatctccgagaagacaagaggaccaaagattactttaagcctaactacaatatgtggaatgagagaattgctccttgagtgtgtgctttgagagagaagaagtgatttccttttatagttgcttatgacgggaaggccggtaactcgcacaatcgtcatcgggaagcaaccatgaagcgccacgtggagggtggatatgagaggaggtgatggcggtttggccgaaccctgggccccaccccactcaatcgcctttcttcaagagctgacgtgtgaacccctagaatgttgcactgtggtttggccccactttagctttatttgatctgacttgtatgcccattaatccgtgtgctctcacgtgattcgtcggaagtgtgtttcttcgcatgccattgcaatttctccttaatttgtagcatacccctgcatacatagtatttctccaagaacaagtggaactacattatttagtactaatatacgtgtaagaaatgttagttctccctttatttgttctaaggtagttaacggtcaaaaccgatacttaacggccgttaacaacaccctcaagctaaacttttgctcctcctcaagtaaagataaaatttaggttgttgatcaggagttgctaccatgttttatgccacaatagtaccatgcctacaacgtatccttctacctagaaattaaacaaattggcaattgtacttttacctttcttaccttactcccgttggggcttttagcttctcctcatcttgggtaattgagagacagaacgaatcatagagcacaatcacttactctttgtttaactttatttctagaggttttcaagaattttataaataaaaggaaaaagtacgaattaccccccccccccgaactattgcggtcgaccgaattaaccccctgaacccgaaaaccaaacattgcacaccctgaactttcaataccggacgaattaccctcctcaacctaacctagagcagttttgtcctacgtggcttacgcgtggcaatctagttagcatattctttaaaaaaagttggtgggacccacttgtcatatctcctccctacctcttcccaatctctatctctctatctcaaacgcgcggacgcatgtgcgcatggcagcagcgcagcgcggacgggtgggcggcgaacggcggtgcgcaggggcgggcggtggacggcggcggcggccgcgaggcgagggttgaggtaggcgttggcgcgaggagtggggatggcgacggggagagcgggctgggcgcgaccgtcagggtggaggccacggcagcgacgatggagagggacggcgagggggcggagggcacctcggctgcacctccgtcggatgcctgcacgatgcagcacaactgcgcatcatcctcggcatcacccttgccctcgtcctcggcgtcggcagcggcggcgctgggaggagctggtcgagagtggcgtggaggcccaaacttggcggtggtggccgctgccggtgtggctaatgctaggatcgaccgcagtttggttcgtcatcttcaacgtgggggtgtgcgccgtcggcgtgctgttgtcgcgtgcgcgggagtcgctctcgccgcgctgcggcagtggcggcggcggcagagtcacgcgcacggcctctagagcagcctgatcgcataacactcggcgttatacatcttctccttcccgtcggtgatcttctatgagttccatcttgacgccggcgagccacaaacgccgatgccgcgcaagtatttgtcggtggaggaatcgcagcccacgacggatctcgcgggaaggaatcgacaagcatgccgccgtttcgagcttcctcggcgactttccctgccagcactgtgaacggccgccgtgcttgtcccccacccttgtctcctgcacggcaatgtcctccgtgacgacgccagtcacccgagctcgccctgcctccaccgccgactgcctgagttctctctgcctccgcctcctccaccggcgcggagctcgcccctcagctgctgctgcggccgctgccttccccccgccgcagcgtcgcaccccgtcttcctcccgagctctgcctccgttatcggccacccaagcgagcgagaaagagagagagcagagggattggggaggggagagagatgataggtggcgccagtagtttttttttaattttctttgctgactggattgccacgttggcgccatgtgtccaagctcaagtcaaaaacagctcaaaacagtgctttggggggggggggttattttagttgggggtgaagaatgtctggttttcgggtttaggggggtaattcggtcgaccatgatagttgggggggggtaattcgtagtttttcctaaataaaataagagttcctccaatgacattctcatatcgcttaatgtgtataattcctcaccaagacattgtgttgcctctttttcatcctacctctaaaaggtttatatgtgaagctcaaggtggggaaaataattaggcaatactcttgcatcacatatattgcaaaatcgaaaagaggatcaaggagaaaacaaatcatacaatctgatcaagatgtgcaaagtgtgtggctatatggtagaaagtggtatgtggtactctttgtcatatattgactatattttattcctactttgagatatgacatttttttctaactatttttttctcatgcagatcaagaacattgatgagcattcacttcttttgcaactactctttttttttccacagtgcttgagaatattttctattctctatcgccttctcgttgtttttatcacagccatctcttttgcatatataaagtgagatatttttggctgatgtaatggagcattttatttgttcgatgagatgttgctaacctccagtgtggaggtaaagcaactatggtgggtgcatggtatgtttttgctaacctctagtgttgaggtcatgcatatattgtgggtacgtgcacgtatgatgattatatgtgtaaagaatctcacaagggtcacaataatttgaaaaagctcaatgcaatagcaagcattatatgtgtaaaggcttttgcgatataatcatcatatggctttggcaggaatttgtcatcattgagaaacttataaattttcattcttttgaaaacttaaatcattcagaagtcaagtatcactccgaagtaagaccatagcaactctatttcaccatctcagatccacacaacaacctagacttagatcatgcatatgcagcccacaagtttcaagttcaaggtaaaattttttgtccaacaaactcagaaacttaggtgaagactaggttgtaaaactaagcattagagggaaataaaacagggcaactattcatcatttcaaccatgagcactagagcagtcttaccacgtatggaaagcaaatatttttggtattttttatattttacaaatttttatcttttttaagatgcaattcaaagaaataaaatatacaacttaccttgggcccttccccaagctagcttcttgctcatagtctatgataaggattgaatctctacgagtggaagtaggccatcaagtcagcgtgactttgcttcatggtggcgctgatgtttgccaataggccatcggtatgctactgccatgtgtaggtctcctggacatgctgatccagcgtgttctacatctcattagtccagagatcaagctctcctagcttttgggtgatgtccgcatatcctcggccgaaatcacgataacatggagccaagaaagagcggcgtgcaccaaatggaggggcatcccactggtgctggaggagtggtccacattggaaaaattgtcctagcgattactgggttgttccaattgtcacgcccataaatttagctaaatttccggactattttgtgtataaatcggtcaatatactgcattgtagttgtagcattctcacctatgaattttgtgaaattgggcacatctaatccttacgggtatggaaccgaatcttacatgtttacgatacggcctttcagatgtatgcgatgttgctttagactctcttttccaatgctcacatgaccgatctatggttcggtcttaggtgataatattatattattttcatttgtaatacaatccgaacttcgttctatatttttagttgcattattgtctaagctagtaacacaatccgaatcatcacttggtttagctatacttgttattgcattatcatctaagctaggacgtaaactattgtcatccactcggatttcctgagccagagcttcatgcaacatatgattaacatatgattaacgggcggcggtggtgctcgatcttcgtctctcgacgacggcgacaacgatccaatctggttagtccgattagtttgaatggagatgtggattgatccagttgaaaacctgtgaacataaatttattgttgtaaattgtgatgtaaattgtgttgatttgtggatttgtggatttgttaactgtgatggatttctggatttattaactgtaatggattcgttaaatgtgatggatttaaattgtggatttgtgaattttcggttgacagaggcggacggagcagcgtcgctccgtctttttttagcgcgggttaggattatcactggcggattatacaacatagccgcctttgcaaattcattttcgctagcggctaccttacgaacaccgccaatgaaagtggatccacgctggtagttggcaaatgccagcgaaagtactatattatcactggcctttggtctctagcggtgctgtaggctgcttgtgaaaacctattttggccgtcaggaaaaataattttttagtaatgcaagcagtctattatatgcaaggtgggccaaatctctttaagttatattttttttggaaaaaaaaacactgtaggggaatcccccatagtaaataaatttattaaaagatcaaaagaataaatttacaacaggtttaaccagtttgaaagaaaatttctatcttctacaggtaatcttaaagaaagctctccaagaagaagaaacagatggaatcacaccatcaaagataatttatgcccatttctctgcttccaaatgttccaagccacatagagaattttttcaacaaagtgcgaagacctataagtttgttttgcttgaagcaacatttgctcaaaagcaatagatacatcccagactattccaaattgagcccaactctgagagctgaaagaaaagatgcacgaaggtttctctagttccagaagaacatagaacacaagttaaatcactgttcagagatgcacaatgctttctatctagcatatcttgggcatttaatctgtcaatcagaagcaaccatctaaaaaccttaactttcatagttcacttacttttccggatccaattcagataaccaggagcttgaatattctttaagttatattcaaactagaacatcggtttcaaactagaacattggtttccagcatctctaaacctcttaaaataatcagtaacagattcatcatattcttccttaactgatgttaacttagataatataaagcttggtttcactagtataaaaataatcatgaaatttgcactctagttgagcccaagtgtagatagaatttgcaggcaatgaagtaaaccaagcaaaagcctaggtgtttatatgtgatcatattatccttgccgctaaattttacgaattcaagcaccttgaaatcacgaggatatgggaatatatataaaaaaataaagacaaggccttcgagtagccttatttttttggctcaattatgnnnnnnnnnnnnnnnnnnnnnnnnnnnnnnnnnnnnnnnnn

SEQ ID NO: 19064 - DNA, 676 bp, Oryza sativa
ttcgatgttccatgggttaggcaactctgtgccgtcgcccgtgcccagccgtatggagcccggccgggggacgccgatcactcgatacggaccctcccacattggtgagagcttgctcaatccagcacgcgtttgaacgcggcgtaagacgaggtcgtcgacgcagagtgattgggcccggacgtggcgctgatggtagcgccgcaggctctgctggtagcgtgcggctcggaggccgcacgccgctttcgttcttccaagtagtcgaggtcatctctgcgaagctgatcttgatcagcctcgcagtacatggtggcccgaggagacctcagggtgagctcggatgggagaaccgcttctgcgccgtagacgaggaagaaaggcgtttccccagttgctcggcttggtgtggttcggttcgcccagagcaccgctggcaactcctcgatccatgaatcgccgtgcttcttgagaatattgaaggtcttggttttgaggcctttgaggatttctgcattggcgcgctccacttgaccattgcttctggggtgggcaggtgaggcgaagcagagcttgatgcccatgtcttcgcagtagtcgccgaagagttcactagtgaattgtgtgccgttatccgtaatgatacggttaggcactccaaaccgggctgtgatgc

SEQ ID NO: 19065 - DNA, 708 bp, Oryza sativa
  unsure (1)..(708): unsure at all n locations
nnnnnnnnnnnnnnnnnnnnnnnnnnnnnnnnnnnnnnnnnnnnnnnnnnnnnnnnnnnnccacatctgaatcttagatgggctttattctcaaaaaagaatgaaaatacctataatggtccaatattatagtaattattctaaacaaagtcccccacagagtactgttcatcttaatattatgtcttaacaatttgtactaggctactagcagaagattgggcatggattctatgtgaactaaaagccattagtggatatttagatgtcactagtttattataacctagatgtttaaacttgtttaattacttttatcatatgcatgcataccttctgattgtttcacatgactaatcatttcaggctggaaatatcctaatagatacaaatggagctgtcaagctaggagactttggagtgtcagcctgcatgtttgatactgggaataggcaaagagcacgaaacacttttgtagggaccccttgctggtgaatattctgctgatactccctccattcacttttacaaaatatgaattaactttgtgtggtccttttaattgaactttgaccatgattggtccagtatgtagttattgatacaaagtcatgaccatttgagatcacattgaaatacaaatctagtggaacaacttttattttactaccctacagctacatatgttagccaaattggtgaccaaaa

SEQ ID NO: 19066 - DNA, 681 bp, Oryza sativa
  unsure (1)..(681): unsure at all n locations
nnnnnnnnnnnnnnnnnnnnnnnnnnnnnnnnnnnnnnnnnnnnnnnnnnnnnnntactaatcaaacctgaccaattcaacattgatgatgcaaacagagaccaggtttttttttcgagtgtgcattgagtaatggttttagcttcttctcttttgcaggcgcatttgtcgcagaatagcaagttcgacttccacaaatacatcaagaggtctttggaggacgacttcaaagttgtcgttggcatcaggtccgtcctcgctttattaattataggactcttatattcaacattttttttataaagaaacatatttagtctccagttgtgtatgtgtatgtggatcttgacacatttggctggttttgcagcctccctctgtggttcgtcggaatccttgtactcttcctcgatatccacggtaatccttgtcctatttcattctgttttttactctcaaaaccttgttctgaattggtcttataatcaccatcgattttttttcaactttttccccgcgtgtaggtcttggcacacttatttggatctcttttgttcctctcatcggaagagcgaaatttccctgttcaaagaaacagttaacataattaattatgctttaatttatcatgaaaattaatatgatcatttaactaatgaacaaacattcatgtgaatgcca

SEQ ID NO: 19067 - DNA, 755 bp, Oryza sativa
  unsure (1)..(755): unsure at all n locations
nnnnnnnnnnnnnnnnnnnnnnnnnnnnnnnnnnnnnnnnnnnnnnnnnnnnnnnttctcattttctcttatttcagtatttcaataaaagcagtttcaaattcctaagggctgtatctgtgccgttttttcctttttgaagaattttgacttgaaatgaggtcacttgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgcggatctccccaggcactagccccgacccgcgcctttcgaggactgggacttgggcacgggcccttaaatcaagctaagacgcaaaaagaggaccacggcacagatcatcctcatctcatccgcatagcaaaataaaattaacacaaagaattttttcatcatttttgattgcagattataagttgatttatacaaaaaacaggcctgaaggccttagaagaaaggaaaagaaagaaattgaagattggcgggggcctgggggctcaatccgatgcgcctgggtcgccggcctcgtcttccacgtcgtctgcaccgctggcatcgccctcctcgtcggagttgggggcgaacgcaagccgaggggccgagccctcgaagctgtggacgatgtggtccgcggcatcccggac

SEQ ID NO: 19068 - DNA, 626 bp, Oryza sativa
ttttcttcctccgccctccaagtttcttctccttgtcttgaatttttatggcctttccttgctccatctgaaccccaattccatcaccttcctcagtatcttctcttatctttgttaggcctacattggggtagagccatttcttggtctctttcgcttttactatgagttgcgctggatggaaccgaaaaaggtatccagatgtgtcggtttccgacttcgggatggcctgaagtcgcgatacatccccttccagtgcccctcttctcgtagcaaatggcgggcgaggtgattctatctccagatagagaactcggatccagtctttgttgttcctgaggagcaaccagacaagattccggagtggaccgccaaacctgccctaactccctcccttcagtctttcatcgacattatcgatgacctccgagtacgcgggttgttggggtatgaagtcgctgccgacttcatcggtaggcggatccaaccgctccaggcccgagcccatatggcctttgattattcggggccaaaggacgcgacccgggtttctcctcggggtatttttcttgtatttcagatttcattctttatgtgcatgttcctcctgacttatcgagtgctgg

SEQ ID NO: 19069 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnnnnnnnnnnnaccccctgaacccgaaaaccaaacattgcacaccctgaactttcaataccggacgaattaccctcctcaacctaacctagagcagttttgtcctacgtggcttacgcgtggcaatctagttagcatattctttaaaaaaagttggtgggacccacttgtcatatctcctccctacctcttcccaatctctatctctctatctcaaacgcgcggacgcatgtgcgcatggcagcagcgcagcgcggacgggtgggcggcgaacggcggtgcgcatgggcgggcggtggacggcggcggcggccgcgaggcgagggttgaggtaggcgttggcgcgaggagtggggatggcgacggggagagcgggctgggcgcgaccgtcagggtggaggccacggcagcgacgatggagagggacggcgagggggcggagggcacctcggctgcacctccgtcggatgcctgcacgatgcagcacaactgcgcatcatcctcggcatcacccttgccctcgtcctcggcgtcggcagcggcggcgctgggaggagctggtccagagtggcgtggaggcccaaactttgcggtggtggccgctgccgtgtggcttatgctaggatcgacccgcagttggttcgtcatcttcaacgggggggtgtgcgccgtccgcgtgctgttgtcgcgtg

SEQ ID NO: 19070 - DNA, 777 bp, Oryza sativa
  unsure (1)..(777): unsure at all n locations
nnnnnnnnnnnnnnnnnnnnnnnnnnnnnnnnnnnnnnnnnnnnnnnnnnnnnnnnnnnnnnnnnnnnaggaggagcttgagagcgagcgagtgcggcaagggtagggcataggaaacgaagagttagagcgcaagtggcgaaggcaaggggaagagtggcgagaggaaggaaacgaatcccttcctcggcgtctttatttccttgccaacgctatgcccggctcctcgcttcccgcgcccactacctcgccctctcgtttctcgcgcccacgcctccactaaccccattcgtccgtttgcggcgcacacggcagatgtgcggccgtggcggttgagatggggcagatcgtgcgcgcattaactacgctcgccaaccgagaaaaacgccatcatcacgtctccaggcgaaacgaaccggctcgccccgattcgcgcgctgctcgagtaatgtagcggtcttgaagaggccgctcattattgtcggtcggttttcccttgccgatgcgcgcgatttgcgaccgctgggtttctgcccgcctgtagagaccggccccacctgtcaccgggcctaaggagtggcgtcacgcccgagcgcttccctcgaggggggcgatcgccctggcataacgccgggggctactgtcggtgacatggggccgggggtatcgtgactagaggcttggatagccgcggtcacccacgtggcctgaccccctcgggggggggtcgggcccgagggtgacacggccacccctccctccgtctccccgaggggt

SEQ ID NO: 19071 - DNA, 4788 bp, Oryza sativa
  unsure (1)..(4788): unsure at all n locations
nnnnnnnnnnnnnnnnnnnnnnnnnnnnnnnnnnnnnnnnnnnnnnnnnnnnnnnatacatgaagcattagatgtagataaatgaaaaaactaattacatagttagggaggaaatcgcgagacgaatcttttgagtctaattagtccatgattagctataagtgctacagtaacccacatgtgctaatgacgggttaattaggctcaaaagattcgtctcgcggtttcaaggcgagttatgaaattagttttttcattcgtgtccgaaaaccctttccgacatccgatcaaacgtccgatgtgacacccaaaaatgttcatttcctcaactaaacacaccctgactaaaaagacgggggctattatcgataaatctctgcccttattaaattaacataatatttataagcatcaatatttaaacctggtggatagagtatatactcacaacttcgctaccacaccattaatgtaaattttcagtaatacagtattagccaagtattgaatgtgggaattttgagctttataggtcaggtggtggcatccagtctggatttttcacaatttaattcttttaaaaaacttatttcgcaaatagatctatgaaaaaatttatcccaaaaatatagtcctttttgggcgctagagaagctggcgccgtcctcctaccaccgtggcggggcgacgctaaggtggcagggggagcgcaccaatgtggccgacgccccccccccccccccccacctcccccaagtgtagagagatgtgcaactttatatatatatatatatatatatatatatatatatatatatatatatataagaaccaaccgtagaaaaattaaactcaaatggacaaaatatgtgacttgtagaattttccaaagctataccgaaaagcccccctgttggtatttcttaacgatattactagaaatataattcccagcaatggcgcagaaatactcctggtatattatggttacggagtttatccacaagtacacggatataccattgtagcatttaacccgagagtattccaagagtatcatatttgtttaatcccgtgggaagattataatagagagaaccgtactaataatttatatattacttgtaataaccatagtctaagtaggggttagtataatccaaagggtagggtgacacgcaagcatagaactactcattctcatattaaattatctaagctaagtggaaagaaaatagaaaagaatctatttctatacttctagtatacatactgtacatacattctagtcatatgattaacaaactaataccctctatccgatgccctcctgatacttcaagaagccacccctagctgccgagttccttacgacagctcgtcatgaccatacaaccggggctaaatacggaggagtaccctccccaggaaattaacttaggactatatacacgcgcagaggaatagacgtactgagctgtcaccatcagcggcctacctctcatccacagcacgcctaaactaccagatactactttaataacatcgtcatgacatagagtaattgcataagcaaatattatacctgtacctatgcatatcctagataagttagcagtataatcagtataacatgaacataaaataaagttggcattcatatactcaatatactcagaaagtatttcaataccagaattgtataaagaaaaatattctaaataaagtacaaatcttacaaaagagaaaaggagagctactagagccatacccgaactcttccgaagacttccggactccgatttctattctattcctactccactagcttgagactactaaactaaacttgagagaatatgagatagctgttgcttgaagtgtgtgaagaaatgaagagagtgagctccttaaataggcaggtaatgatggttatggcggttagaaaggtcggtaataccttccaaccgcctgtcacgcccagaaatttaggccaaatttccagactatttttgtgtataaaatccctatccaggactagctaaggtacacaaaatgacaagtaataaacagttccaaacgtaaataaagcgtaaaaatacttacagaagaggcacttagtcctcacaccgaaagagaacgacagcagcagaaaaaggcgatcctagcggggcttcagctccactccacaggcaaaactcaactggggtctgagccttggtcttctaacttcgtcttcagctcagaagcactacacttctaaaaagggggaaataatagcaaggctgagtacaaccaccgtactcagcaagccacaccaacgatgcaggcgtgcaaggggatataaggatggcttgtggctatttgcataaaggcgattgtaaaacattttattgagcaaaacggtaaaactgttgagtaattaaagtaatattaaatctccactgatcaacgctacaccacgttgaacaggcccaaccaacccacctgaactacagtgcattgggtcgatttattaagtatgagactaatcacggtgattctggtcgatcgcccataaccgcgggcacggctattcgaatagttttactctggccagaggtgcacaactatacccacaagacacaatccaccagcatgtcaccgtgcccggccagacacgtcaccatgtcgagtgattgtgacaagacccttcatataacccgctctgaccaagcacaccacaccttaagtttcatccccgcccctagcaggcagcgggcagtcccctctcgtgcctaggtgaatccggaagcaacagaggtcgtcgcagggaccgccccgctccatcacgcccacccttgcctggatgcgtcagccagagaaaagctatacttcaagtcaggcagttacctattcccgcttgtggcaagcgctgtatgtcttccagtgcatcccgcgaactggtccttaattgccatgggtgcgaccagcaaaaccatgcacccacagcccaccattcagtcacgttttagttggatacttacgaccaatgaaacatggtcgggtgtctcgagcacgcagctcgtcatgatactaacaggtctaatactgcaattatcccatcaactgagctagtggtaattaagcatggctaagcatatggttctagctgtgtcacataagtaacatgagctagtcgatttatcacccaaggttgacaaagagcagatatcagtaaacatggcgcaagcaagcagataggtaaactctgatcccatgtaattagcaaaacatgcatatttatttgcaaatggtaaaatatttgcaaattggaatcaacatgctcaaggggaatgtgtgacttgccttgcttcttcacttggatcttctgaactcttttcctcgcgactgcgaacttccgaaacgacgtattctacacgctggcacgcaaaacgagaaaaaactcaaataaaaaccaaggaaacaatacataaaaagtaaacaaacatgtagagctcaattttagatgaattttgcaagttgaacggctcaatttggagttcgaatgaattagatatgaattttagcagttttgagccatttaaatgaatttctagaattaaatacgatttatgacgcaattattaattatttttccaaaggaaaaagggttgctgacgtcatcaagggggaagggcggtgccggcaagcgggccccaccggtcagcggcacaagggcgtcggtccatcgtggaccgggaccaccgaggcggtccaccgccggtccacgggaaccgacggcccagattggcccgagccgatcggatggccacgggcggtgctgctggggcatggcatggctcaaagccggccgatcgagtgatggcgatgggtggcgcgcggtggagcagccagcggcggcgcacggcacgggggaggccagcgaagggggaaggaggaaaaagggagggggagtgctcaccgagcgacacggcggaagcatgcggccggcggcgaggaacggcgacggcggggctccccgggaggacagcgtgatggagctctggcgacgggtgtcgcttgggaaaggggtggacaggcttggcctcgatttgaggaagatgaaggaggggttaggaaagtgaggatggttgcgaggtgaccggaaacgacggccgaccgtgacaatatgaggaagacctcaccggcgaccgagggaggtggagctccggcggatttccggcgaagagaagcagcggccgaggacctcctcgtccttgcggagccgagggagacgacgacgtagcgcgggacggacgagagcggcggcgattggcggccgaaggcggcaatggcgacggtggctcgggttcaccgtggagagggcagctcgggggtggaatgggggagcggcgtggtggccaggcttgctcgcggggcggcgaagccgactgtggtggtggcagggcgcgggagcggctcaggcggcgacagcgtgcggctggaggtggtgaaagaggcggcggcctcgggtgtgcggtgggagttgtgctccggtgatgaaatggggaaacggagcgggggctgaggtgcggcaccgtgcggcggagcctacggcggtggctacgcggcgcagcgaccactagggcggcagtggcgggcggccgaaggttgccggcgagcggcggcgatggggtgcggcggtgtcgcggtggtttccgggcacgggagggctcgggagagaggggaaannnnnnnnnnnnnnnnnnnnnnnnnnnnnnnnnnnnnnnnnnnnnnnnnnnnnnn

SEQ ID NO: 19072 - DNA, 1009 bp, Oryza sativa
  unsure (1)..(1009): unsure at all n locations
gtgggcgcgaggtggacgggactcgagtccacgccggttaggacgagggaaggcgcgggatcgccgaagggagtgggcagtatggtcgccggttggagccggcctgaggttggggatgacaggtgggcccatgggtcccacctgtcgggaagagagggagggggaaacgggctagggaggtaatgttgacttgagggagagagagagagagagccgagcggggccgagcggcccaagaggagaggggaggaggccggccaggcccgagcggaagggaggaaggagagggttgggccgaaagcggcccaaagaggaaggggagattttattttgcttttctttttattttaattggttaaatgatctctgtgactttcaaattatttcttgagctccgaaaattcacggaaaaatccggagagtatttgaaggcacaaagaatattaaaaattattcccggccaatgatatttaaaaggaaatttttaattccctcaataattcacttgatgaaattgatttaacttttattaaatttctagaaaatacattatttaatgatttttaatcccgaccgaaaatcggggcgttacaatagggaggcaatgcacaccgtccagaagaagtccggcatccaacggcaccgaagaggattcggccgaaccatgggctgggcctccctggcccattttcggcaggtggcctcctcttttgctctactctgcagacttgtgaattttggcccaattcgacgtgtcatttctaagttcttggcccattcatacataagtctgattctcgatatcgtccgattgattgatcatttggtttgatgtcgattctcctccactttatggttattctctgcaaaaggttagtaatcctaatactagtggaatattattattctaacttaaatatgcattgcaagtataactagttctcctctattttgnnnnnnnnnnnnnnnnnnnnnnnnnnnnnnnnnnnnnnnnnnnnnnnnnnnnnnn

SEQ ID NO: 19073 - DNA, 622 bp, Oryza sativa
  unsure (1)..(622): unsure at all n locations
nnnnnnnnnnnnnnnnnnnnnnnnnnnnnnnnnnnnnnnnnnnnnnnnnnnnnnnnnnnnnnnnnnnnnnnntcggccaatagaatccttgacgaaaagccttgccaaccaaggtgcgcgaggcggaatgggctccgcactcgccttcatggatatcggcaagaagctcaacgccttgttcctgaggaatgcacttcaggaggattccgttagccgcgcgccgatagagggtcccttctaccagcacgtagcgtttggaaatgcgttggacgcgttcactcccttcgcggtcctcaggtagagtcttatctgtgaggtatgcttggatctcggagatgcaagcaatcaatctaagggagcttggagcgctcccttcgggtcccgaggcctggactccgacgggcctcgggggccggtcaggcacacccgtctcccctaaggggtcaggtcgcgccgacggctgggtaagcctttcttcaaaggcgcccggtggggtctgggctcgcgaagacgcgagccgtgagagttcgtcggcaatcatgttatcccgtctgggcacatgccgaagctctatcccgtcaaaatggcgttccatacgccgcacttggcgtacgtaagcgtc

SEQ ID NO: 19074 - DNA, 873 bp, Oryza sativa
  unsure (1)..(873): unsure at all n locations
nnnnnnnnnnnnnnnnnnnnnnnnnnnnnnnnnnnnnnnnnnnnnnnnnnnnnnnnnnnnnnnnnctctcgtatttttccgtgtgcgtcaagtttttcttgatcagcctcatggctgagcaagcaaaggcgcccgacctctctcccagtgtgagtggcgacgacggggagccgaacccacgccgtcgagctcgtactccaccgccccctccacgccaaagtcctaagcagggggaggtgctcgaaagggtcgaaagatccgcggcttcaccgatcgcgggcgatggaggagaacggcgagatggggaccgtcgcctcctcgtctacggcgacggcagcacgccccagggcgcgctccaagctgcgggcgcgctcttacgccatccgcctgtcgtccctgacccggagtctccagcccaacgatggctggacgatgtggccaaattggtcatgacggcgcggcagcgcctagatgctggtgggcggtcctccgccaccaaggcctctggtgctgctaccaccggctccgcgtcgtcaagacagagggcacgacgagcggcagccgctgttcgccgttcggctgccactccttcgtcgactccttcgacccgggaagatctgcgtggggagcaggacgcccgcgccagcatcaagcgccggcgcaatgaccgaagtgctgcccacgcaacggagggcgcttcctcgtccagagtgtcacctcgacatggacgtgggaatcagccctccgtgcccccggttggtggtgtcggctgtagagcctttgtggcgagtcttcggaatgtccgttggcccccaaggttccggcccaccatcgccgaaaaatatgatggcagcgtcaaccccgccgagtttc

SEQ ID NO: 19075 - DNA, 1092 bp, Oryza sativa
  unsure (1)..(1092): unsure at all n locations
nnnnnnnnnnnnnnnnnnnnnnnnnnnnnnnnnnnnnnnnnnnnnnnnnnnnnnnctcaaaaccagaccttcaatatcctcaagaagcacggtgactcgtggattgaggagctgccagcggtgctctgggcgaaccgaaccacgccaagccgagcaaccggggagacgcctttcttcctcgtctacggcgcggaggcggtcctcccatctgagctcaccctgaggtcccatcgggccaccatgtgttgcgaggctgatcaagatcagcttcgcagagacgacctcgactacttggaagagcgaaggcggcgcgcggccctccgagccgcgcgctaccagcagagcctgcggcgctaccatcagcgccacatccgggcccgatcactctgcgtcgacgacctcgtcctacgccgcgtccaaacgcgtgctgaactgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctagtaggggtcgggtgtcaggtctcgggctcgggccaaccccgcacccccccgggcatgcagggttggccgggggctaccacatgcatatacttatcttttttctcttccgtatttcaataaaagcattttcgatttcctaaggactgtgtctgtgccattgtttccttttaaagaatcttggcttgaattagcacgctcgtgctcgatcctgccctcggtggcccaggccggctaaaatcgccaaaaggggcccagaaccgagccatgccccggggcgtggtgaactccgggggggaatcggcaaaggcccacaatcgggtcatccataaccctcggtcaccacgctcccggcctggccagtctcgacacgtggatctccccaggcactagccccgacccgcgccgtttgaggctgggacctgggcacgagcccttgttcaagccaagacacagaaggaccgcggcacagaccatcctcgtctcatacacacaacaaatagaattgacacagaaattt

SEQ ID NO: 19076 - DNA, 958 bp, Oryza sativa
cggttcgtttcgcctgaagacgtgatgatggcgtttttctcggttgccgagcgtagttaatgcgcgcacgatctgccccatctcaaccgccacggccgcacatctgccgtgtgcgccgcaaacggacgaatggggttagtgaaggcgtgggcgcgagaaacgagagggcgaggtagtgggcgcggaaagcgaggagccgggcatagcgttggcaaggaaataaagacgccgaggaagggattcgtttccttcctctcgccactcttccccttgccttcgccacttgcgctctaactcttcgtttcctatgccctacccttgccgcactcgctcgctctcaagctcctcctccaccggcgtcatggcacggggctccgcaccgctcgatggtagcgtgctgccgccttcccgcatcgtgagcgagaggtaggccgggctgccgcgccgattcatgccggaatctgccaccggccggaaggtggtcgcgctgggcgagggacgcccgacgccagactacccggggcggtccgtcttcttcctctctttcgcaatggcggggctggtcccgccattctctaattttttcatggatattctggagttttatgatctccagatggcgcacctcacccccaacgcgataatgacgttggccatcttcgcgcacctgtgcgagatgtttatcggggtgcgcccatctctccggctgttccggtggttctccactgtacagccggtgtcgccgccgacggtagttggtggctgctactttcagccgcgggggcaggtgctgaaccgctacattccctgcgtcctccgcaagaagtgggacgactggaagagcgattggttctacacccccctcgccgacgaagcgcgccttcgacttccgagccagcctccggcgcatgcctccagctggcgggcggcggtagatctgggagacggctacgacgcc

SEQ ID NO: 19077 - DNA, 770 bp, Oryza sativa
cgaatcttttgagcctaattaacccgtcattagcacatgtgggttactgtagcacttatagctaatcatggactaattagactcaaaagattcgtctcgcgatttcctccctaactatgtaattagttttttcatttatctacatctaatgcttcatgtatgtgtccaaagattcgatgtgatgtgatggagcgtggggctcctcaccgggagaccgcgcaggcccccctttgccggttcagccgggggcgctaagtgaggttcttcaccctcgatctgtggaatgttcgcgagagagcaaatgcacaagacacgggcgatgtagacaggttcgggccgctgagaagcgtaataccctactcctgtgttctggtggatctgtgtgtgaagaagttacagagagccggagagcaagagagttcaggctctagaacccctcttcccctttctctcctctacgagctcaggtattcccagagtcgtctgagagtccccctctctcagagttcccgtgggcaaggtcctccttttatatctcaaggggataccacatgcaccacttctacctactcttcttttgggtggggacccaccctatcttgaccaaaacttggctcgcgccttcggctggaagctaaatcacagcttgtccttgagtgaagcccagcgccgtgaactcgccttcacttcgccggaagcagatgcaacgtgggagcacggctgtctgccgatgacgtgaccggtgtcagaccagtcacaaaccggtcatt

SEQ ID NO: 19078 - DNA, 3516 bp, Oryza sativa
  unsure (1)..(3516): unsure at all n locations
nnnnnnnnnnnnnnnnnnnnnnnnnnnnnnnnnnnnnnnntttcctatgccctacccttgccgcactcgctcgctctcaagctcctcctccaccggcgtcatggcacggggctccgcaccgctcgatggtagcgtgctgccgccttcccgcatcgtgagcgagaggtaggccgggctgccgcgccgattcatgccggaatctgccaccggccggaaggtggtcgcgctgggcgagggacgcccgacgccagactacccggggcggtccgtcttcttcctctctttcgcaatggcggggctggtcccgccattctctaattttttcatggatattctggagttttatgatctccagatggcgcacctcacccccaacgcgataatgacgttggccatcttcgcgcacctgtgcgagatgtttatcggggtgcgcccatctctccggctgttccggtggttctccactgtacagccggtgtcgccgccgacggtagttggtggctgctacttccagccgcgggggcaggtgctgaaccgctacattccctgcgtcctccgcaagaagtgggacgactggaagagcgattggttctacacccccctcgccgacgaagcgcgcctccgacttccgagccagcctccggcgcatgcctccagctggcgggcggcggtagatctgggagacggctacgacgccgttcttgaccgcctggcgggtctgcgatcccaggggctcacgggggccatggtgttcggcgactaccttcgtcgccggatcgcgccgctccagcggcgcgcccggggcgcctgggagtacaccgggcccgaggactccatgaggcccaccaggggcgcacatgggactggtaccctgaggatttcaggatggtggtccaacgggtgctgaatctcagctccgtggaggcatccctcatcccccaaggggtcctccccctctgctgcgatccagagcgcgctaacatcctgaccatcatgcaggaggtcggggcgtcgggggagcgggccccccgaggccacgatggcgcggccgggagccgcaggggggaacaatcgggcccggggggcagccgccctgccgacgcccgggggaagaggaaacaggagggtacccctcccccatctcctccccgagggggcggggcggtgcgtgccagcagcaggcgcccggagggtgccgtgccgacgccgcagcccgagggagagcgaaagaagaaacggctccgcaagatgggggggaccgagtcatgccgggggaacctcatctcgcccccgaggtggtcgtttagccgacctccccgtaggttcgtccccgcgcccaccgcggccgtattcattctcccatctcccaaggcgagttttcactcacccgtttctttttgtcttctgatttttcttctgcctcagcgagatcccgtcgcgccccccccgccattccaagtccggccggtctgaggccgaggagacggtgaccgcggaggcccggaggcgggaagctgaccggcgagaagccacggaccgcctccgggaagccgaggaggctgcccaggaggccgtccgggtttgccaggctgaggaggccgctcgggaggaggccagactccgccgggccggggagtccgtccgggaggcagaggcggcgcgcacgccaggcggcctgtcaagcccccgacccgactccgcccgaggtgacgacgacttccgaggccacccacgacgaggccgcgggcgcgccgctcgggcccgacccctcgggcgacgcttgggacgagccagctccgggggacgcccccgagtccggcacgtcgatcagcgggccgagccgcgcggcacccacaccgaggcggctctcccctctgccttccgctgccccaccgagcgcggagcccctcctgcaggccttggccgccacgaacaccacggtgttggacgggttaagtgcccagatggaggtcctacaggcagagcgggcggaactcgacgcggcgtgggcgcgcgtcgaaaaggggcggcgctcggtggagggggatggtggaggcgggccgcaaggcacaccgccggcacgcctcagagctcgaggcccgtcgtagggacctggcggagatcgccagggaggtggaggaggagcgggagactgtcctcatcgccaccgccgtgctcaacgaggcgcgggacgacctccgcctccaatacgggagccgggcggtggagctagagaagaagctcgacgccgcccggggagtacttgacgccgccgctgcccgggaacagcgggcggcggagaacaaggcggcgtccaggcagcgcaaagaggcccttgaggctcgcgccacggcgctggaggagagcgcccgcgccctggacgcgagggagagagggctagcggaccgcgaggccgtcgtcgccacccgggaggcaacactggcgtcgcacgaggtcgcctgcgccgaaaaggagtccgcactccgcttccgcgaggacgtgctcaccgagcggtggcgagctctcaaggaggccgaggccgcggcgcagcggctggcggatagcctgtccctccgcgaggcagcgcgggaggagcaagcgcgccgcgatctggaaggcgcccgcgccgagggggccgtactggatcagcgggccgctgagctcgaggcgcgggcgaaggagctggatgcgagagcgcacagcggcggggcggccgcgggccatggcgacccagccgcccgcctcgcagctgccgaacacaccatcgccaagctgcagggcgcgctggactcgtccgccggggaggtcgaggccctccgcttggcgagcgaggtagggcccggcatgcttcgggacgccgtctcccatctagaccgcgtcgggcggcaggcgggcctctagggcgggcggtgcgcgaagtacgccgccaaccaggggggtctcgcccagcgcctctcagagatggccggggccctccggcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggatggcgcacgcgcgcaggtccgggacgccgccgaccacatcgtccacagcttcgaaggtacggcccctcggctcgcgttcgccctcgactccgacgaggagggcggtgacggtggtgcggacgacagcgacgacgaggctggtgacccgggcgcgtcggagtgagcccccaggcccccgccaatcttaaatagctttttctttcttcttccgaggccttcgggcccccttcttgtatagactaatttaatctgcaatcaaataaagaggaaatttctgtgtcaattctatttgttgtgtgtatgagacgaggatggtggggatcctggagagtctgtgtgttggcttgaannnnnnnnnnnnnnnnnnnnnnnnnnnnnnnnnnnn

SEQ ID NO: 19079 - DNA, 3219 bp, Oryza sativa
  unsure (1)..(3219): unsure at all n locations
agagaaaaaagataagtatatgcatgtggtagccccgggccaaccctgcatgcccggggggtgcggggtggcccaagcccaaacctgacacccgacccctactaggggtagaagcgacgaaggtgttcgatgtcccccgggttagcaagctctgtgccgtcgcccgtggccagccgaacgaagcccggccggggnacgccgatcactcgatacggaccctcccacattggtgagagcttgctcagttcagcacgcgtttgnacgcggcgtaggacgaggtcgtcgacgcagagtgatcgggcccggatgtggcgctgatggtagcgccgcaggctctgctggtagcgcgcggctcggaggccgcgcgccgccttcgctcttccaagtagtcgaggtcgtctctgcgaagctgatcttgatcagcctcgcaacacatggtggcccgatgggacctcagggtgagctcagatgggaggaccgcctccgcgccgtagacgaggaagaaaggcgtctccccggttgctcggcttggcgtggttcggttcgcccagagcaccgctggcagctcctcaatccacgagtcaccgtgcttcttgaggatattgaaggtcttggttttgaggcccttgaggatttccgcgttggcgcgctccacttggtcattgcttctgaggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctaaacggacccaggatatcgagcccccagacagcaaatggccacgaaagaggtatggtctgcagggcctgggccggctgatgggtttgcctggcgtggaactggcacgccctgcaccaccggaccaggtcgaccgcatcgttgagagccgtcggccaatagaaaccctggcgaaaggccttgccaaccaaggtgcgtgaggcggagtgggctccgcactcgccttcatggatatcggcgagaagctcgacgccttgttcccgaggaatgcacttcaggaggactccgttagccgcgcgccgatagagggtcccttccactagcacgtagcgcttggagatgcgctggacgcgttcactctcttcgcggtcctcgggtagagtcttatctgcgaggtacgcctggatctcagcgatccaagcaatcaatctaagggagctgggagcgctcccctcgggtcccgaggcctggactccgacgggcctcgggggccgttcaggcgcgtccgtctcccctagggggtcgggtcacgccgacggctgggcaagcctttcttcaaaggcgcccggtggggtctgggctcgcgaggaagcgagccttgagagttcgtcggtgaccgcgttatcccgtctgggcacgtgccgaagctctatcccatcgaaatggcgctccatacgccgcacctggcgcacgtaagcgtccatctgcgggtcagagcaccggtactccttacagatctggttaacgaccagctgggagtcgcctaacaccaggaggcggcggatccccagtccagctgccaccctgagtcccgcaaggagtccctcgtactccgccatattgttggtcgcccgaaagtcgaggcggaccaggtatctgaggacgtctccgctcggtgaggtcaacgtgacccccgcaccggcgccctgaagagacaaggagccgtcgaactgcatcacccagtaggcggtgtgaggcagctgcgaggggcccgaggtggcctcggggacggagacgggctcgggagctggggtccactccgccacaaagtcggcgagggcctggctcttgatcgcgtggcgtggttcaaagcgcagatcgaattcagagagttcgattgcccatttcaccacccgtccagtaccctctcggttatgcaagatttggccgagggggtaagacgtaaccaccgtgacccgatgcgcctggaaatagtggcgcaacttcctcgaagccatcagaatagcgtaaagcatcttttgggcctaagggtatcgggtcttggcgtcccggagggcctcgctaacgaagtagacgagccgctgcacctttcggcggggccgatcctcttcgctaggggccgtatctccagggcgctcttcgtccgagagggcacgcgggtagcactcggcttctgtgccgacgacctcggggtcaaagggcgacaggcgcggccctcgcgcagtggccccgaggccgtcctgggggtcgggggcgcctggcaccgtcggacaagcaggcggagggccagctccggccgtcgggggccttaggccaccgttcggctcgggggcctctcctccctgctctttctcgggtcgagtcgacacagggtggggatgcgtggagtgagggttgtcctcgtcgcgctccacgaccaacgccgcgctgaccacctgcggggttgccgccaggtagagtagcaacggctcatctggctccggggcgaccaggacagggggagaactgaggtacgccttcaactgagtgaggacccgctcagcctcctccgtccaggtaaacggcccggagcgtttgaggagcttaaataggggtagcgccttctctcccagcctcgatatgaaccgacttagggcggccatgcagccggtgacgcattgcacatccctaagcttgttgggggggcgcatccgctctatagctcgtatcttctcggggttggcctcgatgcctcgggcagagaccaagaacccgagaagcttgcccgcaggcacgccgaacacgcacttgtcggggttcagctttatgcgggcggagcggagactttcgaaagtttccgctagatccgagagtaaggtctcttggttgcgcgttttcacaaccaagtcatcaacataggcctcaacattacgtcctatttggctacccaaagaaattcgagtagtacgttgaaaagtaggacctgcattctttaacccgaaaggcattgtcgtataacaataagttcctatggcggtaatgaatgcggttttttcctcatcctccctagccatgcgaatct

SEQ ID NO: 19080 - DNA, 1427 bp, Oryza sativa
  unsure (1)..(1427): unsure at all n locations
ccctgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctcacgaatgaatccggcctccagaagtcgcgccacctcctcgcagatgaaggcttgacgtttcggggcctgccgccgcactttctgccggaccggccttgcgcccggccgcacggcgagacggtgctcaatcacctccctgaggaccccgggcatgtccgccggtctccagtcgaagacgtcggcgtttgcccgcaggaaggagacgagcgcgtcttcctatttgtcgtccagaagaccaccgattcgtgtggtcttggacgggccgtcgcccagggcaacctccttgaccgggacctcgtcgcacgtgatcatccgctgcttcggggcggctgggacggaggtgctgagcctctcgtcgccacccgcgggcttggacgccgcggcgaggtggtccgcgcgctgctccatacaagcaagcgtgactttgaggtcgccatggacggtgatggggccaccggggcccggcatcttcatctggagataggcgtagtggaccgccgccatgaacttcaccaacgcgggcctccccaggaccgcgttgtagggcagactgaggtccgccacatcaaagttcacccgctccatgcggaagttggcagaaccaccgaaggtgaccggaaggtcgatatgacctagcggccaagtgtgccccggcgtcacaccgatgatcggctgggacggccggagcaccatccccggggccttgatagcgtcaaaggctgcgggggaaaggatgttgagggctgcacccccgtctataaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgtggccagaagctctcgcttcatggccttgaggctccggcgagaagcgtgagcgcacgctcccccatcgacggtggcgacggtggcctcaggctcctggaaccccaggtcatcgtcgccatcgtcgacgtcctcggcggtggccttctgcttggcctcacctcgacggttgcctgtgggagccgccggggccttgccctcacagcgctcctgcctcctctcctcctcccacttcctcgtccgctcagccaaacttttgaccgcgcggcagtccgcgaggtcgtggagggaggtnnnnnnnnnnnnnnnnnnnnnnnnnnnnnnnnnnnnnnnnnnnnnnnnnnnnnnnnnnnnnn

SEQ ID NO: 19081 - DNA, 791 bp, Oryza sativa
  unsure (1)..(791): unsure at all n locations
nnnnnnnnnnnnnnnnnnnnnnnnnnnnnnnnnnnnnnnnnnnnnnnnnnnnnnnnnnnnnnntgattatcttaccaggcagatgtgcgcgtggatctttcatttggcggaataaaggcccactgcggttcctgttgcatgtatttttctgatgacactcattcctaaatcagaaaagaagcaaaaaaaaaatagcatgtgttacaccgactagaatattagacaatatgggatatgttagtacgatatgataagaagcaaaatgagagtgaaatattaagactacagtaggaggccacgaaaaagaaccaaaggttttttttacaagtgttacttttgtcaaatatgtacatgtaaatccatgcttcattctttcttttttttttttggttctatcatgttttctaagtccaatctaaattcccatagtagtttttttagcctattcagcatatcataaacatgattttacagggcaaagagtactttgcctatacaaattgaattgagattgtcgcatagctatctaaaatgcacaatacaatataaatcttctcacaataatgaccaatttcaatagtttgacttcactagcataaaaaaaaatgcatgctaagatcccacatttttcatgcaggtatttaaaatttgaagtgaacactacagttctcatatgggcgaagaaaattcatgtgtatagaactgatccttttcgtttccggctaacaggaataccatccccaatctcgacaagacctatttggccatgtgtagcatgatgaaaggatcgc

SEQ ID NO: 19082 - DNA, 838 bp, Oryza sativa
  unsure (1)..(838): unsure at all n locations
nnnnnnnnnnnnnnnnnnnnnnnnnnnnnnnnnnnnnnnnnnnnnnnnnnnnnnnaaggttttgagagtaaaaaacagaatgaaatatgacaaggattaccgtggatatcgaggaagagtacaaggattccgacgaaccacagagggaggctgcaaaaccagccaaatgtgtcaagatccacatacacatacacaactggagactaaatatgtttctttataaaaaaaatgttgaatataagagtcctataattaataaagcgaggacggacctgatgccaacgacaactttgaagtcgtcctccaaagacctcttgatgtatttgtggaagtcgaacttgctattctgcgacaaatgcgcctgcaaaagagaagaagctaaaaccattactcaatgcacactcgaaaaaaaaacctggtctctgtttgcatcatcaatgttgaattggtcaggtttgattagtatatacattgatgaagccttgccgcatggtcaggtagtccaccttggtgacggacccaaagaactgcctgaagaatgctacctaacaacaaacacggcatgaatattttttttttcaaaaaatatggattgaattggaacagctaggccagttgcaagaataaaaaacaagcatgtattcggagattgataactcacgatccatctgagcccaggggtgcttgagaatgatcccagatgccgcttcacgaacgacgtctgatgcgtgaacctgaatcgtgaaggatctgcatggatcgatcatatttttcagctgatttgctcctcctctttcaagacattatcataaaggttctgaaatgaaatagttgggga

SEQ ID NO: 19083 - DNA, 606 bp, Oryza sativa
  unsure (1)..(606): unsure at all n locations
nnnnnnnnnnnnnnnnnnnnnnnnnnnnnnnnnnnnnnnnnnnnnnnnnnnnnnnnnnnnnnnnnttcgcctggaagctaaatcacagcttgtccttgagtgaggcccagcgccgtcactcgcctccactccgccggaagcagatgcaacgtgagagcacggttgtctgccgatgacgtgaccggtgtcagaccagtcacaaaccggtcattcttgtccaccacgcgtcagtttagcataccacacgtctgcccttcttcatacaatgacttccttgccatggttgcgatgaagcctggaatggatctgaccgggactgacgtgccaactccaggagttaccacgccggctccggctagggacgagagccaggaagctctcatcattccgacgggacggggcgaggcgtgtgacaggccgcctgttgccacctaacccgcgatctgaccggtcggtgaccggtcacacaccgtgactggtcacggaccggataagcgtgcgctgcgccgcattaaatgcggcgtggcgcgctcgtccaacctgctataaatgcgggtaggtgagccccgctgtgctcacctaacccacacacgtggcgcccaaacc

SEQ ID NO: 19084 - DNA, 679 bp, Oryza sativa
  unsure (1)..(679): unsure at all n locations
tatagggcgaattcgagctcggtacccgtcatagattggctggatctacggttcagtcacagaggatatcctgactgggtttaagatgcactgccgtggctggcgatccatctactgcatgccgataagacccgcgttcaagggatcagcgccaatcaacctttctgatcgtctccaccaggttctccggtgggctctcggttccgttgagatcttcctcagccggcactgcccactctggtacggctacggtggtggtcgtctgaaatggctccagagattgtcctacatcaacaccatcgtctacccgttcacctctcttcctcttattgcatactgttgcctgcccgccatttgcctgctcacaggcaaattcatcattcccacggtaagatgcctgtctctatacatgtttttggtttgagttctgatgttgaacattgcttagtgacattattcatttgtcgttcttaatttcagctctccaacgctgcaaccatatggtttcttggcctcttcatctccatcatcgtgacgagcgtcctggagctgcggtggagtggcatcggcatcgaggactggtggcgcaacgagcagttctgggtcatcggtggcgtctnnnnnnnnnnnnnnnnnnnnnnnnnnnnnnnnnnnnnnnnnnnnnnnnnnnnnnnnnnnn

SEQ ID NO: 19085 - DNA, 1817 bp, Oryza sativa
accctctctcgcgggcgccgggcctgggccggtttgtaccgtagcgcggctgatatttttctggccccgtttttctccggctgcaacgaggaataattgtgcgaatgcttttataaaagggaggaaatatcaggggtctgttgcttgctagcttcggttacctgagcttgtttttgtggtcgaagagaaataaggaaggctggaatacttgcctgcctgcttgccaaaactgaaagtgacatgcatgcacgatattgtctgctcctgttttttatttctttgacgttgcctggctggcgtcctgtttgctattatgaaatgatgaagaagtcatcttatccggctcctcgttgttccggtggcgctatgattgacttttgtgtttgtgtgacgagaataatataggcatgttcaagctcgtcgaagcaattccttccttttcgcgtatgaatgtgtgcatgattgatgtaagtggtagagcacaaatcggatgtgtattgcgcttgagaacgaaagagaagaaatattgtgcagctcccgacatgcttccttttacctgttcagggtccatttggtctcccattatataactctggatgatgcggatcagcggatcacgcatcttttgtgacggtaaccatgcagtatacaatacaatataattggccaatccattcatttcattaagttgagatcataacatctcactatctatatgatggaagctacaagcggaagcagcaaccaagcaactgtgaaagtttctgggccatttgttcgttatcatttgccaagcaggccatgcgtgttttctgtttggaataagttcgccggaggtccctcaacttaacagcgagattgtttgaagtctcttaaccacaaaactagaaatgtgtagctctaaactcacataaaccgtgcactcgaggtcaaggtcctatggcagtatatatgggtgctttcgctgacgtggcatcctagtcagccaaaaaaaataaaaataatatgtggatcccacatgtaagttaagtgagaaggaaaaatgtgggggccacatctcttcttactcttttctttctactcttctcttcaacggtggttgtcggcggcagacgggagtgaggcggctggcgagccgagccgagctccactgtcactgccacaccgacgcacacacgccactgcggccgcctctctccccctctatcgccgcccgctgccgcgctcgcccgctgccaccccgcccaacgtccaccgttgggtcggccacaacgttgttcatcctcagttgtgagggcggcggtgggcagagcagctggcgaggggagaggcggccggccacgctggcgagagaggagggccgagagagcggcggagtggagcggccgacagtggagggccgaggccagcgcgagctcgcgccgggaggagtctgagatggagacgacggaggtgggttggctgctaggcaacggggtcagtggagggctgtgccgacggtggggtggttgatgaggtggtggtgaaggtccctaggtggtccaggcaaggcagatctagggtggcatgtgggggcggcgtcgacgacgaagccaaagtaggccgagggtcggctgtggggcgccgttggtctcaacggggtgctcgcggcaataaagctccgtcgctgccgcccatagatgaagatccatctgctctcgctgcctcgccctttctagccgccaccacctccttcctacttattccctccgcctcttgtcgccggtgatgtcttcgcgccgaccgcctctcccgccggcatcctctcgtcgtcgtca

SEQ ID NO: 19086 - DNA, 465 bp, Oryza sativa
tagggcgaattcgagctcggtacccaactaagggagagtattagttcatgctaaaaatatggtatatcatcgtcaattacacacacacacccacctggagaggcatagtatccatgcttcctgagcagatagaaccggagagctgtagtgtggaggtcatagtgattgtcggtatcgtcttcttcctcatgaacccggcgcaacacattttcaatctccttctcgtagtggtagtcaatgcaaagacgttctaaggtgtcgacgagctcaagttttacgtgcaaattggggccagaagaacactcaagtatcatccttctcacttgttcctcggaaacatgagcttttctcttgatattcagaagctacatatacatatacatgcgaggacgattatgctacgaagtaattaattatttgttaggcatatttatatgtactatacgtactatatatctctaaatg

SEQ ID NO: 19087 - DNA, 642 bp, Oryza sativa
  unsure (1)..(642): unsure at all n locations
catatcattcatgccatggctagctacctcttgataatagtagaattgtcacgccccgaactagtcccgaccggaactagcccgtgacgctccaatttaacctgttaatcgataccagtcccaggaaatagtgctggtatgacagggagacagaatatcacagcaacagaggtctctttatttagagtagaggtacagtcatgttgggctgcggacagatcccgagctcacaactgcattacagaagggaaacggaagccaggacttggaccaaacaacacaggcgcgacttgggaactaggccgaaaccctaaaactcatcatagccggcttgctcctggaagaactcctcatcagcaggatccgcttcatcttcttcagcaactgggggggggggatatttatatagagcaagggtgagtacgggagtactcagcaagccagggaaataagtgtttaatgtaggcttcaaggaaaggctgttgttttcgtaattgattttatttgaactcttttctaaaaacaactaagtgagtgcttctcaaacgacacggatgagacagtgcgtctcgtccggtcggagnnnnnnnnnnnnnnnnnnnnnnnnnnnnnnnnnnnnnnnnnnnnnnnnnnnnnnnnnnn

SEQ ID NO: 19088 - DNA, 617 bp, Oryza sativa
aggatcggccccgccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggtcaaatcttgcataaccgagagggtactggacgggtggtgaaatgggcaatcgaactttctgagttcgatttgcactttgaaccacgccacgcgatcaagagccaggccctcgccgattttgtggcagagtggaccccagctcccgagcccgtctcgatccccgagccagcacggacccctcgcagctgcctcacaccgcctactgggtgatgcagttcgacggctccctgtctcttcagggtgccggtgcgggggtcacgttgacctctccgagcggagacgtcctcagatacttggtccgcctcgactttcgagcgaccaataatatggcagaatacgagggactccttgccggactaagagtggcagctggactggggatccaccgcctcctggtgttaggcgactcccagctggtcgttaaccaagtctgta

SEQ ID NO: 19089 - DNA, 1091 bp, Oryza sativa
cgacccccaacttcgtccatctccattcgtgtacttttgtttataaccagactaagccacaaactaaaccttacccactagacatgtggaagtacagtagtgctttgcaacagaggcccgaagaccggtccttatgtggccgaggtgctactatcaaaaccatgcaccccgagcccagcctaaaaccattttgaggattttgaatagagggggaggtgtgaatccaattccacaataatccaaccattccatagtgtccaggtgataagaacattcccaaagtttagagttgtaaaaccacctaatgttgcataattaaccagcgaagcatctacctaagttcatactagtggaaccataaatagagtacccactagttggagttttgtttattctagggtgaacaaggtaataataacaataacaataataataaggtcataacaaaggtaaataggcatggctaaataaaacagtgataacgcgagaatttaaataaagtgataatgcattaatttaaatcaaaataatttcataaactgggattcaatatgttcaaggatgatgtgacttgccttgctcgctttcccaaacgtcggcttcaacctccacgaagagcggatctaacgaagctgcagcgtctacacgaccaacgggaaggaaaaaggcttttactctaataaacttcatgtcacggtccaaaacgaccctaaaatacaacctctaaattatgcctagaataattaaaatccgtgtgaaagcctccaacaattaaaatgtgcaaagttaaaagtcaaataaggcttggagaatttttgtatatttcctaaaagtctaaaatgcgtaaataaattttagtggaattttcagagcacaaataataatcattaagaaataaacaaagttaaaatgtttttataaaaagaaaagctctaaaaagtcccttttccctcccactccctcttgggccgggtcggcccatctacctccgccttcctatcatgtccccgtggtccatccggcctgtccctgcgcgcgcgccgttgacgggctgggccgcccgtccccctcgctgacgggtggggcccacc

SEQ ID NO: 19090 - DNA, 2676 bp, Oryza sativa
ccctttttaaaattaaaaatttaaataaagaaattcgcaaatattcatttaaagagcatataaacttcaaatggccataacttggccatttgaactcggaattggaccgttcatgtctctaatttttccttaagaagtcaagaacctatttttgtgctttgtttcagcttgttatatggagtttattagagtaaaagccttttcttttccgttggtcgtgtagacgctgcagcttcggacgatccgctcttcgtggaagttgaagccaacgtttgggaaagcgagcaaggcaagtcacatcatccttgaacatattgaatcccagtttataaaattattttgatttaaattattgcactatcgctttatttaaattcccgcgttatcactgttttatctagccgtgcctatttacctttgttatgaccttcttattgttattgttattatttccttgttcaccctagcataaacaaaaccccaactagtggacactctactcatggtaccactagtatgattttaggtagatgcttcgctggttaattaggcaacattaggtggttttacaactctagactgtgggattttctcatcacctggacactatggaatggttggattattgtggaattggattcacaccgccccctctattcaaaatccccaaaatggttttaggctgggttcggggtgcatggttttgatagtagcacctcggccatataaggaccggtcttcgggcctctattgcaaagcactaccatacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcgtgcctacctgtcccgggggttccggtcgtaggtggggttgggtcggtactcttgtctatgactaggatgggttggaaactatgtcacgtcttccgtccgtataccgtggtggtatgtggcacgtggctacacgtgaggaagatgtgtcttgtgggtaaagatgtacacctctgatcagagtataatctattcgaatagccgcgccctcggttatgggcaagcctagcaatgtacccaagttagtgttttaattcttaaaacatgcttaacaactaaaatgtggaatggttggcctgggttggcttgggacgagctgggacccagggtcgggttgccagttcggtccaaatcatcgtaggccttgggttaaggcaggttcgtgtgggttcacggcccttattaattatcttgtatagctctaggagcatatttacaaaatagctttcagcaactaagtgtcttttaatgctgtttactgcaaaccctaaccccctatattataactcccttgtactcccatgcatttattctgcacttgtgggtgtgtcttgttgagtacggtggttgtacttagtcttgctcattttttcccaaacccagaaaaggagttcctggatgatgaaggctttggtttctagctcgtgcctgccgtcaagcgcctgtggtcgtcgccctagtcttccgctgtttttcgtttgtcttcttgtgtgctgggccttcgccgcccatgtaataaattatctatttacgcttccgcttgttaaactctgaattgtatcaacttttggtgtaccttggctcctgggacaaggaataatacacgcacgtaaggaacgcccgttgggttatttccggtcgtgacatgccacgtttctgccgcctcaacctattgttgatccaatacagcagcagccgattcagcagacacccccaattcagcaggttgtgcagccaatccagcaacaggtcatgcaaccagttcagcaaacaccaccaaggcagcagcctctgcagccgattcagcagacgccgttaagacagcaaatcgttcagccggtccagcaccaaggttcaataggtgcatcggccgggtttgcaacgcctggtggtcagcctgtacaacaatttttaaatcaagttgtcccagaacacttggttcaccacgtacagccggatggcacagtaatacctcaagttgttcctgagcatttggtacgtaatatccagccgaaccttcataattaccaagggggtaacttgaattaccaatatcagcctccttccccgcaagcccaatatcagctagggggattggctcaacctcagtttgcgcctcaatatggtcagttcgagcccatgcagcaacagtcacaaggggtagctcagcagcgaccatgggccgatgtgattgctgacgtaatgagggaacagtttgggcttaaaccaaaagagactggaagcttgtatcggcagccttaccctgagtggtttgaaagagttcctcttcccaatcggttcaaagttccggacttctccaaattttcgagacaagatggtgtgtcaacttatgagtacattagccgattcttagctcagtgtggtgaagcatcggctgtggacgctctgaaggttaggttatttcggttatctttgtctggatcggcttttacttggttttcctctttgccgtattggtcgatcaatagctgggccgatt

SEQ ID NO: 19091 - DNA, 1396 bp, Oryza sativa
gcaaggtttttagacagcagattcaggtggccattgagggaggcaagattaggtttgatgattccagaaagccgatgaaggtcgatggtaatccttttcctgttaatatggtgcatacaactggccaaacagccgatagggcccgtgcaaggggttttcgggtgaattaggctaagattatcaacaaatatcagaagaagtatgacaagcagcaggagaagtatcatgagaaatacgatgatagttttgatcctcattggggttgtgagttcttttgattctgctggaatgaaggtatgaggttgccatctattgaaaactgccatgggtgtagtgatatcgtcgagaactcaagccgatcatataataggggcaatcggctaaggcagataagagtttatgttcatcaaagattgggtccagtaaatcaagatcatggccaaaaggacaatgtaatcaggaagaatcaatggtgtccttctggtattttcacaaagaatcagaagagaagggttcaacgattgaggaacagggagcgccttcaggaggttgaacaagaaattaatcatcggctgaagaaagcaaagccaaggcaggagtggcgtgttaagaatcaggttcctgcagctgatgatgttgcagctgatgaggcaaaatggttggcaaaagggaaaagtgttgtgacggcaccggttaacatggtatttaccctgccagccgaattcgggatcgaccaagccgatgttgacgaggtggaagaggaatcggctaagttggttctgtcaccagaacaggcagtgttcgagaaacccgaggggacagagaatcggcattttaaaccattgtatataaacggctacgtcaatgggaagccgatgtctaaaatgatggttgatcgtggggctgcggtaaatttgacgccctatgctacgttcaggaagttgggtagaaatgccgaggatctcatcaagacaaacatggtgctcaaagattttggtggcaatccatcagaaaccaaatgtgttctaaatgtggagctgacagtcggcagtaagactattcctaccacgttttttgtcatcgatgggaaaggttcttacagcttgttgcttggaagggattggattcacgccaattgttgcattccttcaactatgcatcaatgtttgattcagtggcaaggcgacaaaatagagatcgtgccagccgacaggtcagttaatgttgccagtgccgatttagctctttgggagatggatggccttgattgtttatctgaaaaagtctgggatggagattttctaaaagtgttcgattttgatatacaaccaattgaagatggagaacccaagctattattttgagggcgtcgtggagggttcaagtgtttacacta

SEQ ID NO: 19092 - DNA, 1216 bp, Oryza sativa
atgcaaggccgacatgctttgaaccggtcaaggctgagattaaaagattatatgatgctggttttattcgtccttgctgatatgctgagtgggtttctagtattagttcctgttatcaagaaaaacagcaaggtcagggtatgcattgatttccgaaatttgaataaggccagaaaatatggtctgaggatgaatccgacaaaatgtgcttttggtgtatcggctggccagtttttgggatttcttgttcatgagagggggatcgaggtaactcaaaggagtgttaatgcgatcaagaagattcagcctccagagaataagacagaattacaagagatgatccgcaagataaattttgttagaaagtttatttctaatttgtctggaaggatagaaccttttacaccattgttgagattgaaagccggtcagcagtttatttggggggcagagcagcaaaaggctttggacaatattaagaaatatcttagctctcctcctgttttgattcctccacagaaaggaataccgtctaggttatatttatcggccggtgagaagtcaatcggctcggtcttgattcaggagttggaagggaaggaacgagttgtattctatctcagtcgtcggctcttggatgctgaaactagatattcccctgtggagaagttatgcttgtgtttgtatttttcgagtacaaggttgaggcattatctactgtccaacgagtgtactgttgtatgcaaggccgatgttgtcaagtacatgctatcggctccaatattgaaaggaagggttggaaattggatattttccttaaccgagtttgatcttcggtatgagtcgccgaaggcgattaagggacaagctatagctgattttattgtggaacatcatgatgattcaatcggctcggttgaaatagtgccatggactttattctttgatggatcggtgtgtactcacggttgtggtatcggcctagttataattttccctaggggggcatgtttcgagtttgcttatactattaaaccgtatgcgactaataatcaagctgagtatgaggcagtgctcaaagggttgcaattactcaaggaagttgaaaccaatgccattgaaatcatgggggattctttgctagtaatcagtcaattggcaggagagtatgaatgcaagaatgatacgttgatggtttataatgagaagtgtcaag

SEQ ID NO: 19093 - DNA, 1818 bp, Oryza sativa
  unsure (1)..(1818): unsure at all n locations
gtatgatgtgcatcagtatttgcataatccggctcaatcggcttctaagaaattgcgatataaggcattgaagtatactctgttggatgatgagctttattaccggacgattgatggagtgttacttaagtgtttgggtgccgatcaggctaaagttgcaaccggcgaagttcatgaaggaatttgtggtactcatcaatcggctcataagatgaagtggttacttcggcgtgcagggtatttttggctgacaatgctggcagattgtttcagatattatagggggtgtcaagattgtcagaaatttggggcaattcagcgagatccggcatcggctatgaatcctattattaagccatggccattccgaggttggggaattgatatgatcggtatgataaacccaccatcgagtaaatgacataagtttatattggtggcaactgattatttcaccaagtgggtggaggcgattcctttgaagaaagttgattctggggatgcaattcaattcgttcaagaacatataatctaccgatttggtattcctcaaactattataactgatcaggggtcaatcttcgtgtctgacgagtttgttcagtttgccgatagcatgggtatcaaattattgaattcttcaccttattatgcacaagctaatgggcaagccgaggcgtctaataaaagtttgatcaaattgattaagcggaaaatttctgattatcctcgacaatggcatactaggttggccgaagcattgtggtcttataggatggcttgtcatggatcgatccaagtccctccttacaaacttgtttatgggcatgaggctgttttgccatgggaggttagaattggctctcgaagaatggaattacaaaacgatttaacagctgatgagtattacaaccttatggccgatgagagggaggatctggttcagacacgattgcgagcccttgcaaaggttaccaaggataaggaacgtattgcttggcattataataagaaagtggtacctaaggatttttcggaaggagaacttgtctggaaattgattttgccgattggtactcgtgatagtaaattcggcaagtggtcgccgaattgggaaggaccgttccaaatttataaggttgtgtccaagggagcatatatgttgcaagggcttgatagtgaagtctatgggcgagcactcaatggcaagtatttgaagaaatattacccaagtgtttgggttaacgcatgatcggctagtattgccgatgcatgacagccgatgtgtttgcatcgccttgagatggccgatattgttatatcgcccttagttgtttttcatgatataatcggttgtgatttgccgatgtacaatggccgatattgttatatcgcccttagttgttttataattttatcaatgcttttgtcattgtaaaattaggggggcacatatatatcaaaatgcaatgcaaattttttgaggcaaatttttttagcgaattttaaaagtcatattaatcggcacaaaggattgttaagacagtaaagtactagagcatcttagctgattacaaaaaatttctgagtcctattacacaaagttattgagacaagtatcgctggatagccaaaatagccctttgcctgatttgttctacttcttcaatagcttgggcatcttgagcatcagttccagagatgactttcagagacttggttaagtcagcaacattcttgatagccgatttgagnnnnnnnnnnnnnnnnnnnnnnnnnnnnnnnnnnnnnnnnnnnnnnnnnnnnnnnnnnnnnnnn

SEQ ID NO: 19094 - DNA, 3222 bp, Oryza sativa
caaatttttttagcgaattttaaaagtcatattaatcggcacaaaggattgttaagacagtaaagtactagagcatcttagctgattacaaaaaatttctgagtcctattacacaaagttattgagacaagtatcgctggatagccaaaatagccctttgcctgatttgttctacttcttcaatagcttgggcatcttgagcatcagttccagagatgactttcagagacttggttaagtcagcaacattcttgatagccgatttgagccttgctttttgttcttcaattgattttgggagatcggctagctttttgtgttctatatctagctcggcattgcattcctcaagttgcgccaagagctcaattttgcgagcttcgagccggtcaatattggatttgatcagaccttcagatagctgatcaagtttggttttttcttcatgcacaagctgccgattagtttggattgtggccttaatctctttgcgatcacggcgttcggctagtcttagcttggctttttccagcttgaactgatgttgctcgagataagcggctagagttaggacatcggccagatcttcgggaatcagagcttgaacttcatacagccgtgtcctaattgacccacggtcaactaccaaactgtctaaagaagaggctgctagccgatgagagatgtcttcaagtgtttttctcacatcatcggataggggagctagggctttgcttgaagtgtcttcttctgcttcatcaaggtaatctctgatgtcaaaagagaagagatcggctagagcctgcagagacaatttcggaaagaataagagctgggtaaattatagctgatctaattgttgagacaaagggaaacttactgggatagcaggagcagctggttgttcttcctcttcgatgtgatgactccccacagccgatggagtctgatcacttgacgattgctgtataggaggagaagtaggaggaggctacgaaatagacaagtgttatatataatcagttgagattgattaagtaaaagaattaaggacatcttactggtggagccgatttaacaattgctgctgttttttttcttcacagcagttttcttcttctgcaaccacaaagtctatgggtaattagccgaagagtgaggtaatttcagaagaagtcagagagaggtacttactcttgtaaaatgaacgggggcgtaaggagttggaggcgtttgcttgggtgaagccgatggtgttctttctgtgtcactcatttcggctacagcttgatcaacatcttcaccaatttcctcgtcatctaaagcttgttcaatagatggatccaaggcgggcagatcatcagtcgacatatcagttggttgtggttgagttttcttgaatttggtctttttctttggagccaaggctaaggtactcatggctgatgatctggttttccttttcttgcctgcatcggctggttctctagttaggccgtgaaggagagttgaagtcttgggggcatggtagccgatgaaagggggagatagtccacctccattcggaattagacctgaagcatattcaatgttcttgccactgttactttgatgaggaggggaggactctgttgtctgcaaaacaggagcaagaggtcagtcaagtaatgaatcggctaactggttatgcaatttagtaatgacaaagtttacctagggcatgacgtcggggaatagatctgtcatatacattgaagcggattgatgaaatagatgcagcttccattcgccccaccatctgtcaaagtttttgcttctaaatcttgccaactcaatattatcaatactgcccagagagggtcctggtaggttaaatagccgatccatcattagagtggaagtgatttgtcctcggcactgaatcttgtcggcaaagaataagccgattgggagttggcccaatccaagttgtctggccgagctcattgggtgataaaactcgtaggagacttggatgtttcttccttggtgaatgccgatagggaggatgcatgggctgattgcagctataagaatttctctggatttttggatttttttcatggttaatgtcttcaaatctaaagtctgatggaagttcaaggtctgctgagtcttcgtagggaaaccagattcgtgcatctttcttaaaaccttcgtagaaactgcagaaccagtccttgagtaactcagccgatagcttcgctccagcatcggttggtgtggatgcatattctccatatgacatgcatctgcgatgggtacgctcttctccgtcatcttccacaatcggctctggcaatgggaattcagcttctgtcacagagggccgattgacaaccttcatgactaccaggtttaaccaagtttgcagcagccaccatggtccacctgctccaactattgagccgacggctattttagccgatgcattgttcaacatctggtacagatagccgagaaggattttgcccaaaggaaattctttctttgattctaaggcttcagttacgaattgccagttggttgtagggccacaactggatccatagaagaggaatttttccagccacataagcaagaaagctacatgctctcgaggggtaacagacccttggcccatatatgccgccacatagccagaccagtcacctatgcttttggtcttgaagtcgaattggttcttggtgttcatgctcatagggttagccgatgaagttacatctaatccagtaatcatggtgatgtcgattaaagttggagtcatcggcccttggttgaataagaaagcattgatggtgttggaccagaagtaggtggcggcagccatcagaggttcatccttagcagaattggctatggtgagagtgagtgcttggccgattccaatttcatcccagtgaactttcttactagccgatacgcgttggtaccaggtggtccagctcttatcaggagtaggtttttcgagagatggccaagacttgaaggtattcttccagtgacccaggttagggttggctagtctaaaggggatccggttagtttcaccgatgatgaaatcagtggggtcgagattcgagattgccgattgggccaagaaaatagtagtttttgtgtgaaaggctgggaatcgtgactaggttggaaaggtgctgcaaatccaaaggaattgagaagcag

SEQ ID NO: 19095 - DNA, 3472 bp, Oryza sativa
ttggcgcgggagcagaggaattggtggcggcagagggaaatcggtatggcgggaatgggttttgggagggtgaatcggggatttcgcgctacggtttcgacgcgagggcgaggctacgccgcccacaacgcgcgctacccgggtcttctcctcgctgcgcgtcctggatttcgcgaggttttgcgtcgctcacctaggggacgaggaacctagtttaggcgcgggtccaagtgacacggcggcaaaaatccaacgtggcgcgacgaggtcccggtccagctcaccacactgtgagagcactgtgagaggcctcatgtcgtgcatacacaagtactgtctagagtttgtcttcttggagaagacccagaaaaaccaacctttgtatacaaaaatgcttaatagacatagtataagacacccttggatactatcccatcgtcatgtgaagtagcaaactatgttatgatccccttgatcttgtttacgcctttggatttaagatatgtacttaactttttagattagatagttttacctttgtgttactttggataccataactctttatcaagtaatattgattacatcggctatcgcacaccaatgacctcaaaaagtaatatgtagatcacacattcaatatagggtaagttgtatgtgaatggataatagagttggaataattcatagtactagtatgtatcgctccataagttattttgttgtaaatgctcacttacctaacttaggtactatttgtttcagcttaagattattgtaatctcttattaaatcagattactctaaactagattataataagctgacatagaataagctgccaattgtttggtttctctggattattagaggcatctaaggccttgtttctttcagcttggaattattataatccagattattgggagtaagctgaaagaaacatacaacttattgaagtagcttattataatctggtgcccagcttattataatatgataaactcatttaggtgagctttttccagattattgggtgaaaaattacccaccatgccaccccactccctctttagacttgcaaacccaataatctaggctctaataatctaggaaagaaacaactaaccgcttattctactacagattataacaatctagtttatagtaatctgactcaataatctagaatataataatcttaagctgaaagaaacagggcctaagagtagtgggtctttagccactcaataatttggaaaaagctcctctagtgaagatttatcaaatattctggacttggggggcatgtgttaacaaccaaatttggtaatatcggcatcaggaaagaagattagatcgaagcaaagtcggaggcggagatcgagttcggaaacagagcaggaatcggctagagtccagatcggttacgattagaatcggctgggtctgagtcgggctaggtaagccgatgcagccgattctgacaatgcaactcgatgtatgacatcgggttgaattgaggtgcttcaaggtgattgccgcacatggatagagtcctgagaagtcaattgtatctattaattaggatgttttatataatttccttagagatatgcttgggcaaaagtctgccgcaaagacttatggtatcttggagtttgttagagatagttgtcgtgtctgttatggacatatcttgtaattttcgggtataaatagacccgagcactatgtatcttttaacacacacgttcaatacaatctcggtgcatcgccaccttttttgctttagttttatttcgacgagttcttgctttcgggttgagctgcatcggtttcgatcttcaacaagaggtaaaacttgttatggcggcttgcgttcttgggattagtgcttccatctttatgacactctaatcttgtttatgtaattcgtcgagttatcatatatcctacataatccttggcaatatcgatatccaacctacaatcggctaacatccgtcaatagaaggcagccgattaggttaaataccgatgttgacttagattatataggatatctaccactctatggcacatccaatggcttgattgtctagatacggcttgacttaagtttgaccttataagtcgtgattagaatctcaatctctagcccgcttcttggttgctgattagggtagtatcggagtttcagccgatcttacctaatttaactgctttttatcctatatgcttgattgacatgttaaatctgtcctttacgttaagatcttgctgcatttaaatatattaggcttgtgtttagtatattctacttgctttaatatcttaatatagagtagtatcggagtattagccgatacatgctagatctatctgatcggctatgctatgaacgtatatagtctcattattaatatatatttcgatctaagtgatttatactgtctcggcatagcgaccgatctatcccaatcacttgatttaagtacgtattgatataaagattatatattggtaatatctgcagccgatcgagtagattcagtcctttcttatttattaatgactgccgatcgatgcatatacgacatcggctgaaagataaatgatatgtcatcggcacctagccgatcggctatcatttatagatttaactgcggtttctttgcttctatttcttgttgattacaggatcaaatcaactggcacgctcatacattcgaaggtgagctttggacctgcactggagttaagcagatctccaaggcctcgtgttttctgtcaacaagattataataatctagcataataatctatttgtttgtttcagcttactcctaataattcagattataataatcctaagctgaatcaagcggggtcttagtttgttgaaaaaccacccattacgtatatgcttaactgaatcaacatgtattttaaagtgtcagcgttaatgtggtctttaccaaaattaaatacctatagtcttgatacttttttgggtaagattccacaaacaaaattactgacaagagcttaaacgttctctcattgagttttgctatatgcacaaaaaaaagttcaattaaatatgaaaataagtctaatgtaagcacttggataaggttgaataggcttagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacattcactaaacacatccactatcaaaagcaaaacacccaccttgtgacacaaacccaggggctactg

SEQ ID NO: 19096 - DNA, 5680 bp, Oryza sativa
  unsure (1)..(5680): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttagcctgtggtaactctacatcagtgctaacaggttaattcagttaagcacgtacgtagtgagatggttttgcaacaaaattaagtaggggtagatatttgcataaaatgatttattatgggggtagaatgtcatatgagatgattttggaatttttctctattatattttagagcggagggacatgagatttaattaaacacatccactataaaactcataggcaacaatgagatttaattaaacacatccactaaacacatccactatcaaaagcaaaacacccaccttgtgacacaaacccaggggctactgtaaaccgatggagtagaaggcacaaccgcacaaggcagcagctgaaaattgggggaggaagaagaacaccaggaagggaaagcattacttcatcattaacccactcgcccaagcataaatccgccctccagttcatatgcccctcttgccgaacatgaccgttgggcgctgtccccttccagatcccagatatactaccacccctctctccccccgcatcgcccccacgattcgtcgcgttcgcgtgctgccaaatcctcctccccctcctcggtccccacaacattctgtcgcgccgattcgaccgttgccgcttcgcccgctccgcgcacgcgcgcacgccgctcccgttcccctcgcgcacgcgcgggccatggcgatcgacctggcgccgctggctggggagttgaaggtcgcggggccggcggttggaggaaaaaaaaagaaggggcaggggaagaaggcgggggtgtgcggcgggaaggccgtggtggtgaccgcggcggacgcggaggtggagggccacccctacgacttccacgtgtccgggccgcggaacctgccgccgcccaactggagggagatcatccgttcgagctggttggtttccggttactctctccatgtttccttgcgaaatcttagttaattagtttgatatatgcattttggcgttatggagatatcagatatggtcgtcatgggcgtgaatctgtggggatcgtttacgccgcgggcacccttggtttgttgcctcttctgattgatcggaaaagggactatgttttagggaggggattgccgtccggttgcacccggctcccaggattggaaggggagggaatatgctagatgaaaggcgatagctttgttggattgtaaacaaggaaccgaatttactgctattttcaggattttgttgcaatctgcactggcgcaagggtatagcatgcattaagattaaaatctccaatcgatcacctcacaaatgtctgcacaacatttaaactttttttcaatgtcttttctgatgatcctgcgattcggcgtgtcagctttgtgtttagttggttagtgttgcgcttgcgcgcctacaagtaataacctacaagtcaggttacagactaccatacccagagttttgcccttccttccatacactgtttcgtgaggcatgggtatggaaatgcacctaccttttcttacggattgagtattcttcttaaacaagaaagtgaagtagcagataatcagtgattgaaaccaaggtcctgtgggtggtactttcctatgggatatgtatggacttacttttgttgaagaggtgcctttctaattctcgccccttgtttttatgaccttcaataataatcaattatacagttctacactctattgctctagtttttaggctataccatttcaattggacggtacaaactctactggttgaactagagttatcactacagttcccttgcttcgtgctatagtacttggacgtagtctctaaagcatgggcgggaatgggtcacagaattggtattccgaaaaagaaatattcacagaattgcacgtttcgttctgaacattataagtgcttaggatgtcaggtcttagtaaattccaatctgtggcaagcatacaccagtattcctattaataacgtaatttcataagcggatgaaagcttttcacgacttttggtgaaaatggaacatgcaaatctgataattttagcggacaggaggtgcattaccataccaaaaaaaaaagaaataataataatatgagctatttggtttcttttgtcaaagtttgtcagttagttatgacatcaaatatatttcgatttgacctcatacatacaagaacttctggtaatgcagtatatgctttgtatgcgtaaccaggtttacttcagtgtatcacacttgttaatttgtatctgctacctttagttctaatgccatcaatgttgctttaaattgattgcaggaaggatcccaattacaaaaggatggtaatggcctgcttcattcaagcagtctacctgcttgaactggacaggcaagatgagaaaggagaagaggatggccttgctccaaaatggtggaagcccttcaaatacaaggtcacacagacattggtcgatgagagagatggttccatctatggtgccgtccttgagtgggatcgttcttctgctttgtctgaccttatcctcataagaccaagtggcgcgccaagggctgtgttagctctccgaggaacactgcttcagaagcccaccatcaagagagacctacaagatgatcttcgcttcctggtgtgggagagcttaaaaggatcagtcagatatattggcgctttagaagcactgaagacagcagttgagaggtttggtagcgctaatgtcagtgttgctgggcactccttgggagctggatttgctcttcaggtttgcaaagagctcgctaagcaaggagtcttcgtggagtgtcatctgttcaatccaccttctgtttcacttgccatgggtgtaaggagtatgagtgagaaggccagctacctgtggaaaaaagttaaggctagtctaccactgactgaagaagcattacctgacagtaccaaagaggagggaagtgcaaagaagaaattgcgtgctgacaagaaatgggtgccacatttatatgtaaacaacagtgactacatctgctgtcactacaatgcccctaattgctccaccaccaccaccactaccaccactgatggtgcttcagatgagcagcagcagcaacgaaaggcaagtgagatcgctggtgatgtggtcgcgaagctttttgtgacatcgaaaggcccacagaagtttcttgaagcgcatgggctggagcaatggtggtcggatggcatggagctgcagctagcagtgtatgacagcaagcttatatacaggcagttgaagtccctctacacagcaactgcaccgtcaccccctgcaaagtagtagaaactgctgagatcgctgtttcaactggcgttagaaatactctttctaatcagtttctgcctctattaacttgatatgtttcatcatggttgtgactgtgaactattatacagtaaaatataataaacggacatgtgctgataaatacattgatatttttcatgttccatcttctgtcagaggttttcaagactctaaattgttacaagggatataagggatactagtatgtctggataccgattagcatccatgtttatgattatgatcttttgatggtgcacttggctgatgttcgtagggtgcaactgtgaagcttttccagaatgaatgtagcatggcaaattagcatccatgtcatgatctttcgatggttcgcttagctgatgttcgttgggtgcagctctgaagctttttccagaatgaaatgtagcatggcagatgatgaagaaggccaccaaaattgtagggagtggttctgaagcttttccatttccatcatgacaaaataatgaaaacgccaccggaatctcgaccaaaagaacgattaaggcttatatcgagggttaaaatggttaatattgaaataacaaaacgactccgctggggatcgaacccagaatctctggttccgtagaccagcgccttatccattgggccacggagtcgtagttgaagatgcagagaaaaataaatattcatcttatacttagtaatgccttgaaagagacaaacaaaaccaagataaaaaaaaatgggaggaaatgtggaaattcgaaggctaagaagaagtaattaagaacgatcgtccaagctctacgtagggccaaatctccgaacactgtagcggccgcgcccttttaagctcagtacggtacgggaacagcccaaaatagttttgggcctatctcttctgtacgctggagacgagcctctagtaagctggtcgatttgctgtacagtttctcttcgccatcgtcgctagattgtagtacttctgatgacatctactgatgcacattttggtaacggtccagcagtgcagtcgtcggtgagcatccattattcaggttcagcggatgcatcctctgacggcgaccagctctttatattgaggtgacagtgaagaggtcactttggaccacaaaaatttacagcctcctccttgacaacgcattgttgagcagtgcctatgccttgagttgagcgatcgagtgacctcaattatatggaagcatgttgtttgcttcccattgatgattcatgcgtccccgcagactgcagaaaccacatgacagactgacaatggcgacggaatgctagctctctcgtatgcactctctatcagtatgcagtagtagggaatcagggataccccgatgctaataaataacttttacagtggtcgctactggtagtagaaaacaattgatcaagactactacaatattttaccgcgagaccgatttctatgtgagttcagttctaataaatccgatccgtctcattgtggccttctttcctttgtcagaaactcagaaggtgattctgatttctgacgctgcagatggtaattaggaggtgacaaaattcagtgagcttcgcatgcgcagcagaaacctgcaggctgcagctagcacccaagggaagctgctgccttttctggcaacggggccttgtgtttgtgttgttgtgcatagcatagactttgctttgcttttggtatggagcccaatctttggtacatgtgtacgtaccgaatggccttgctcttgcaggaagcaatgttcctgtctcgtggacaaagctaaatagctaatgcaggctgtactggtcattaactatacacaaacccaatgatccagaacgctttatttggcaattgagttgtaataagggactaatagctgataagaaatgcagcagcgtaccgtggtttagtctaaaagataatggcctggaatgcaggatcatgactactgattaagctgctcctactaatggtcagtgtcctccttcctcttttgcctctcattttgttcgtcgatagtacatcattgcacgatctctttccctgagtaaagctgatctctttcccttcttttctggctatcattatttgtatggcaaatgctaacacttaacgccttgttgatctgaataacaataatgaaatctctacctgtcattcataattattcatccatgaaccgagaacagtcaaattcgtatatcttacaatccaattccaatcgcaaatgg

SEQ ID NO: 19097 - DNA, 554 bp, Oryza sativa
  unsure (1)..(554): unsure at all n locations
cgccaggcgccggagcagccgccgccacgcgcggtggccgcaccaccccgcggcggggctgacgtcgcgcaccacgagctgcaggctccggaccacggcggagccgcgccgcctgcccgtgccgccggcgccggacagagaaggccacgaggacggcaggcagcccgatgagccgccggagacgacgttggcggcggggtggcgcgccgcggttagctctgtggtggttgtggtggtggtgcccgctcccatggtggtttggagaggcgcgcaggaaggaagaagtgggagagagctctctcgtggcggttatacctgtggttatatgggaagcgagacgaataatagcagtattaggctgttagcatgtcgagatgagaaaacaatggtggttattgggctgcggagtagacaagtggtagagtgagatgagctcatgggtttttgtggtggttacttttggagatggaatggacatgcatgggagcttgtgctatttttagacacaannnnnnnnnnnnnnnnnnnnnnnnnnnnnnnnnnnnnnnnnnnnn

SEQ ID NO: 19098 - DNA, 1111 bp, Oryza sativa
actctagaggatcccctattatcaccctaggcttgcaaacctcaacataggctagcttctttgtgcacttacttgagactagttgatttaggtttcgaattgtgcaaaaccattttgatttacgcttccgcatacaaaactcggttttagccaaaagtttgaaaaaccgcctattcacccccctctagtcggccttcttgatcctacaccttaaccattcccatcctgagttttgacgatggtaatatggtattatgccaattttctcctactcggctccgcgccgagccgcgcgagctgctctgctgccccacggcgcccgtgcggaggccgccgacgaccgcaccactagcagccctccccaaccatgccaagcaaggcaatcatctctcttgcggcggtgatgctcctcggagcaacgtcccggccatttgcgcctcaaccacgatgaatttgttcctctagatcatccccatgtcgtcccgtgccccacctccaccacccatcccagccaccggtcgccttcgtgtgtacttcggcgagccccaccggcgctcctagaccccgtcgtcggcctcggcttcgccggtgtgcctagttcccggagaccgtcgacgccgcacccaaccttcaccgccttcacacctgtccctagctaccgtggcgtcacccaagcggtggccgtggttcccctgggcatcccatcgccggccgccccccctccggttggcgcctccccgtgctcacgcgagagaagagaaaaatctgattaagtctaatggaatactctccatcccaaaatataagaatctatgatcgaatgggacattttctagcctgtctagatttgttgtactaggaaatgtctcatccaatcataggttcttatatttttgggacataagtagttaagttaactaatactacctccgtcccaaaataattgtatttctatgattcaaactttgtcccaaaataattgtaattttagagtactaattgccccatcaatcatctatcattcaaatttctccctattatacccttaaccatcttcccactctcacataaacaccatttaatgaggggcaccatagtctttcttctcaaa

SEQ ID NO: 19099 - DNA, 845 bp, Oryza sativa
cccccgcaagtagttagtgcggcattggttgtggagcgcgatgagaacaattctcatttcacgctttcccaccctgtgccgacttggcccgggagagagcaggaaggagaggctcccgagccgaacggtggcccaaggcccccgacgaccggagttggccctttgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccgagccgaacggaggcctaaggcccctgacgaccggagttggccctttgcccgcttgtccgacgacgccaggagcccccgacccccaggacggccccgaagccactgtgggaaggccgcccctgttatcctccgaccccgaggtcatcagcacagaagacaagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctcatggcctcgaggaaactgcgccattatttccaggcgcatcgggtcacagtagttacgtcttaccccctcggtcaaatcttgcataatcgagagggtacaggacgggtggtgaaatgggcaatccaactttcttgagtcgatttgcactttgaccacgccacgctataagagccaggcctcgccgattttgtgcagaatggaccccg

SEQ ID NO: 19100 - DNA, 6023 bp, Oryza sativa
taatggaatcctcctagaagtgcattcctcgggaacaaaggtgttgtgctttcttgccgatatcaatgaaggggaatggggagcccattccgcctcggcaacgttggttggtaaagcttttcgcaagggtttttatggccccacagctcttaatgacgcggtcgacctggtccggcgatgtagagcgtgtcaattccacgccaagcaaatctatcagccggcccaggccctgcagaccatacccctttcgtggccatttgctgtcttggggactcgatatcctgggaccgtttaggcgggccccgggcgggtttgagtatctgtatgtcgcgatcgacaggttcactaagtggcccgaggcttatccggtcgtcaagatcgataagcactccgcacttaaattctttaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatagtcaagaagtatggcgattcatggatcgaggagttgccagcggtgctctgggcaaaccgaactacaccaagccgagcaaccggggaaatgcctttcttcctcgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgtcccccggccgggctccatacggctggccacgggcgacggcactgagctgcctaacccgtggaacatcgaacaccttcgtcgcttctacccctgagggggggtcgggtgtcaggtttcgggctcgggccaaccccgcacccccctcgggcgtgcagggttggccggggcctacaacatatgcatattcttatttctcttacatctgtatttcaataaaagcagtttcaatttcctaaaggctgtatctgtactgttttttccttttgaagaatcttgacttgaaataggtcactcgtgctcaatcctgccctcgggggctcgggtcggctaaaatcgccgaacggggcccagaaccgagccgtgccccgaggcgtggtgaactccggggggggaatcggcaaaaacccacaatcgggtcacccataaccctcggtcaccacgttcccggcctggccagtctcgacatgtggatctccccaggcactagccccgacccgcgccttttgaggaccagaacctgggcacgagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgccggcctcgacgtcactgtcgtctgcaccaccggcattgccctcctcgtcggagttgggggcaaacgcaagccgaggggccgagccctcgaagctgtcgacgatatggtcggaggaatcccggacctgcgcgcgcgcgcggtccttggtcccaggagggaactcatccagcgccatccatggagagaaattggggtccctggcctggtaactcgccaggacgagctccaccgctccttgggcgagggccctcgaggatgacttaattgtcttctcgagctcctcggggagccgttggagagccccggccatcttctagaggcgctgggcgaggcctccctggttgtcggcgtactttacggtccgccctctccagaggcccacttgccgactggcgcaatctaggcgggagacagcgtcccaaagcatgccgggccctacctcgcctgccaagcggagggcttcgacctccccggcggacaagtccagcgcgccctgcagatcggcgatggtgcgttcggcagctgcgaggcgggcggctaagtcgctttcgcccgtggccgccctgccgctgcgcgccctcgcgtccagctccttcgcccgcgcctcgagctcagcggcccgttggttcagtacggccctctcggcgcgggcaccttccagattgtggcgtgcctcctcctcctgcgctgcctcgcggagggacaggctaaccgccagctgttgcgccgcggcctcggccccctcgagagctcgctcccgctcggtgagcgcgtcctcgcggaggcggagtgtgaactcttcttcggcgcaagcagcctcgtgcgccgccagcgttgcttcccggatggtaacggcggcctcgcggtccgccagatccctctccacgacgcaggcgcgctcttccagcgccatggcgcgcgcctcaagggcctcttcacgctgccgggacgccgcttcggtctccgccgccgctgttctcgggcagcagcagcatcaagcaccccctgggcggcgtcgagcttcttccttagctccgcctcccagctcccatattgaaggcggagggtgtcctgcgcctcgttcatcacggtggtggcaatgagggcagccccccgctcctcctccacttccttggcgatctccgccagcaccttcttacgggtttcaagctccgagacgtgccggcggtgagccttacggcccacctccaccatggcctccaccgagcgtcgcccctcttcgacacgcgcccacgcggcgtcgagctccgcccgctctgcctgcaagacctccacctgggcgcttaacccatccaacaccgtggtgtttgcggcagccaaggcctgcagaaggggctctgcgttcagtggggcgatagaaggcgtggggcagagccgccttggagaggatgccacgcggttcgggccgccgatagaagtgccggactcggggatgtcccccggacccggttggtcctgagcgtcgcccgagggagtgggcccaagcgacgcgcccgcagcctcgtcgccagctgccccagaagttgtcgcctgagcgtcgcccgagggagtgggcccaagcgacgcgcccgcggcctcgtcgcgagctgcctcagaagtcgccatcgcctcgtcctggcgaaatccgacttcctcccgagcggcttccccggcctggcgggcccgggcggcctcctcccgagcggtttcctcggcctggcgagcccgggcggcctcctgggcggcctcctcggcttcccgtaggcgatccgcggcctctcgccggtcagattcccgcctgagggcctctacggccgccggatcctcggcctcagactggccggacttggaatggcgggagggacgcgacgggatctcgctgaaacaaaagaaaaaaccagaagacgaacaagatgggtgagtgaaaactcgcgttaagagaatacagtcacgatgggtgagagacgaacctgcgagggggtcggttaaacgaccactttggaggggaaatgaggtttccccgagatggttctgtctcccccatcttacggggccgcttcttcttgcgctccccctcgggctgcgatgttggcgcggccccctccgggcgcctgctgctgacacgcgccgccccgccccctcggggaggagatggaggaggtgttcctccctgcttcctcttcccccgggcgtcggcagggcggctgctccccgggcccctgtcgcgggacccagaagcacgaccccctctcggggtaaattgttcccccctgcggctcccgcctgcgccgtcgtggccctttggagctcgctcctctgaggccccgaccgccatcataatggtcaggatggaggcgcggtctggaacgctgcagagggggaggattccttggggaatgagggccgcctctacggagttgagattcagcacccgttggaccaatatcttgaagtcctcaggagcccaatcccatctgcccccctggtgggtcctcatgtagtcctcggacccggtgtactcccaggcgccccgagcgcgtcgctggagcggcgcgatctgacgacgaaggtagtcgccgtacaccatggcccctgtgagcccctgggatcgcagacctgccaggcggtcaagaacggcgtcatagccatcccccagatctaccggcgcccgccagctggaggcctgcgccgggggctggctcggaagtcggaggcgcgtttcatcggcgaggggagtgtagaaccagtcgctcttccagtcgtcccacttcttgcggagggcgcagggaatgtagcggttcagcaccggcccccgtggctggaagtagcagccaccgactaccgacggcggcgacaccggctgtacggtgaagaaccaccggaacagccggagagatgggcgcaccccgatgaacatctcgcacaggtgcgcgaagatggccaatgtcattaccgcgttgggggtgaggtgcgccatctggagatcgtaaagttccagaacatccatgaagaaagaagagaatggtggaaccagtcctgccattgcgaaagagaggaagaagacggaccgccccgggtagtgtggcgccgggcgtccctcacccagcgcgaccacctcccggccggtggcagattccggcatgaatcggcacggcagcccggcctgcctctcgctcacgatgcgggaaggcgtcagcacgctaccgtcgagcggtgcggagccccgtaccatgacgccggcggaggaggagcttgagaacgagtgagtgcggcaagggtagggcacaggaaacaaggagttagggcgcaagcggctaaggcaaggggaataatggcgagaggaaggaaacgaatctcttccttggcgcctttatacccttgccaacgttatgcccggctcctcgtttctcgcgcccactatctcgccccctcgtttctcgcgcccacgcctccactaatcctactcgtccgtttgcggcgcacgaggcggatgtgcggccgtggcagtcaagatgggacatatcgtgcgcgtgttaactacgctcgccgaccgaagcgccatcatcatatctccaggcgaaatgaacctgctcgtcccgattcgcgcgctactcgagtaatgtaacggtcttgaagaggccactcattgttatcggtcgtttttccctagccgatgcacgcgatttgcgaccgctgggttcctgcccgcctgtagagagcggccccacctgtcaccaggtctaaagagtggcgtcacgcccgagcgcttccctcgaggggggcgatcgccctggcataacgccgggggctactgtcggtgacatgggaccgggagtatcatgactagaggcttgggcagctgcggtcacccacgtggcctaaccccctcgggagggtcgggcccgagggggacgtgcccaccccctcctctgtctccccgaggggtcgagccgctcctgtttcggccccgagggctggggcgccccgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttatggtggcagcaggcggcctggtacacgcctcgccccgtcccgttcgaatgatgagagcctcttgacactcgtccctagtggagccggcgt

SEQ ID NO: 19101 - DNA, 3119 bp, Oryza sativa
agatctcctcctattaatgaagaaatgacagggtgatcccctgtgtccgacgagtgacggcgctgggcatcactcaaggacaagcggtgatttagcttccaggcggaggcgcgagtcaagatttggtcaagatagggtgggtccccacccacaagaagagtaggtagaagtagtgcatgtggtatccccttgagatataaaaggaggaccttgcccacctaaaaaggggggaggagatcgagagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcctccggccgaaccggcaaaggggggcctgcgcggtctcccggtgaggagccccacgctccgtcagtcgccgctctgaaaaatattttttttgtcaatctgatcgcatggggagtctaagccgaccattgtattctccagtgatttccagaaaataatagattttagagtttagatccctctcaccttttttttttggagttacattcattatatttctgtgataaaattaacagtaaatttgtaattttgggataaatttgatgttacatctatatttttgtgatacggcccatcaaattttgtagttttgtgaaatttactctacgttgaaattgaaaattagcacatataaagctatacacaaaatccaactcacatacctttctgttattttctgtacaaaataagtatctactccttttgaaatcttaagtgtagtttctactaatttaataattccattttttttcaaaacataattgttaacggatgtggattcttaattctaacatggactttatctagatccaaaaacatgcatggtgctgttgtatcctttcttttccttctataatgaaattggcagagctcctaccctttctcctaaaaaaaaaatctaacatggactttgaattaataaatagaaagtcataatagatttggactaaaaactaataaatatgaggaaaactgtatttggtgtgctctttaatttcgacttttcttgataagataattggtatatttcaaataattgattgtttggttggcggccaaagtttgtcatgctagactttgagagtatcacagttaattaagctaagtcgtactcttattttctagcgaaagtttatcacggttaaggctaaaaaatatggcttgcttcacttatggctataatggagttgtggtaaagttagcctccagccaagtaaacccttttttatatcctccgtacaaatttgtacttggctttagaccttttttttcaaaaaaagtttaagatcaacagttaagaactactacagtattaagttgtatgattttatatttggaaccttactaatttaatcccaaactttgtaatacttcgcagtaactagccatttgctagtggcatatactcttcatctaatctaagcctttgtaatttgatcccgcctaaatggatgactagatttatttatttactatttatttgattaacatgggtttttttacataatgacaatcagtatagctgtacagatatcaagatatataagtaagaacagttcgaagtttccctgcatacgaaggatcaaattgacaaaatgacttgaattagcatgagtgtccatgtcctactctccaagtctccattgcactcgcagaagctaatattttagtattatgctgacttttgcaatagcacgcaaaaaacattgctatattttatcatgagatattatgtaatcaccgaatatgggttaagatgcgacgccatggaagctccactgtatgtcacgatcatcgtcagtttgtcactgattgtgctggatcagcagcgccaatggatgaggagtccataatggattagcttttggcgccccctctttgtcgcgattgtttctcctcttttctgatttcccccccgttgaacgtggatcacgcaattgatggccgatcttctgagctactggcacgcgattctcttgtctttcccgttcccataattttcccacgacatgagaaaaataagttattgtctaaaaaaaatgagaaaaatatgttctctattgacgaagctaagcctggcagcggataaagcagctcacacggatctaggggatatcagccgctcgcgtaaagacggccggccggtggtgtcccgttgcgtgccggtcgccgcatgatgagtcagcttcagatagatgatcctctctctcctcgccgtctcctcctgtccggtcgtttttctccgcttcgatacgcgggccgggcccccgcttttcgcatgcatctttcggccgcgctcgcgagcgcacagcccaaatattcccgtggcccatctcctcctccgtctcggcggtcttgcgcgaaaaccccgtcgtcacctacaacgaactaaccgcgacttccgcacggaaatcaccgagagaacaaagagccgcgcgcacgcgacgggtttgggtcgaaacggacgtcgttttcgcaaaagtacggggcttttccggcaccaccaatcgggcggggcggtgtgttacaggggaattactcgggtcaacacgatgttgggtacaagcaggaaagtttgggttggatagagtggtaactaaactgccatgtcagggacagatcgaccagtgagtggttgaattaccatgggctctctgatgatccgcgctaagcaacaacagggggattcccgtcactttctttcgttgttgtttttctcgataggctaattaacaagaatagattaggcgaaagaaaaagcgcgagtgggggcgcaaaagcgagccggcgaggataaggcccctccacaggctccccaaccgcatttgtttagtccaatccatcgtgtttccacgtggcgacccaacccctcggagtagacctgcgttccaaacagtttacaggtcgtctgctcgcggagtcgcggctcgcccctc

SEQ ID NO: 19102 - DNA, 6110 bp, Oryza sativa
cctcctcccaactcttgcttccgttttccgtgcccctcctgccgacaaacccacacctgaatagctcatcctcacctgatcagctgaacctgttggagagaaagaagttagttggccatctcgccctcgctagaaaaaggaaaaaaaagaaggaaaggagaaggaggagagagcttgctttgctgctgggttgttgctaatggtgttctactacaaggcgaggccggacgccggcgactacaccatctacatgggcgccgacaagaacgagaacgaggagctcatcaagtacggcctccccgaggacgtctggtacgtacgtacgtgcattctccgcacacgtactgtagtagctcgtcgtcgatcctcgcgtagcggcattgcacatttgcgtttgcgcttcgcgcgcgtacacacgtacgatcggctagtcgcacgcgtaggctcgcgatcggcagctacatgagaggtggagaggagagctcgccggcggcaggtcggcagctgcgaggaggaggaggattgaggctttgacgaggccatgacgaggcgtggtggggacatcccaacgcccccaacgaccaaactctactataaaagatgtctaccagatcgaccccgtctaggaggagtacgtaactgctcatgctcagcaacaagttgcaactctgtctgtagccatcgcctgccatccgcactagtactactacagtactactactgtgaccactaccacagccttttgtttgcttcctccatctaggggacctcacctcgatctccttgggtttccaatgcttaaaagtacttttctgcttaattcgtcaaattacgcctcatctgaaacatgtagagatatttattccgatccatgttaagatgaactatatagtgctgtaggaattttcttagaagtaagaacaaagatatatataaacgtacgactggttgttttgatggaaaggtcggtttaaagtggattcttcccttctaatttcgacaaggaaaattgcttttgtcccgtcaggttccacgtggacaaggtatcctcggcgcacgtctatttgaggctcaagaaaggcgagtcgatagatagcatctgcgacggtctgctggaggactgtgcacagcttgtaaaggctcattccattcaaggtacgcactcatttcagacaacatttgagtgtagaggtagcgcatagcttaattagctttcttttccaccatctgctttgtgtgcttgtggctagattcttttggtttctaacgatcaactagtaaattttcactcgtgcaaaaaagtagggtagatacagtttaccacaaaagattctgcagttacgaagaatttatcatggatagatgcaggttctcaaaagaaaaggaaacgtttacttgcaaataatgataatcatttgcacctccaattatgttatccacggatagaggaaatagagcatggtgtgacctgtcggatattcgtgtggcctacaattctacaaagctgcagcatcacattatattgctggttacagacaggaatcttaattttgtttttgcttttccaccccggcctttttcttttcagcaacttttagcttcttgtattattggcactagctacagtgggccccttggatcaattatccgcttgggttgatttggcctatgtgaggggattgtgtgataattagaacgtgacgagtatgtgtcttggatcactggatgatatttgcagcttgcatgtgcttgtcgtgcaggaaacaagatgaacaatgttgaggtggtctacacgccctggtccaatctcaagaagtccccatccatggatgtcggtcaagttggcttccataataccaggatggtaagctgctagggtggtctaacatcctcttctttgtacataaaaaatttacagcagcatatatatgctcataacaatggcaggtaattgatttctatgagggggttacaaggttagaaactattggtaaaaggaaggtccatgttgcagagagacacacacaaataccccctccaatcaaacttgctcgagtcagagccatgaattatctacttatggataagttaaatatcttgagaagtaaacataactgattgtttaaaacaatttatccaagcaatacaattgaagaaaattttacgagaaaatgtatttgtagaggcatatggagcaaataacatgagcaagttagttaggtagatgaaaagaatgcggcacccgtttcctacattttagaacagcaattttgtgacaaggtagttattttcacccaacatacaagtgcattatatgcgagacatactgtgttctttccggggaaaaaaatattgtggcgcattttttataatttaaataaatccaggctatatatatgtatctggctaggctcgctatctactactccctccgtcccaaaataagtacagttttagcactgttcatgtccaatgtttgaccgttcgtcttatttgaaatttttttatgattactacttttattattattagatgataaaacatgaatagtactttatgtgtgactaatttttttaatatttttcataaatttttcaaataagacgaatgatcaaaatgatgaacacggatatatatggctgcacttattttgggacggaggtagtattattatcttttaaaaaaaaactagtactactacattattaagagcaccaacaagccatcatgacatcaatggtaggggtctatcctccaaaaatatatagttatgcaataatttgatttcaccaacatgttaatatgttgcaacatattatgactagtgccactgtttcatcaaacacaattcaacaaaaatatcgcttaaaatgccatatacacgaagtactcatggtaccgaaaatattatttgtctggaaagggaacaaaatgtaaacagcagagtaatgtacaggctgtctagatatatattttttattaggaccaaattgcttaaacctgcattattgcgttcaacttgcttttgcatcatattttgatggagatacattttggaactaacagttgttgatatcttttggagttggcgtacattatcctgcccatatattatagaaaacgggttttatttttctgaaaaagaaaagaaaaagaagctagcgcctcttgtttccgaagggtcactggaaaaggccgccagctgattcgtcgaggggttggggtgtcaattccgcagatgcaattttgggagcatttgcataatcgatctgcacgggaacactgacagacagagagtgaccagccttgcaacttgcaaatccatctcttgttagccagccaccgcaagttgtagctgccgccgatcgatcagatgccagtgatctcctgtcatgctttcctttggcatctaatcgagatccactcatccaccaaaccagctgcatctcatcagcaataataggatgtgtcacgacgctggctgatcactgatgcatggcaggttcgcgtggtgatcgtcgagaagcgcgtcaatgagatcatcaacaggttgaacaagaccagggtagagcgccggcctgatctgaaaggtacacgcacgcacggacgacacgcatcgatcgatcgattgatcagatattcaggcattacacatacaattaaaatcgactaatccctttggcctttgtacgccgcagccgagaaggacgcgtcgaacgcggcggaaaaggcggagaggaagatgcagctgaaggagaagaggcggcgggaggagatggagaggctggagaaggagaggcgggcggagatacggagctacaagggcctcatggtcgccgagaagatgacctccaaccgccagatcgcctccgccggcaactccatgcaggagatggaggacgacttcgtctgatccatccatccatccgtccgaagccagcaaccgctcccgggcatgcgtgcgtgcgtgcgtgcgtgcgtaacgtacgtgtgcggccacgtgtttctctgtacatcatccatccatataagcgtgcgtgatcgtctcaccggtcagtctccctggaacggtttctgcagttctgctatagtagtggtagtagcacatctctgtacatacacatggtccctagcaatgggcacagatgagaaagaaggcaacgcgattttcggtatttcgatatttctacatgtcgtagtagtatttgccagctgagtgggccgcgtgacggcgccgatgcaaactctagttgatctgacagtattacgtgatcagttaccgactccaatgaacgtcaagtggtcttcaacatctttcggatcactcgtaggtattgctactcagcagtatttttctccttcgaccaacaggaaccaactttgtgtctacgttgttcactgctgatacgtgaacacaagatgttcaacagtcattttattcagctattacagggctcactgagacaaactaaattgaatcagaagaggagataacattaacacttaattgcaattctgactttctaagccaacttcgccagttatcacgagcgaagaacgggtaattttatcgggaaaaacaggggagtaccaattaccaagtgtacaacagaggaaaacggacgagaaggctaacgggcgaccgctcgctaccagcgatctttttttttttctttttttttcttttcctcttttaataagtttatgcacttaaagtttacacatctaaagtttgtaaagcgaatgtttataagtcaaaagtttatatactcaattcaaattcaaattcgaatttaaatactttatatttttctcttttagtaagtttatacacctaaagtttacacatctaaagtttatccacctaaagtttgtagagcgaatgtttataagtcaaaagtttatatatccgattcaaattcaaattcggattcaaacattatatgtatgtaatatttctatacacaaagtttatgctgcaaagtttacggtataaagtctatgcacatgaatgaatattagattttttttcctaattttcttttactaattttattttgaaatttatgatgtaatagaaaagttaaaaagagagatgaaagaggagtattaggagggagggacgggtgatcgctaggaggagagggaagcaatcacccgcccactagcaatacccggaaaacggacgtgtatgaatgaagaaaaaagcaaggctacactgccataggcccacaataattttggtcctttaggcccatgctattagcctgataatctctttagaataggatgacagcctgcttcatcaagctgggccaaaaatctgaacagcaggactgcgataataacatgctaaccatatgggcttgtctagatgatgaatacaggcatacagcagtacagcctccacgttgtcaaggaaaacttcgcaagaacatgtcgcgaaaactgaacggaatttgttcatggagacgccggtcgccaggacgggcactgccacggtgaacgcagttctgagcgccattactggtcaccattgatgcatccaagtgggtaatcaagagagatagataaagttagtcgtggctttctatgggcaggcaaggtgcatgctcatgacggttgctgctgagtgccgagtcgcctgggctagggtgtgcgctccgacagtatggcgacctgggaataccaaacctcggactaatgggcatcgcactccgttcgcgttgggcctggctgtggcgggtatcttcggataagtcctggcaaggattaagcgtaccttgttctcttaaccattcacagtgcaagcccgggttagaaaggatcacgaggtgacacataggatgaagccctttaaaaacattttctccacggatcaagttaccttacagtgagacccacaaatattttacagcatttcattctcttgcatcaaatatctcaccaaatgatgaggacgtaactagctcggtgtcggtgacatgggatcaggagtatcatgactagaggtttgaggcagacacaatcgcacacgtggcctggtacccccgagggacgtcgggcccgagggtgatgcgttcgccctccttttagtccccccgaggggg

SEQ ID NO: 19103 - DNA, 5032 bp, Oryza sativa
  unsure (1)..(5032): unsure at all n locations
nnnnnnnnnnnnnnnnnnnnnnnnnnnnnnnnnnnnnnnnnnnnnnnnnnnnnnnnnnnnnnnncagagatggcacgttagtcctggtcagatatatgccaggcttcatcctaaccattacaggcaagatgttgtgtgaagaagggtgagcatgtaggttgctaagctgacacgtggtggacaagaatgaccgacgtgactggtctgataccggtcatgtcgtcagcagacagccacgattccacgtcgtgcctgcttccggcggaagtggaggtaggtatgggccgtcccatcagaaggtcattcggacggcaaccatacaagtctccgtctgtttatgaaaaggtggggtaagtcccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatctcccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcatctggcgcgccaggtaggggactctgcgagggattttctgagctctcgcactctttcgtgtgcgccaagcttttcctgttcagcccaatggccgagccagcaaaggcgcacgacctctccccgagtatgagcggtgacgacggggagccaaacccacgtcgtcgagctcgtactccaccgccacctccacgccaaagtcctaggcgggagaaggcacttgagagggccgaaggatccgcgacttcgacatccacaggaggtggagaagggcggcgagatgaggagcgtcgcctcctcgtctacggcaacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcagtcctccgccaccaaggcctctggtgctgctgccaccggctccgcatcgtcaagacggagggcgcggcgagcggcagccgctgttcgccattcggccgccactccttcgtcaatggctccgacccgggaagatctgcgtggggaaccggatgcccgcatcagtatcgagcgtcggcgtaatggccgacgtgctccccacgcaaaggagggcgcctcctcgtccggagtgtcgcctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttctcatggccctgaaaggacaggcgcggggttggctaatgaacttgccacccgcgtctgtccactcttgggaggatttgtgccaacagttcaccatgaactttcaaggcacatatccgcgcccaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccaaactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaaggacgaggccggcgctcccaacagggaacgcccaaccggcaagtggtgcaccgtccacaatacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcaatgatgacctaggtttccaagagcctggggccaccattgctaccgtcgatgggggagcgtgtgctcacgtttctcgccggagcttcaaggccatgaagcgagagcttctggccacggcccctactcatgaggcgacgcgccgggcgcggtggtcggaggttgccctcaccttcgaccagaccgaccacccaccgtgcgttgcccggggagggcagattgcgatggtggtttctcccaccgtttgcaacgtgaagttggggcgtgtcctcattgatgggggagcggccctcaacatcctttcccctgcggcctttgaagccatcaaggccccggggatggtgctccggccgtcccagccaattatcggtgtgacgccggggcacacgtggccgttaggtcacatcgacctaccggtcaccttcggtggatccgccaacttccgcacggagcgggtgaacttcgatgtggcggacctcagtctgccctacaacgcggtcctggggagacccgcgttggtgaagttcatggcggcggtccactacgcctacctacagatgaagatgtcgggccccggtggccccatcactgtccatggcgacctcaaagtcgcgctcgcttgtctggagcagcgcacggaccacctcgccgctgcatccgagcccgagggtggcgacaagaggcttggcgcctccgcccccgccaccccgaggcagcggatgatcacaggcaacgaggtcccggtcaaggaggttgccctgggcgacggcccgtccaagaccacgcgctcgtctccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaagccggattcatccgtgaggtcatccatccggagtggctggcgaacccggtggtcgttcccaaggcgaacggcaagcttcggatgtgcatcgactacaccgaccttaacaaggcatgtcctaaggatccttaccccctgcctcgcatagatcagattgtcgactccactgcggggtgcgaccttttgtgttttctatatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtagccaattaggacgtaatgttgaggcttatgtcgatgacatggttgtgaagacgcgcaaccaggaaatgttactctcagatctagcggaaactttcgagagtctccgctccgcccgcataaagctgaaccccgacaagtgcgtgttcggtgtacctacgggcaagcttctcgggttcttggtcactgcccgaggcatcgaggccaaccccgagaagatacgaggctatagagcgtatgcgcccccccagcaaacttagggatgtgcaatgcgtcaccggttgcatggccgccataagtcggttcatatcgaggctgggaaataaggcgttacccctatttaagctcctcaaatgttccgggccgtttacttggacggaggaggctgaacgggccctcactcagttgaaggcgtacctcagttctcccccggtcctggtcgccccgaaaccagatgaaccgttgctactttacctagcggcaaccccgcaggtggtcagcgcggcgttggtcgtggagcgcgacgaggacaaccctcgctccgcgcacccccaccctgtatcgactcgacccgggagagagcaaggaggagagggccccgagccgaacggcggcccgaggcccccgacggccggagctggccctctgcccgcttgtctgacggtgccaggcgcccccgaccctcaggatggccccggggccactgcgggaaggccgcgcttgtcgccctctgaccccgaggtcgtcggcacagaagccgagtgcgccccgcgcggcctctcggacgaagagcaccctgtatcgactcgacccgggagagagcagggaggagaggccccgagccgaacggcggcccaaggcccccgacgaccggagctggccctctgcccgcttgttcgacggtgccaggagcccccgacccccaggatggccccggggccactgcgggaaggccgcgcctgtcgccctccgaccccgaggtcgtcgacacagaagccgagtgcgcctcgcgcggcctctcggacgaaaagcaccctggagatgcggctggcgaagaggatcgccccccccgaaaggtgcagcggcccgtctacttcgttagtgaggccctccgggacgccaagacccgataccctcaggcccagaagatgctttacgctattctgatggcttcgaggaagttgcgccattatttccaggcgcatcgggtcacagtggttacgtcttaccccctcggccaaatcttgcataaccgagagggtactggacgggtggtgaaatgggcaatcgaactctct

SEQ ID NO: 19104 - DNA, 2510 bp, Oryza sativa
  unsure (1)..(2510): unsure at all n locations
agactctacccgaggaccgcgaagggagtgaacgcgtccatcgcatctccaaacgctacgtgctggtagaagggaccctctatcggcgcgcggctaatggagtcctcctgaagtgcattcctcgggaacaaggtgttgtgcttcttgccgatatccatgaagacgaatgcggagcccactccgcctcacgcaccttggttggtaaagcttttcgccagggtttctattggccgacggctctcaacgatgcggttgacctggtccggcggtgcagggcgtgccagttccacgccaggcaaccccatcagccggcccaggccctgcagaccatacctctttcatggccgtttgctgtctgggggctcgatatcctgggtccgttcaggcgggccccggacgggttcgagtatctgtatgtcgctatcgacaagttcactaagtggcctgaggcttatccggtcatcaagatcgataagcactccgcgcttaaattcatcaggggcatcactgctcggttttgggtgcctaaccgtatcattacggataacggcacccagttcactagtgaactcttcggtgactactgcgaagacatgggcatcaagctctgcttcgcctcccccgcccaccccagaagcaatggccaagtggagcgcgccaacgcggaaatcctcaagggcctcaaaacaaagaccttcaacatcctcaagaagcacggcgacttgtggatcgaggagctgccagcggtgctctgagcaaaccgaaccacgccaagccgagcaaccggggaaacgcctttcttccttgtctacggcgcggaggcggttctcccatctgagctcaccctgaggtcccctcgggccaccatgtattgcgaggctgatcaagatcagcttcgcagagacgacctcgactacttgaaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggcgtcccccggctgggatccgttcggctggccacgggcgacggcacagagctgcctaactcgtggaacatcgaacaccttcgtcgcttctacccctagtgggggtcgggtgtcaggtctcgggctcaggccaaccccgcacccccccgggcgtgcagggttggccgggggctaccacatacagataattgtcttttttctcttccgtatttcaataaaagcattttcggtttcctaatgactgtgtttgtgccattgtttccttttgtagaatcttgactttaattagcacgctcgtgctcgatcctgccctcggtggcccgggccggctaaaatcgccaaaaggggcccagaaccgagccgtgccccggggcgtgatgaactccgggggggaatcggcaaaggcccacaatcgggtcatccataaccctcggtcaccacgctcccggcctggccagtctcgacatgtggatctccccaggcactagctccggcccgcgccgtttgaggctgggacccgggcacgagcccttgttcaagccaagacacagaaggaccgcggcacagaccatcctcgtctcatacacacaacaaatagaattgacacagaaatttcctctttatttgattgcagattaaggtagtctatacaagaaggggacccgaaggcctctgaagaagaaataaaaaactatataagattggcatgggcctgggggctcattccgacgcgcccgggtcgccggcctcatcgncgctgtcgcccgcaccgncgtcacccgcctttttgttggagtcgagggcgaacgcgagcccggggggccgtaccctcgaagctgtggacgatgtggtcggcagcgtcccggacctgcgcgcgcgcatcgtccttggtcccgggaggaaactcgtccagcgctgccccggggagaaagtcggggtccctggcctggtagcttgccagtacgagctccaccgcccccggggcgaggtccctcgagnatgacttgatcgtctcctcgagctcctcgggaagccgctgaagggtcccggccatctctgagaggcgctgggcgaggcccccttggttggcggcatacttcgcagtccgcccgccccagaggcccgcctgccgcccggcgcggtctagacgggagacagcgccccaaagcatgccgggccctacctcgcctgccaagcggagggcttcgacctccccggcggacgagtccaacgcgccctgcagatcggcgatggtgtgttcggcagctgcgaggcgggcggctaggtcgctgtcgcccgcggccgccccgccgctgcgcgccctcgcgtccagctccttcgcccgcgcctcgagctcagtggcccgctgatccagtgcggccctctcggcgcgggcaccttccagat

SEQ ID NO: 19105 - DNA, 1809 bp, Oryza sativa
  unsure (1)..(1809): unsure at all n locations
nnnnnnnnnnnnnnnnnnnnnnnnnnnnnnnnnnnnnnnnnnnnnnnnnnnnnnnnaaaaaccagaggacaaaaagaaacgggtgagtgaaaacttgccttgggagatgggagaatgaatacggccgcagtgggcgcggggacgaacctgcgaggaggtcggctaaacgaccaccttgggggagagataaggtttccccggcgtggttcggtctcccccatcttgcggcgccgcttcttctttcgctccccctcgggctgcgacgtcggcacggcaccatccaggcgcctgctgctggcacgcgccgccccgccccctcggggaggagatggggaaggggtaccctcctgcttcctcttcccccgggcgtcggcagggtggctgcaccccgggcccccatcgtggggcccagaagcatgaccccctcccagggtagattgttcccccctgcggctcccgcccgcgccatcgtgacctcgaggagcccgctcctccgacgccccgaccgcctacatgatggtcaggatgttggcgcgatctggatcgctgcagagggggaggactccttgggggatgagggatgcctccacggagctgagattcagcacccgttggaccaccatcttgaagtcctcaggggcccagtcccatctgcccccctggtgggtcctcatgtagtcctcggacccggtgtactcccaggcgccccgggcgcgccgctggagcggcgcaatctgacgatgaaggtagtcgccgtacaccatggcccctgtgagcccctgggatcgcaggcctgccaggcggtcaagaacggcgtcgtagccgtctcccagatctaccggcgcccgccagctgaaggcctgcgccgggggctggctcggaagtcggaggcgcgcttcgtcggcgaggggagtgtagaaccagtcgctcttccagtcgtcccactttttgcggagggcgcagggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacagaccgctccgggtagtctggcgccgggcgtccctcgcccagcgtgactatctcccggccggtggcagattccggcatgaagcggcgcggcagcccagcctgcctctcgctcacgatacgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacaaatcccttcctcagtgcctttatactcttgccaacgctgtgcccggctactcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtnnnnnnnnnnnnnnnnnnnnnnnnnnnnnnnnnnnnnn

SEQ ID NO: 19106 - DNA, 797 bp, Oryza sativa
gcccacgccgcgtcgagctccgtccgctatgctagcaggacctccatctgggcacctagctcgtccagcaccgtggtgttcgcggcggctaaggcctgcaggaggggctccgcgttcagtggggcagcggaaggcagaggggagagccgcctcggtatgggcgccgcgcggctcggcccgccgatcgacgtgccggacccaggggcgacccccgaagctggctcgtcccaaacgtcgcccgaggggtcgggcccgagcggtgcgcccgcgacctcatcgtgggtggcctcggaagtcatcgtcgcctcgggcggagtcgggtcgggggtttggcaggccgcttggcgtgcacgcgccacctccgcctcccgaacggactcctcggcccggcggagtttggcctcctcccgagcggcttcctcagcctggcgaacccggacggcctcctgggcagcttcctcggcttcccggaggcggtctgcggcttctcgccggtcagcctcccgcctccgggcctccgcggtcgccgtctcctcggcctcggactgtccggacttggaatgacgggaggagcgcgacgggatctcactgaggcagaagaaaaaccagaggacaaaaagaaacgggtgagtgaaaacttgccttgggagatgggagaatgaatacggccgcagtgggcgcggggacgaacctgcgaggaggtcggctaaacgaccaccttgggggagagataaggtttccccggcgtggttcggtctcccccatcttgcggcgccgctttttttttcgctccccct

SEQ ID NO: 19107 - DNA, 3062 bp, Oryza sativa
tgttttattcttaaaacctgcttacaactaaaaggtggaacggatggcctgggttggcttgggacgagctgggacccagggtcgggttgccagttcggtctgaatcatcgtaggccttgggttaaggcaggctcgtgtgggttcacagccttgtttaataatattgtatagctctggaaacgtgtttacaaaatagctttgagcaactaagtgtcttttaaggctgtttactgcaaaccctaaccctttatatcataacccccttgtactcctttacatttatcctgcacttgtgggtgtgtcttgttgagtacggtggttgtactcagtcttgctcaatttttccaaacccagaagaggagtccctggaagatgaaggctttggtgtctagctcgtgcctgccgtcaagcgcctgtggtcgtcgccctagtcttctgctgtttctcgtttgtctttgtgtgtgctgggccctcgctgcccatgtaataaattaactatttacgcttccgcttgataaactgtgaaatgtatcaacttttgatgtaccttgcctcctgggacaaggaataatacatgcacgtaaggaatgcccgttgggttaattccggtcgtgacacttcatataacaagcaggaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaatttaaaaatggtttattgcgtcagccgaggggaggggcgcgcggaccgggtccacgggagtggggcccacgcggcagccccacggtgcacgggggaccgggggcacccggctcacaccggccggcgccgtgggccccacgcgtcagccacacccgagggcgcgggcggctgacggccgggcctcacgcggcagccactcggcgcgcccggaggcggccacgtcggtgcggacggagggaggcggcgcgcccgcgcccctatggtcgccggcggcggccataggcacggcggagcgggcggccgagagaggggagggaaagggggaaacaaagcggcggtccacggctcaccctaggtcgacggcgacgacgaaaaaggcgaccggagcggaggaaggcggcggcacggctcgggtcaacggggtcggcggcgctccgacggtcggcgagctcggcgagggggtggacggggtcgacggcggtgcggcgaagccggacgaggcgacgccggaccaggagacggtcccgcgagctgagaaggccggccggaggtcgtcagcgacggaggagagagagggcgacggcacgagctcgattccggcgaggagacggtgcggcaaagggtgaaacgggcgaaggaggtgcggggagggtttaaatagggttggaagggggagaggccggccgggagaggaaggaaaccggccgggaggtccggccgccatcaatggtgccggcgagatttgcgggagcaaatccgcccgtttgaatgcgagagagaaagagggagaaatggggggaaagggagaggggatcacggggaatgattccccccactttattgcacgcggggacggcgggaggcggcgggattcgcggcggcggcggcgctaggcgcgggtgagccggcgggagcggcgggaggaaggagatgacgggtgggccccacccgtcagcgagggtggcgggcgggcccgcccatcagcggcgcgcgcgcggggaggggccgagtgggccacgggggaagaggagagatggggagggaagtgggccgagccggcccaagagagggagggagggttttattgtttttctttttataaaaccttttcaactttgtttatttcttaacaattattatttgtgctctgaaaattccactaaaatttatttacatattttaggcttttaggaaatatacaaaaatcctccaagccttatttgacttttaactttgcacattttaatttttggaggctttcacaaggattttaattattctaagcataatttaaaggatatattttagggtcattttgggacgtgacatggcagcaacctgatcttgggtcaaccgattcgcaacctgcccgccatgttgtggctgctctctcattaacaaccgagggttcactggctggcctggcgccattgctgatggagcaggtaggggagttgatgccagtgccgtcggctgagatgttggtgcaacagagggaaccgcctgagttgatggctgaacatcggtaatcaaagaccgataatttggaaagacacctccttgcaaataaaccgggcctacaacctgatgctcagctattgaaccatcggctatggacttcatcatgtttgataaggtattgactaacaccccagattgattgatcaaagcatgatgcacagcgtagtcaacccgatcttggaaattactgaaaaaatcttgtgccgtatcactattctgattaagatctcctccttgcaacccctgggcaccaccaccttgaactccatgcaccccgtcaccttgcactccatggactccttgagaattgtcaccttgatttcctagagagctgtcggtagcacctttgttactcagctgagccgagccgtcttcttaactccagtgcaggtccaaagctcaccttcgaatgtatgagcgtgccagttgatttgatcctgtaatcaacaagaaatagaagcaaagaaaccgcagttaaatctataaatgatatcctatataatctaagtcaacatcggtatttaacctaatcggctgccttctattgacggatgttagccgattgtaggttggatatcgatattgccaaggattatgtaggatatatgataactcgacgaattacataaacaagattagagtgtcataaagatggaagcactaatcccaagaacgcaagccgccataacaagttttacctcttgttgaagatcgaaaccgatgcagctaaacagaaagcaagaactcgttgaaata

SEQ ID NO: 19108 - DNA, 775 bp, Oryza sativa
agttcatggcggcagtccactacgcctatctccagatgaagatgccgggccctggtggccccatcaccgtccatggcgacctccaagtcgcgcttgcttgtatggagcagcgcgcggaccagctcgccgcggcgtccaagcccgagggtggcgacgagaggctcagcgcctccgtcccggccgccccgaggcagcggatgatcacgtgcgacgaggtcccggtcaaggaggttgccctgggcgacggcccgtccaagaccacacgaatcggtggtcttctggacgacaaataggaagacgcgctcgtctccttcctgcgggcaaacgccgacgtcttcgcctggagaccggcggacatgcccggggtccccagggaggtgattgagcaccgtctcgccgtacggccgggcgcaaggccggtccggcagaaagtgcggcggcaggccccggaacgtcaagccttcatccgcgaggaggtggcgcgacttctggaggccggattcatccgtgaggtcatccatccggagtggttggcgaacccggtcgtcgtccccaaggcgaacggcaagcttcggatgtgcatcgactacaccgacctcaacaaggcatgtcctaaggacccttaccccttgccacgtatagatcagattgtcgactccaccgcggggtgcgaccttttgtgtttctatatgcatactctggttatcatcagattcgcatggctagggaggatgaggaaaaaactgcattcatcccccccataggaacttattgt

SEQ ID NO: 19109 - DNA, 1067 bp, Oryza sativa
ccgccagagaaaattgattatcgctggcggccgataaccgctagcgaagattgatatattctctggcctttgctttgtggcggctgcaatttccgccagggaaaacccaaaatggccgccacgaaagatgattttcatagtagtggcaagaggacaatgtctggatatggtccgagattgattttccttccccaaccacaaaacaaaatacaaagcctttctcaattgtcaataccggttaattttgtgcccccccagcctagttgatgattaaaatagcccatacaatacatggtttcatttttgttgattcgtaagtagtacatgtaagagacaaatatattgaaaacaatgcagacacgattttataaaaaaaatgtaagataaaagtcatttcaatctctcaattcattaatttcttggcacatcataaaaaatgctaacatgacaccctatttaataagaatgaaacaacaagtgggagtggccttaataaaataataatttagtagggcgcacatgttaatgagacccactccttcatcgccccaaagtcgagcacgtcgctcgagctttagcacacgtgaacaagtgactgctaggggcacgcgctgtgctgagagggaaagaacatcataggaggaggaggaggaggagatgaggcatacggaccaggaggagggggtagacaccggtgccacctatggcgatgatgacagggcaagctagaggtagtgggcagcgatggtgatgatggaggggatcttgatggtaatggaggaggaggctatccggtggccaccatatttgcttggggggacagtggtggagcatgtggagctccgtgcataggaagctgaggagattgctggcgccactgggtcatcacctagccctaccttcattgctgcatctctacctccatcgagagccaccactacctctagctacactgagcattgttgtcgcttgcttgaactcctcatccttctccatcgagttgcatccccagacaaaatgcaagtaaacatggaccaaaagtgatattggtgagacggataggtgag

SEQ ID NO: 19110 - DNA, 2366 bp, Oryza sativa
  unsure (1)..(2366): unsure at all n locations
nnnnnnnnnnnnnnnnnnnnnnnnnnnnnnnnnnnnnnnnnnaagataacaccgttcgttgccgccaccattgttccaatgcatgaccttcgtcctcttaatggcgttgccctagagtcacatccaatcatgagtcatgactatcctcgcacactcctctacaaacaaagagagagggaagggacggaagaagtaaccctcgttgacatgtgggcctctcaaacattttttatttttgagtgaatagcaaattgggccatattttattacccaagtctcactttataccacccgtaaacaaatctgatcaatttggaccgagtaactttgttatcttttgagtttggatcacccccaaacaatttcttcagtactcatcaagaatctcaatcaaatcaattttgatacaacgttgaacttccccgtctatatgcaggtaatatattcagcagcatggtgggtggatacaaatagtaaagagagttaggtggtccaaaccgaaaatatggtaaagttacccaggtccaaagtgaaaagattagtttatggatggtccaaagtaaaacttaggcgataaaagatagattagactgtacttttttactttttctctaatagttactactgtaagtaagcgccgcagctttggcaaatgaaaaatgggtcgatcacatcaggcatgatctgaacttgacattggttcaggaattctttgcggtctaccagcttgtttggagcagcgaactagcattatcagaagggactgaggacacggtcatttggagatggatgaatactggcaaatacacagcaaaatcggcatacatggcccagttcgctggcagagaggaatcaagggcagccaccgtgatttggacatcatgggcactgtccaagtgcaagaattttgcttggttattactgcataacagattacggacagcggatcgattgcaaatcagacagtggccaaattgttacttttgtcagctttgctacagaaacctggaaacggcgcagcacttgttcaaggattgcccgttcacacgagaggtctggaacagagtagctgcgagactggaatgcagtcaattatttctagcgcacaatccagaggagaagctgattgaatggtgggaaaagaggacatcccagcaggacaagagacaaacaaagggattgcgatcgctacacgtgcttctctgttgggaagtatggtgtgaaagaaatagacgaatcttcaaggataaataactctcaatgcttcaggtggtggcgaaggtgctggatgaggtccagttatggtctgtttgtggggctaaagacattgtgagaatagcacattaaaactatacgttgtggcaagctgttttttttatatactttgggtgtgtttagttcacatcaaaattagaagtttggttgaaatttgaacgatgtgacggaaaagttaaaagtttgtgtatagaaaagttttgatgtgatgaaaaagttaaaagtttgaataaaaagtttggaactaaactcggccttcctcttccttttcctctctaatcaccgtgggtgattatgtacagttcttcctctgcttaatataaaatcagctcaggctgacttaggttttaaaaaaaaaagtaagcgccgagtcagtgcaaacgagggagttaaattgatatggttttgtctgtcaaggtgccgtttctatggttggaggaggaaaatgaaattaggggaatagaacagtcgcaatccaaaagctattgttctctcttctacggtagttgatagttcgatacgtgtgtttgatgtgagagactgagaggagtgcacggtgcacctgccccgtaaggacgcggaactacattatcagaggctaggccggtactgttatacgcgacgttcacgaatcacgatgcgtaaaaaagtgaagcatgaaacagtactaggctctccacgggccacatcatgaaaaaactggtgcgacgccacgcttaacaatttgtcggtcgtaaactcgtaaagttaaaagccccacgacattgtcaaccaatatctcagcacatgaacttctctaacgagtacaacgaaaccgcatccgcaaaagcgccgtgaaccaaagctcttgccgtgctgtgccgtgccggtggccgtgaacatgtggaacacgaagaactcttgcgcgagatcggagcacctgacctcccacctcgcgtccggcccgtcgccgtcgcagcaagcgggctgtcaaaaacgacgccacagcgcgagcgctctcgccgatccggcggacccacccttctcaccttgagcaccaaccgcccgttcggtagtccgatcccccacccctcataccccctacgccttgc

SEQ ID NO: 19111 - DNA, 10087 bp, Oryza sativa
aggggggtgagccatgatggagtcgggggtcccgccctgcgccgcgtgcggggacgacgcgcacgccgcctgccgcgcctgcagctacgcgctctgcaaggcctgcctcgacgaggacgccgccgagggacgcaccacctgcgcgcgctgcggcggggagtacggcgcgcccgacccaggtgcccccgcgcgctgcgggttactgttttgccctatgcgggattcgatcgatgcgggggatgaagtagcagtttctgacgaggttgatctctgtcacagcgcatggccagggggcggtcgtggaggaggaagtggaagagagccacgagccggcggccggcggtgttcgcgagagggtcaccatggccagccaactcagcgatcaccaggtgaatagccctctccataaactcgtgcaattctgggtagaacagcttgagcgctccgacgttgttgacaatgttgtgtgggattttgtgggaacaggatgaaggagttcatgccaggactatgagcacccatgccaggacaattagcagtgtctctggagttgggagtggtaagcaactcgtctcgttgtctgtcatatttttccttgcattattccaactgagtactgatatatatatatatatatatatattttcacttgttatggatttgaagaattgaatgatgaatctgggaagcccatctggaagaacagggtggagagctggaaggagaaaaagaaagagaagaaagcctcagcaaagaaagctgcagcaaaagctcaagctccacctgttgaagaacagattatggatgaaaaagagtaaggaacatggaaccatttcatagatccatgtgatccatcaaaaacttaacatttcttgattcatatacattatttacagttacaaatgaaaattcttgtgtatattaaaatatatctgattagatcaataggctaagaatactcttgatccttgttgacatataaaaaaacaaactttatggtttgggtaaatttagaatctggctatatctaaccttttctttgaatgtactagatgccagatcatgtgcatttagaactgaacttgttgtcttatgcagacgttattcgtttagaactgaactaataaatccctaatgcagatattatctcacaatgctaaaatataaaacgtctaattggattactacagaaaaaccctttagctaatttcgagatcagcatatgtagtcaatcttaagttcttaacacatcatatttcatacttcattaataaggtttcattttggtgcagcttatctttttctggtataacactaggccttcttattttgtgatgcgaacagtacatgttcatctttgttcctccagtatactatcctagcctattatgcaacctttttaacttcgtgttcatatcctgataatgtgccagtaaagtctcagtttcagaaactcttgttacttcaggttttaaatgctgattgttgacataacactgtacttggagaattgattgtaataccaagcaatttgcccttttgcagcttgacagatgcatatgagccactttctcggatcattcctatatcgaagaacaagctcacaccttacagggcagtaatcattatgcgtctggtagttctggggctcttctttcactaccgtatcaccaaccctgtttacagcgcctttggtctctggatgacatcagtcatatgtgagatctggtttggattctcctggatcctggatcagttccccaagtggtgtcctatcaatcgcgaaacttatgttgataggctgattgcacggtgtgttcgctaaagcctaatttgtatatgaaaactatatacattactattcattaagaatttgtgtctcataagctgcattgctcatgtgttgtttcagatatggagatggagaagattctgggttggcacctgtagatttctttgtcagtacagtggatccattgaaagagcctcctctaatcactgcgaatactgttctgtccattcttgccgtggactatccagttgagaagatttcgtgttacgtgtcagacgatggttcggctatgctcacatttgaatcacttgcggaaacagcagaatttgctaggagatgggttccattttgcaagaagtactccattgagccacgtgcccctgagttctacttctcacagaagattgactacttgaaggacaagatacacccatctttcgtcaaggagcgtcgggctatgaaggtagataggagtttatacagtttgatggtgctctttatgttatattgtacttttgctaatattaaagcaactatcacattttgtgcagagggattacgaagaatacaaggtgaggataaatgctttggttgctaaggctcagaagacacctgaggaaggctggattatgcaagatgggacaccatggcctgggaacaaccctcgtgaccaccctggaatgatccaggtaattcagttttcattaccaaaacatcaatcttggatatttgttcttgtattcataccgggcaaccttttacagatttgcaagtttgtaattctcacctgaaaacgggatagtttctggtgtacaaaagttaagaataaatgaagtttaggttgccacttggagtagagattctattgacttctgctttgaaacaaaatatgtcaagtgttaactattgtttgcatgcagaaaaccaggagagaaagtctaatcctatgcagttccactttaagattttcgcagataatatatgtcatacaacttcaattgattatcgatatgctcattcttgttgtccaggagattgtgcataaattctatcctactcttcaggatgcagttaattaaaattatgtcattagagtaactcaaggttttacagatttattagtaaaatggttcaaatgttttgtggagccccctctctctcacacactcacatatggctttttatacttgcatcaaaaccaagacatagataacatgcagacgatagcctattcttcaaacttacacttagcataccactggctttttgtaacaggttttccttggtgagaccggtgctcgggactttgacggaaatgagcttcctcggctagtctatgtttcgagagagaaaagaccagggtaccaacaccacaagaaagcaggggccatgaacgctttggtaaaaatagctcctagagaaaattacacatatatgtattagtttaaagtatggcaaacttatcatgtggatatagtaattgaaagtttggtcacctttctaatttttcaggttcgagtatccgcagttctgacaaatgccccttacattcttaatcttgactgtgatcactatgttaacaatagcaaagctgttcgtgaagcgatgtgtttcatgatggacccttctgttggtagagatgtctgctatgtccaattcccacaaaggttcgatggcattgatcgcagcgatcgttatgccaataggaatgttgtgttctttgacgtaagtactaagagagtgactatgtattgcatgactattatctttacccaatttatatattcatacttatcatctgcaggttaacatgaaagggcttgatggcctccaaggtccggtttatgtgggaactggttgttgtttctataggcaagcgctctatggttatggaccaccatcactgcctgcgcttccaaagtcttctgtctgttcatggtgctgctgctgctgtcctaagaaaaaagctgaaaaaagtgagaaagaaatgcatagagactctcgacgtgaagaccttgagtccgccattttcaatcttcgggaaattgacagtaagtgcacaaacatggagagataaaagtagttcgaaatttgaataattttgtgttcattataatgtggtttgttttgcagactatgatgagtatgaacgctcgatgcttatctcccagatgagctttgagaagtcgtttggactgtcatcagtgttcatagaatcaactcttatggagaatggaggcgttcctgagtccgcaaacccatctacactgatcaaagaggccattcatgtcattagctgtggatatgaagagaaaactgaatggggaaaagaggtgttaattctccccttattatctatacctttgttgaagttcattcctcctaaaactcaaagcgtgatttcttggttctgtcctgtcatagattggctggatctacggttcagtcacagaggatatcctgactgggtttaagatgcactgccgtggctggcgatccatctactgcatgccgataagacccgcgttcaagggatcagcgccaatcaacctttctgatcgtctccaccaggttctccggtgggctctcggttccgttgagatcttcctcagccggcactgcccactctggtacggctacggtggtggtcgtctgaaatggctccagagattgtcctacatcaacaccatcgtctacccgttcacctctcttcctcttattgcatactgttgcctgcccgccatttgcctgctcacaggcaaattcatcattcccacggtaagatgcctgtctctatacatgtttttggtttgagttctgatgttgaacattgcttagtgacattattcatttgtcgttcttaatttcagctctccaacgctgcaaccatatggtttcttggcctcttcatctccatcatcgtgacgagcgtcctggagctgcggtggagtggcatcggcatcgaggactggtggcgcaacgagcagttctgggtcatcggtggcgtctccgccacctcttcgccgtgttccagggtatcctcaagatgattgctgggctggacaccaagttcaccgttacggccaaggcgacggacgacaccgagttcggcgagctgtacgtgttcaagtggacgacggtgctgatcccgccgacctccatcctggtgctcaacctcgtcggcgtggtggccgggttctccgacgcgctcaacagcggctacgagtcctggggcccgctcttcggcaaggtgttcttcgccatgtgggtgatcatgcacttgtaccccttcctcaagggtctcatgggtcgccagaaccggacgcccaccatcgtcgtgctctggtctgtcctgctcgcctccgtcttctccctcctctgggtcaagatcgacccgttcatcggcagctcgggacccaccaccaccaacagctgcgccaacttcgactgctgagcgacatttgtgctccaggagcatcccgtttggcggtgttttgccggtattgcaaatgtgtgtatctaatgcgacgaagacgatgggtggtttcctctctctgggctttgtcctcgatctgagaggtgttgtaggttagtactccgcatgaaaatgttcattgtattgttattgtctgtgatataagaagttttgatgttgaagccgctgaaactatgagagggcaccgttaaatccgtttaatcatacttgtagaaaaaagagggggaaagaaaaggttttcttcggtgaacttgaaattggactactgatcagtttgtaatgttatatgactatatgctactgaatcttatcttatgcgtagcctcctgcagaagagaaaaaaggtacgccgttgtcttgcgaataatagcaaacaagattttgcttagccttcaaaattccctagctaccatattcttgcactaacttttcagcaccagcttttcggctagtactgtattctttcatgataaacaacacccttttcggctagtactgcatcctttcatgataaacagcactaatgactgctaattcgagcacgcttccttgcctttgcatcttgacaataatcaatactacgacctaattgccacgaattagtactactactcctactgatagaagaacgtagataaattaatctaccaatcagcaatgtggtgcaaggtgtgactggatgatgaccatgtaaaataagatttgattgtttacatgggcaagcttatgatagtttgctgtgtcgacctgactaacttgagttggaacccatggtggcccgtgctgtcttgcatagacgtagggacacgatcgaggagggaatcaacaccttccatatgatgctgttgcaatcatggatgctcattagcggcgatcatcacatcggaaaattgtcatcacaaagcgtggtgaactgtatatgtacttagagcaggtacagtagcaggcataagccagctataaacatatttaaaagagataaagaaagagagaatagcagcgggctacagatctatagccagctgcagtacggactccaaaacgtaatgtatgtatgacaggtaggaccaggtattaatagtatagtgagcaactattatatgaattagctattacattggctatagatgatttggagctagcagtgagctatactattgaacttgctcttagagcaggtacaatagcatactataagccagctataaacatattttaaagagataaaggaagagagagaagagcagtgggctacagatctgtagccagttacagcacggactccaagacgtaatgtgtgtatgacaggtgggactatgtattaatagtatagtaagcaactattgtataaattgtctattacattggctacaaatgatttggagctagtagggggctataccattaacctgctcttatgcaccaacactgtgaaacttcattttccaaggtacatcaagacactcagtacgtcacagtactcgattgtatctctactactataaccaatgtatcgtggtcgtccactcgtctgttgtgacttgtactacaagtgtagcgtggcaaagcagtgaaaatctgacttcagggtcttcaggcatcataccattcgagtagcagaatacgtgtagatatacagaaaactactaaactactagtattagcaaccacaatgtgctaaaaaggtaaccttaaggaataaatatattcttaagacacaccttatatattgtgcaagttagcaataggaaaaattttcttatgatgcactttaagcttacaactagccatagtgaataaacaagtattttttttctcctatacatcctctctctccctactatctcaaagaagctggcagccatcttaattttttattttatagtgggacccatgttaaagaccataacattatgcatcataccataaaaaagactaactatttatgggttccatcttaagatgtgtatgtgcatcatacattggccttgccttactagtaccaccatttgagtggcaggcaaaatgttcaacgcgtacgtgcaagatcactgcgctgcccaaactgcagcccaactgaaaagcttaccaatgctgtagcttcgtagctgttccgtctttttggatggttgcgctgaggcgggaccgaggggtacatgatagccgtgcggctcatccgaattgcgcgcggttggcaacgtgaggttgaaggctagtagaaaattgcagtccgactcgaaaggtccaagcagaaaggagcagaaaatggactttcctcttcatcagatgacagcatttacacctcacgcaatgaacacggccacccaacaacgcaccccctgtgtgtttgtgccacaatcaaatgcaaggaaggaaatactggcctgatctctaatctctttgcacagccggatcaactggtgctcgaacatgcagtacacgctatacagacaggaactgatctctcattcagtgctcagtactagccaaaaggaccagtaacatcactccggcctggttcacgggtgtttagatggtgctaaaactttttagtccatatcacatcggatgtttggacactaatttagagtattaaatatagactaataaaaaaactaatttcataaataagagctaatccgggagacgaattttttaagcctaattaatccataattatcaaaagtttactgtagcatcacattggcaaaatcatggcgtaattagactcaaaagattcgtctcgcgaattagtccaagcttatggaatgggttttgtaattagtgtatgtttaatactccaaattattgtccaaacatcggatgtgacagggacttagaataagtccatgtaaaccaaacaaccatagttctccaaattttttttctaaaaacatcacatcaaatggaaatcatgagacaaatcttttgagccaaattagtctataattagccataaatgctacagtaacccacatatactaacgacagattaattaagctcaaaagatttgtctcgcagttttcaagcgagttatgaaattaattttttttcattcgcgcccaaaaactcccaatcaaatattcgatgtgacaaaacaggccctcggtagtttcagtaacaaatcctagattgccgtacattggttagaacttttacggattttctctactcagaatagtttaagtctacaggaatgtcagtgcagcacatacgaacagtggcacacgagccattagtgcaggtgttgacagacacaggggaacaacatttgccaaaacattgcctgcttggctctgcagaatgctcaaactgatgctgtcgtttgtatatggctgttcttagctctcaaaccaagatcttgaacccgatcaagagcaaagaaccgcagcaaaaattacatgagaaagaatatcaatcgatcatgagctagctagggaataattcacgatttcaccgggacaccgggtggcacggatcaaccagccaactcaacacgaaagaagcaaaagaattcgacgagatcccctcgtttcccgcttgctcggctcgctcgccgcgcgcgcggcgccgcctcaccggcacaccttgcagaggcagacgagtaggatgacggcgaacgccaggcaggacagcccgatggccaccccgagcaccgccgcgctgggcccgccccgcgcgtcggcgccctcgtccgcgtccccgtcctttgcgccgtcgtcgtagtccgcgctccgctccgaccgcgccgtcgccgtcgccggcggcgccatcaccgggaacccgtacttgtcgcacggcgccacgccgatggcgatctcggcggacagcaccgaccggttgtagcacagcttggggttcccggccgccctgaacactcgcagcctcgacacgaacttggcggtgaatggcaccatgccgtcgaagtcgttgccctcgaggttgagctccttcaggcccctcatctcggataggaactgaggtatgctgccattgagccggttcgagcccaggttgagcacctcgagctcgggcagcgtggacacagtgtccgggatgcggccggagatggagttgttggacaggtcaatggtggtgagcgaaatgagatcgccgatggaggtggggatgttcccgttgaggtcgttggagctgaggttgaggtgggtgatggcgctgaggagggtgagggtgtcggggatggcgccggtgatgcggttcccggagaggtcgaggtgggtgaggttggggcagtgccagtggtgcgggaggaagccggagaggttggcattggagagggtgaggctggtgaggtggcccatgtgggagacgacgactgcgagctccgaaggggagccggtggcgaggggagtgtccgcgacggtgagctcggtcaggttctccaggtgcgagagccacacggcggagaggcggtggagcgaggcgacgcaggagaaggcccggagccctgccgcgagctgctccggcggaagcagccgcggcggcgccgcggggcagtcggagaaggagagcgcccggagggacggcgcgagcgcctcgagcgccccggccgagacggaggtggtcgccgagcagttggccatcacgagggacgtcacgcgccgaaacggcaccccggcgtcgcaggacgcggcgaccacgcccacggcgccggccgcgtcgtcgcaggggtcgagacggtgcgggcggaggccgagcgcccgcagcgccacgagctgctccgggtccagcggcgccgctccggcgaaggagatggcgacgagtagtagtagcagca

SEQ ID NO: 19112 - DNA, 584 bp, Oryza sativa
aaattgttaaccaaggagaagcggacagctactatagcttttaagcattcaccatacataagaagcacacaaatattattaagacgagacaaaatcatcagcattagaaacgatgtcagagtttgtaccgatcgaagagtcatcttcagtgaagtaggagatgatctttgcatgcccttcagtactgtagcgatccattggtttccatcaatgctcccttttgatttctacaaacaacaactacaacaaaagacgctacttatgatttgcaggaaaaagttgaatgccttgttataggacaatgaaaactggtggtgattggtgagtgtactgtgtctagtttttccaaaagctattggttgaccatgatatattttgggcataagatgaatactgtccacttattggtggttagattatttttgagcatgaaaccaaaatgaatattctatagtctgaggaactcaacactttttaagcaaggaattgaaagaatccttacaaaaagctttatgatgtcctcgatagtctcagcagagaaacatttgttgataagtgggagcctatcgaaataagattgtcat

SEQ ID NO: 19113 - DNA, 533 bp, Oryza sativa
  unsure (1)..(533): unsure at all n locations
nnnnnnnnnnnnnnnnnnnnnnnnnnnnnnnnnnnnnnnnnnnnnnnnnnnnncacaaatttttattaacaagggtagcttagtaattgctcaaatcccacccgtcacccaatcaaccaagccgtcgcaccgttgattcaagattaaccctaatcaaccaagccagcccgtgcgacggtggcaaccggctggcgcgacgggctcgtcggcggtgacggcgacctactgctgcgtacgtcagctgcgaccggtgggcgctatgggcgcgtgcgtcggcggcggcgacggtgtccagctgctgctttcgtaggcgcgtacggcggcagcgagcggcgggcgtgtgaggcctcggcaagcggcggccttttacgacagcgacaaccagcagatcatgtaggttcctctcgcacgcgagcgttctaattcttcctctcgtttttttttcttcctcctgctgaaacgtttgttgcttctctcaaaagttctgaatttgtaagaatannnnnnnnnnnnnnnnnnnnnnnnnnnnnnnn

SEQ ID NO: 19114 - DNA, 803 bp, Oryza sativa
gttttaagtgtgctctcaagtccaaaacaaaacagcacacttctgttccaaaaagtctgatagcgtgcgagtttcatgtattgataaagcaggagaaaaatataagtctatagttctagaagatggtagttaagaaaaaacagccacaccatacgtttacgacaacaactgctgcgagagcgaaaacaagaactagcgatcttcgaaacgacgccgagcgcgccgccgccgcctggcctggggccaagacatggttttcacctgaagaaagtaactgggagagacgagattagattatacagcaacgccccaataggaaaacggcacccacaagcatcgtcgttgccggcctgaaggcatagctttcgctcataattatttcgcccctcccaagaaaggttcctgtcacactccgctgccaccaccattcaaaaaccttcaacacgtggccaccgctctggcgcctcaccgttggtcagccatcatgaaggtgcacgaaccccgacgcgctctagctccatccacgcaattgggttggatggggagagggtgagagagaagaatggatcccctctcccccacactagcctgctcgacgtggccatcttttatcggcaaaggcgccatcgcacactactagaaaaacgattttttatggcgtttggaaaatatttttcatggcggctataagaaaaaacagccagtgtagaaaatcgggggggggggggggggcgccagtgaaaactgattttcgctggcggccatattaagaggtccgccataaaaaatactatattattttg

SEQ ID NO: 19115 - DNA, 515 bp, Oryza sativa
ggacggtgcgcgggcaagagttggccatcaagaagctgcggtccgccaggggcaagggcgagcgcgagttccaggccgaggtggagatcatcagccgcgtgcaccacaagaacctcgtctccctcgtcggctactgcatctacggcgagcagcgccttctcgtctacgagtacgtccccaacaagacgctcgagttccacctgcacggtaagtacttgctgccggatgatgtaccattgttgcgtgtaatgctggggcttgcttgggctgacacgagtggttggtttctgcaggtagcggccggccggcgctggactggccgcggcggtggaagatcgcggtcggctcggccaagggcctcgcgtatctgcacgaggactgtgagttccaccttgtgtttcctccgaaatctaaggtggtgtttgggaatctctaacaaaaatataagtccctatgagagagacttgtgcttttgttaaaaggattaaagtttagtcctttcttcctaaacacca

SEQ ID NO: 19116 - DNA, 669 bp, Oryza sativa
ttaaagcatgtctctcgagaacaaaatattgaagctaatgatttggcccaaggggcatcgggatataagccgatgatcaaagatgttaaggttgaaattgcagcaatgacagccgatgattggaggtatgatgtgcatcagtatttgcataatccgtctcaatcggcttctaagaaattgcgatataaggcattgaagtatactctgttggatgatgagctttattaccggacgattgatggagtgttacttaagtgtttgggtgccgatcaggctaaagttgcaaccggcgaagttcatgaaggaatttgtggtactcatcaatcggctcataagatgaagtggttacttcggcgtgcagggtatttttggctgacaatgctggaggattgtttcagatattatagggggtgtcaagattgtcagaaatttggggcaattcagcgagatccggcatcggctatgaatcctattattaagccatggccattccgaggttggggaattgatatgatcggtatgataaacccaccatcgagtaaatgacataagtttatattggtggcaactgattatttcaccaagtgggtggaggcgattcctttgaaagaaagtgattctggggatgcaattcaattcgttcaagaacatataatctaccgatttggt

SEQ ID NO: 19117 - DNA, 758 bp, Oryza sativa
  unsure (1)..(758): unsure at all n locations
nnnnnnnnnnnnnnnnnnnnnnnnnnnnnnnnnnnnnnnnnnnnnnnnnnnnnnnnnnnnnnnncccttaggttgcaattctctttacagagatcacacgccggaaaagttcttattcattggcttcaggatgtaacaaaacatttgagatgctttattgcttcgtgcgttatgtaattttcaattttttgtgttacaatgttatacagggaagtatgagaatacatggggttacgagtacttaaaacatgcttgtgaggatgatgaacatctatttctgctgccaattactctgaagttctgccatagactgtgtgctcaaatttgccactccatctgtgcattgtccatgtcaaaattggaaatagtgcagatgattaggatacactgttgtttgtgtgaagggcagagaaaagaaatggattttggagcaattgttcacctgttggaatcgtcagatgggacttggagctccttttctgaactgaatggttcgaaaagacggtcgatgtcctcgttcttgacctcctcaagggtagcaggactccactgtatcgcaacaaaaattaaaaaacagtatgaaaaataaaaatttctagacatgtttaagagtgtgtatgagagaaccttaggggcattgtctttgtcgatgctgagagctctaattccctgccaagttttaggtgcaaatattatgatgaatgacatcttagtcttgcctgtatcaagaatcaccgttacttattcatatagtggca

SEQ ID NO: 19118 - DNA, 5394 bp, Oryza sativa
cgtagttcagaacttaagatgaatcttatccatatgaagcctgtttttgaaaagttctggtaggtccatgctgcggtctctctaggttctcgtatcgtatcctggtatccttttcttttgctttgtgatcatctgatgcctcatactgacaattcccagtttgcgttgatattggtttactgaaatattataacgttgctattttgctcactgcttatggtagcccaattgaataatccgtaaaatcatagtctgattgaactgtgtttcaattttcttgctgtatatgctaatcttagtgacttgcatcaattgggtgttatgtgcttattacgtaattctgtaaaacgaaaaatacaagttaattcttcatgattgttttttgtttcatgctttcatatttcattggttatttgtttggcacaaccgcacaaagctttagctatctattttggctgatattgggtatgcatcattttactgatagggatattgattgatgctggataaaaatgtttttcttgcatcacattcaaacttttgagtagttaggatggcaactttgccgaggttaccaacagttaatttggttccctttttttccctgttgccaatatctgattaactcttgggtgctctctcttttccataaacctagtggtttattggataagcatcctagctaacatcagctgctaaaataaagtagttttactttttaagttctcttactagtcgcattgtgaggttttgttaggcaactttgccgaggttaccaacagttaatttggttacctttttttccctgttgccaatatctgattagctgttaggtgctattctttccataaacctagtggtttaatggatgagcatcttagctaacatcagctgctaaaataacgatgtacttttaagttctgatcattctttcgttttgttttcataatctaattcaatgttctgtgactccataaatcattttttttacttgggctttatatctcttcctaatgcaagacggtatgcaaattttggtcatttcaattatgtacaaactcatcccagttgcatttgctacctgtgaagttgttaggcaactttgccgaggttaccaagacatgtttggtttcctttttttccctgttgcctatatcattagttgcttggttgcttgaactccattgacctatttggttttttgggtatgcatccatgccaacatataatattttccatcattctttttacacttagcactgcccaaatgttggtttggttcgtggactgagattctcgggaggcttttatgttttttgatcgaatggttcgtggtttctttgctggtttgtggttattttatcttcttggagtatatgtttgtcgagataattgttgatgtaaatgcagtcgtaaagctcttaaacgaactctaccaacagctcttattccgaaaaagtagctaaactgaaggatgaagaactctggttgggcggccgagcacctgcagcatcggccactgccttacgagtacttttcgtctgtgaggtcgactcgacatcaacccttgtaattccgtctgtgtggtacacaggatttgttatttagtaattgtaaccattcaaattatctactgctattcatttaaagttttcaacttacctagaagtgttttttgtcgctcgtcaatcgtcatgataacgaatgctcatacaacaaactgaaccagacgatacggacgaaactgcatgaagctagaatagctgtgtgttctagcagtgttgtctcgtagtaatactgtacgtaccagatcgtccagtacattcaaaattttcaccaagtgaagaactgagttctggaatcgttaagtgaagaactgagttctcgaatcgtgtgtgatttgtatagttccgagattagtactccctccgattaaggttttaatacgttgttagtaaaaaaaaggttttaatacgttttaattttagttaaagttaaagttaaactgttttaagtttgactaaatttatagacaaatataataatatttataatactaaattagtttcatcaaatcaataattaaatatatttttataataaatttattaattgaatatattttcataataaattgtctggggttaaaaatgttactatttttttatacaaacttggttaaacttaaatcagtttgactttgattaaactcaaaacgtcttataatctaaaacagagggagtactctctctgtctcattttaagtgcaactatgattatccgtatccaactttgattttccgttttatttgaaaattttttaaaattagtatttttactgttatgaaatgataaaatatggatagtaatttatacgtgacttatattttagttttttttaaataagacgaaaaatcaaagtcacacttaaaaggaaatggggcggcggagggaggactagtccactgataagtgataacgcatcattcaaaatgatcccgaagtgaaaaccgataaattctcaaagaggtgtgaattagaagtcaaactgcatcgacccagctgtccatggtcttcttccgttcgccctcgctttcttcccgcaccaaccccgcctaccgctccaccactactactacaccatcccctccaccggctccccctcaccaaacttccctccacgcctgcttcgcccaactcgttctcttggagcacctaactcgagctgagctcccttcccgcggaattcgggtccctccctgatggcggagccggagcagcagcagcagcaggcgaattccgacgaggtaccgatcagccccacgcgaacgaggccattttcttctctcttgtagtatgtggtgtggtgagagtgataacgctcggcgccggttctttgtgcaagtggtgctcgggcaggagaccggcggcgcgagggtggcgatcctcaaccggccgggccagctgaacgtcatctccgatagagtggtgcgatttctttcgcttcgtgcattttccgatcttatgccggaagcagcagctggaagctgtaattggctgggccgtgctcggtttctggttgcaggtgtatctcctcgcccagttcttggagagctgggagaaagatgaggatgccaagctggtcatcttcaaggtgcgcgcactgctgccctcttagcaccctgcattgataaagctctagggcagaacataactaattataattcagacaaggataggttttagcctagtgatgtcatgcgtgatttgtttccaggagacagctcaaacaaatcatttaccttactctagtttgtttcttcaaagtccttgcaatgcatggagcacttggctagtagtacaaactatgtagagaaacgtgttgcttgtttaaggattcggtaaggtgtgcctggtcaacatttggactttactcagtagttagtactgatacataaggtaacgttttgatatggataagtttggcaataagacagcgatgaaatgaggcgtatcatgtcacaaatgaaactttttgttatgactttgtatgatacccatcgattggcccaagcatatgaatgtatggtctgctgatgaacagggggctggacgtgcattttccgctggtggggatctaaagatgttctatgaaggaaaatcaggtatggatatgatatgaatgtttcagtgtagcagtggtaccacatcacatgaccttactgtataatttgatttccatccccaagactcacatttgcgcacacttgatggcatttaaacctattaacagaactcctttgcagatgactcctgtctcgaggttgtttacaggatgtattggctttgctaccatatccacacgtataagaaaaccgcggtgatgccctcttttatgtttgtgggaggactgttttctaacttgggggcgaattctgtactcaaattctatggttttatttcaattcatgcaggtggctcttgttaatggacttgtcatgggtggtggtgcagccatggttgctccactgaagtttgcagttgtcacagagaaaacagtatgcaacactagtccatagtccagttcttttggaggctttttttattccatattgtgttatatgtttgtttgttggtttgctgtatttatctgtaaaagtgtaaatcacccctctacatgtcactatctcttcaattcagctagtattattattttggcaaaattggttatatagcatcaaaagttcacgtttttggtatgaaaaaaatagaaaggagagaacactcctattcttgaaacggacccatttggtatcatgattactctgtcttgggagtttcacggtgatgttttttgtgtgtttaggtcttcgcaacccctgaggctagtgttggattacacacagactgcagcttttcttatatccattctagactccctggatatttaggtaagtactgaattgcattttccattcagaggtcaaaccatcaccttactacaggcgtattgtctcttgagatgtaatgagaaatctgatagtgacttgtgtgacaaattaaacatatcttaggacaatatggttctgtaatgtatcacttgacatagatatttgtgccaatatgcttattctctttgaataattcttaggggagtacctggctttgaccggtgcaaggttgaatgcaaaggaaatgattgctgccggtcttgctactcattttgttccttctgaagtaaggcattcagcatttaccattcatattcacgatggttccggtgcatgatttcctcgattgttctacatgtagctcgacaaatcaaaatgtttgttgatatattgtctttctgtggttggactaaccaaaaatgattataatgtgaatggcagaaattggaagaacttgaaaaatgcctgctgaatttaaacacaggagatgagtctgctgttcgagctgctattgaagagttctcaactgatgttcaacctgatgaagatagtattttaaacaagttaagaactgatgtccttttccaaatgtaacttgctgcgcatgcatttattattctattattgaaataaattgacactggaatgacaatcttacttcgataggctcccaactatcaacaaatgtttctctgctgagactatcgaggacatcataaaagcttttgtaaggattctttcaattacttgcttgaaaagtgttgagttcctcagactatagaatattcatcttggtttcatgctacaaaataatctaaacaacaataagtggacagtattcatcttatgcccaaaatatatcatcgtcaaccaatagcttctggaaaaactagacacagtacactcaccaatcaccaccagtcttcactgtcctataacaagg

SEQ ID NO: 19119 - DNA, 2857 bp, Oryza sativa
  unsure (1)..(2857): unsure at all n locations
actgttttttaattttgttgccatacagtggagtcctgctacccttgaggaggtcaagaacgaggacatcgaccgtcttttcgaaccattcagttcagaaaaggaagctccaagtcccacttgacgattccaacaggtgaacaattgctccaaaatccatttcttttctctgcccttcacacaaacaacagtgtatcctaatcatctgcactatttccaattttgacatggacaatgcacagatggagtggcaaatttgagcacacagtctatggcagaacttcagagtaattggcagcagaaatagatgttcatcatcctcacaagcatgttttaagtactcgtaaccccatgtattctcatacttccctgtataacattgtaacacaaaaaattgaaaattacataacgcacgaagcaataaagcatctcaaatgttttgttacatcctgaagccaatgaataagaacttttccggcgtgtgatctctgtaaagagaattgcaacctaagggttaaagtctagggagtgaatgtatgtccaagagagaccagtcatgtagcgacttgagagccctatgagcagttgggctccacaggatactctaactccaagtagtattgtttgtacttggtagttttcttctgagtgggggctttcctcactgacaaaattctcctcacagcagcttcttggtctttcgggaactccaccgccatcttcttcaggttcgttgcttgagttagcagaaagataaagagttccttctggtaccgttgaggcctgaatccaagaaacttgagctgctccaaactcttagttaggcatgataactttgaaagcctctcctcatgatcagcaaaatttggcaatgcagtgtcgtcttttgcatcaacagcctaagcatgaatggcaggtagataaattagtggtaaacttactgatgaaactcaatatagtaaagatgctaatgtgaatgcaagagtgaatgggtgatattgcataccgaaagagtcaactgttgcaggttggggcaactctcaagcagcttcagaaggaagatgagttctctttcatttgagaaatccaagctcactgacagtattctcaagtcttcaaattgtacagccaagtttggagtgtctttatattcagatgacaacaactacaaaataagacaaagataaatgaccttctgaaagagcaagagttacacatgtgttagaccatattcacattccgatgttcagttgtgtgatttacactccagctatctgtgctataagcatataatgttgacatataaattatcgcttcatgttaatatctatcaaaaacgcattttatcaacaccgtgtcatttgaacagtgcttaaacatcaatgcaacattgcaaataggagaatacgagtattactaacctactacaaagctcaatgtctgaaagttatacagaacaacacatttcctgattagcggtttcactatggccctgtccagagaaaagcaaattattcatgacagtgcgaagcattgccaaggaatatttggcctagataactcctacattaaatcattctattatggatgtaatctaagaactgttttacattaatcacaacttaaagcacatcacaaacagttccctatttcatcagaactacataaactaacatttgtgtgaaacacatcagagcagctaattaaccataggatgcaagcaaaacatatacaagggagagcgcaccttgatggccatgcccctgagcgtgaggcaggtcaaccccgtgccagcatccaagaacggccgtatcctgaactgcagtttgacgcgcggcctggcgatgtgcaggtatgccttcctgatttccggtgcaggatccagccgaaccgactgcaccttggggcgcgtgtacagcgtgatcgtcctcagacccgccattttcaccgtgacctcacgctgctccagagccgacttaaacaggaggttcctcaccgtggaggactccatactgcagctgccggcgaatcccatgcagtacaccatctccagcgtctcgagcacgggcgcggccttgaggatgacgctgatcatccgctgcgggatggcaacgtggtggagcttgagcgtgcggaggccagggcacgcggcggggcaccatcgcgggagcgcgcaggagtcgagggagaccacggtgagggagcggatggagaggaggttctggggaaggaacgcgctgcggggcaggcggacggcgagctcggatagccccggtcggcggcggcgtcgaggaggcggccgaacgcggaggaggagaaccggcgggtctggggggcgaagcagaggcggcggatgaagtacgcccgcgcggggagcgacgggagcggcagggccgggtcggcgacgagcgcggagtcgacgcggccgaactgggacgggaggacgcggaagcggcgggagaggccggagagcgtgacggcctggcgggtcgtgaggcgggagaggatggcgaggatgacgtcgtcggggaggccggagaggtagtcgtggccccctccgccgcggcggcggcggcgcttgcgtggggttcgtgccatcggtgcggcgcggtggaatcggagggggaggagattttcgtggatggatccggaggggaggggaggggaggggggcaaaagagtcaggagcttctgatttccgaaccggtcgggcctcaagtagaggaaaccggtcgcacgcgcgataggttttctggtttctcctctctttctgtgtgtgtgtttatttacacgnnnnnnnnnnnnnnnnnnnnnnnnnnnnnnnnnnnnnnnnnnnnnnnnnnnnnnnnnnnnnnnn

SEQ ID NO: 19120 - DNA, 778 bp, Oryza sativa
attgttatccacagttaatctttaaagggtaatttaggaacacaaatttttattaacaagggtagcttagtaattgctcaaatcccacccgtcacccaatcaaccaagccgtcgcaccgttgattcaagattaaccctaatcaaccaagccagcccgtgcgacggtggcaaccggctggcgcgacgggctcgtcggcggtgacggcgacctactgctgcgtacgtcagctgcgaccggtgggcgctatgggcgcgtgcgtcggcggcggcgacggtgtccagctgctgctttcgtaggcgcgtacggcggcagcgaacggcgggcgtgtgaggcctcggcaagcggcggccttttacgacagcgacaaccagcagatcatgtaggttcctctcgcacgcgagcgttctaattcttcctctcgtttttttttcttcctcctgctgaaacgtttgttgcttctctcaaaagttctgaatttgtaagaatacgcttttgccctttaccgaaaaaaatttaataaaaaacaattaccattttaccctcccaccttccatacctggctcacccttttaatacattttttcaggtaccttctctttctgtccgttagatcattgcagatcaatggtcctaattaattccaagcattgaagaagatctaacgagatattttgaaatctcttaaccacaaaaccaaaaatatgtatctttaaatttacataaaccatacactcaaggtccaacaacagtataatggatggtttcgctgacatggca

SEQ ID NO: 19121 - DNA, 2929 bp, Oryza sativa
  unsure (1)..(2929): unsure at all n locations
nnnnnnnnnnnnnnnnnnnnnnnnnnnnnnnnnnnnnnnnnnnnnnnnnnnnnnnnnnnnnntatatattcgagggaatatgttaggaaaaatgttagtgatggatagtagcgaatgtgattttcaaggtgcatcttgtacttttttaaaaaaaaaatgtttgagccactgtaaatgtattactatctccgtttttaatagatgactccgttgattttttctcacatgttacatgtttgaccattcgtcttattcaaaaaatttacgtaattataatttattttgttatgagttattttatcactcatagtactttaagtgtgatttatatcttatacatttgcaaaaaaaattaaataagacgaatggttaaacatgtgagaaaaggtcaacggcgtcatctattaaaaaaaacggaggtagtatgagccagcatatttcctaaacagggtacctaactaaaattgcatttcaaagattctaaggacgtcaagccgtcttgttgaccataagaaacatttcaccagcacaatttttatgtgcagcttgattaggaccgtcgtccaatctacactagacattgtatgcaattattccttcagatttgtttataacgatcatgtagtggtcctctaatccaaaacgagatagtggttggttgtacccagttacccacaccacgagagatcatccagaaactgtgttctgaagccacgcatactaatcttttgagcaaatcacaccctatctcatgaaatttgatccatctgcaaaagaatatgatattatgattacctaaacagttagcctacactattcttctttgtttagattatcccggtatcccatctctaatccatttttgggccaacctccaagatcaaaagagttttaagtgccggggtatcatgtactactcatgtagtcatgtgggttgggtttgccgactgtaccaattgcatacgttgtccaaagctcctgccgatctgcgccactacaaaatgcccttgaaatcctcgattttaggttcctcccgatggatttggctgcgtctttccaccgcgatttgcaggtgcgaagccgctaacgcaccgcaccgcaccgcctaaaattgcgctctaaactcggctaaaactgctatagcacgagcaactattgattatttagtcgtgcatatctttccgatgataatggcagtttgctctcaagtggagcagtaactaacaaccgatcgactttgtttagcaactgaatgatgtagcaagctgacaggttgaagtcagcatagcgtgccatgccagctgctaggatcagaacgcccttgaaacattttatgcatgataagaacgagacagagtatcaacatggagagatcttctcaaggcaaaatctcctcatagacaagctgaaaccttactttgccagttctattaactaaaatgagttgaggaagctaatgtgacggtggggaaaatctgaatgaacagccagccaaaccatgaaaaactctcatttctatggctatttacatttgttaatccttaaagccttacccagagttaattctaatggataaacgcatactgtgcactcattggagaaccatgctacattcacaggtaattcccttcttttctgatcactaaagtttccttgaagtaggaattacatatccatctttgtaccaacaacctgtcagaaagctactagatgccagtgcacaaatgacgcattggtaaaattctagcagattaaacagactgaagtttccacatcaacggtttgtcttctggttaaatagggcttgacttgagggcctatacatcgatagattagtaaagtcagtttattagaagtatgtagaggtagaaacctatgaattttaattgaataacgtaatactgcaagtaccttgttagaggatgtaacggcagtcctccattgtggatcctgtgtaggggatggtctatccctgaacaaaataacaactcttgattgtgtgggcctttctactgtctgccgatgaggaatatctttcatgacccatagaacaaatcctgacggtatggatgatcctgcaagagtatccgaagtaaaattaacaagtggttgtgccatctctctctctaaaaaaaaaagaggcttgccaagtgctttcttgagaatggaatattatgttcgcaataaacatgagaaaatatcaacagaaaaaactattatacaacatgcattctgattccagaattattttgattgattggatgcctagtaaagagttaatttttgtgactaggcaattccactgttgcagttcaatgtgtgccgtaaatacaccatgcaactaattatttttctaaaatcattcactagtttgatggtgttgctccctacagttgagttgcacaacattcactaagtatcaggtaaggagaactaagaatccaacttcaaagtggatatcataaatataagaacaaaaagaaatgtaagttctgacatgattgcaatatatcaactagcagagtttgagtatttcaatctggtactacacatagaatcattagatctagactagcttcaccctgggggtatgagaaatgaaaggttggataaataatttatccacacctaccaccacacttactcatttcactaacttattgtattaattcccacatatggttccatgttggagcatgctcacatgcattcaccatcaggcttcgaagcatgtgcacataataagcctgatggcacaccacatcctaccatattttcccattgcaacatgaactacatttaataaaatgttatcgttcaatttaagaggagttatttctagccatagatggtggagagatacctatgaaatagtacataaacaatatgatagcattgttgatgatgtattcatctgctgagtaccaat

SEQ ID NO: 19122 - DNA, 11671 bp, Oryza sativa
  unsure (1)..(11671): unsure at all n locations
cccgtacattgcaatcataacacttctgagttgacccttttacacaaaaggggacaaaagtgtaagtgaggtgctctttatacatgggctcacttctcagaagagctgggctcatacagattattgaagcaggagtacgcatataggggcatcctgttttttgtcatctggttttataagcactatgaccatattggaatgatatcttaaagtatagaatttatcagaactgaaaccaaaagttgtatcttttgaatatatgaccatttattcaattaatttaatattgtatacgatcattattagtttgctttctcatgattttacaaaatacaatacatgcagcaaatgataaagcagtagagagatgcaatccacaaattgaatgattctgcaagagttataccttccgcttctcagatgatccagtttcagaacgcactttgctcatctttgaaaatagtattgcacctttaaatgatcataaaaaataaaagaaaagggcaagtcaagaacatgttgaatgagaggattactggtagcagatgaaggtcaaattatttagtaaggcggatgtgaaactagatataaagtgaaataggactgtgagactcattcaatatttaatctactgcgagggattagaaacaagataataagagtttatcttaggttgaaacaattgactagaaaacatcatgcctaatattgcgacataattatggtatggtatagatgagtatacataggctatgcttaccataacatgccagcgcaccaccaagtacaagaacaactactgagaatacatccaagtaaacctacaaaataaaatatttggctaaacaatcaagtcacaacacaataggtgattaaataactattgatgaaattggtgagcttgtaaatttatcaagtaaactaatgtgaaaacatgaataaaaagtgtgtgaagaacaagtaagatacaagtcataatggagacaattgtacttatagcatcaaacttatcacaaatagaacacataggattttgttactctactggaccatctctaacaaaaattcatgtttgatctgatgaatttcacattgttgtgtctacctacctaaccttgctgtgcataggtttagaatgcattggcctgaataggattgtttactctgtgcctacaaaacttagtccacaataatgacagatttgtgcaaaccacaacacatcagtgttggaacttggaagacaagtatcagattccatccatgtaagataaacatctagtatttcttcattctatttcttcaccgtagttgtttatttgagtttatagtaatacaaaggctgtcttccagcacttgcaacacatcaatgctattatattgataaaaaataagttgatatatcataggaaatgcagcacataaaaacataaagaatttctaatcatcatacccttttcaatagagatgaatcaataggattttctcctctaccaatccagatgaggatggcgaaggcgattgtaacaacaaatgacagtagaagcacctgtatgggaaataaatattaggtcagttgttagttctattttcacaaatactatatgatggtaggtgcactacatgattaaagttaatcaaacaaatcattctcaagcagtacagtctaaataaaagaaagtgtcataaaggaatgtgtattatgtgcatgagcaaggaatatgccaactaaaaagattaccaaaatcacaaatttttgccggcttccaagctgtactcctgggcaacacctccggcgaacatcaacagcacggatgccaggtttattttttgttctatccagtaaagcctcatggtgactcctcgtatcctcttcatcttcatcgtttgtctggtgacacaggtcaaccctgtaagaccattattttagagaaatatagagtgaaaaaagcaactatgaaaaggaaaaagaaggcagaaaaacatatgcataataataacatgattcatgagaaagcaaaaaattgacaatacaaggttcatggcatatgttatctcatagaaatcgttaaatcatgaccatcatcttccccctttttgtttcaccctaacatctctaatgcaatcctctcaaacgtcgcgtggtaaaccaatgcataacactgaacttatacaggtttggtcctcaagatgagaccttactatttctgatgcaccccaccaacgatttgtggttagatacctcaagtgcaaccgttgtggcaagtgctacaagacatgttacagcttagaactgagctaaaggcagtactagtatgtcttttgcctatacaacgacaaggagtgcacaaaccaggtgtatgaagaaagggaaacaaagtcttctacagtaatgaaaaacactcttcccttgccccttcatgatttggaagactgttattaggccccattggatgcttgttggcatagaaagaccctaactcagactggggagcaatatgtgggttacgtgatcaccttccatgtaccctatcaccatggtgaagtgagcaaaagtaaaaggaaaagtgtaaaacccaaacctcattgaggggtagggcttatctccaataagtccatacatggagaagccttttcgcataataccactttgagcaaaagaacattctcttatcacactgagattgcaagcatagatcgccatcaataataaatcatatggtgatcataccaatcaatcgtggtcgtcatatggtcatccaatcaactggataatgtccataaccacgaaaaagaggtgagtaatgcggcatgtatcagagattatatgctaacgagtaatagactaatagtgtcatgtggccatcttgtattgattataagaggtcaatcttaacagggttacccagacagtaagtcagtaagatgatttaaaattattgaagtccaaagaaattataatgagaagatccatcagttttctaatcaagcatcaattaggaatgttgttttccttttatgctcagatggtttgactggtcatcatgcatgacatattgacatagcctatgctgtagttgtagaggatatttacttggtctagattagataactaagaaataagaattggtgtagtccaataaaaaaactggatatgttcgtcaagtgacaattctttcaagtggatatatgaaacagagacatagtaaacaagaacgggaattccaaacaaatctttattactctcaaaattattagcaaagctacatgagaaatgcattgtaagaaacaagtgccgactcaccagaatgacaacagcaacagaaaagaagcaagaagcaatatctgtggactagctgcaaaatattgagaatgcacaactattaggtctggtcagaaaaatagcatacaataaaaggtcatgtagataagcagggaaaaaaacaaaaggacaacagcaaagctatatatccagtaaaatatacccatgagtacaaatccacatccatggacccaacaaagccatctctcacaggtagcgatgatggtagacacgaaatacacaaggaatactgccataggattgggaaaataaaaatcagagttagtaaaatgttggtaatcataaaatatgcaaggaatactgtcaaaggaatggataatgaaagtacacatgattgacctgattcactagtagagataatacaaatactttatttagaaactagtcaacctgagaagctgttagtgaagtaacaacatttttcttcttataaagttaaacatcagtatatttgattcattaattgtgcacaaattaagacaagtgatcagcagtcatgtcatttggtgtaaattggacctatttaaggagagaactagcatgtccgtaatagaaaaattgcaaacaaaaatgagatctattttctatttcttaatcaaagcttcaaaaccagaatataaatagttcaactattccttgtgcacatggttcctcaatgtcatagtggttgcattccagcatcataaaagaggaagctcgctcaaaaacttgaattgtaacattttccaattgccattagttaaaagtttaaaacatggatagcaggaaccattcagaacaattaagacagtcattaactactgactacattatgcagaaatttccagtgcacaaaaaataataaagaaacctcaagcaaaataaagggaaaaaggtattatcatagcaatacagatctcacctaagttgcataggccaatcataaaatggaatatctgcaagaacgtaggcatataacattaaaaatctggcagctgagctcacagcacagagggaaaaaaaaagtgaggcactaattagcattatttaatatcctactcttgagctctcattcgaaaaccctacagcccacgtattgaagtaaaatgtcccataccaaggaaacttgctacttctgtcaaatagatagactataaaacacattgttgttttgataatctatagttatgtttcattcatgagaaggtcacatgattacacatcattaaaggtatgcataaatgaaataacttttgggggttaacatttgtaaatataattatataaacaaagactatattgcaattcatccgaaccttggaatcagacaaactaaataaatgcatactgaacatgatataaagtggtatgccacaaatagtaccattagtaatctaaattactaaagtgtagaaagataactgaaggatgaagacaatctactcccgtattaactataagaaaagtattatagagtagatgaggaagcctagtatgaagcttgagatatcccaaaaaaaaaaaaaaaaaaaaaaaaaaaaaaatatccaggataaggaggttttgcgcctggttattttttagcctccaaactgtcaatgtaagtgactagccactagatatagaggtaagcaaaagcttccaaccagagataaaaacatatggacctaaccacatagctagagcatcagccaattaagtatttatccatgataacaatagagatattatttagtgcaagcatatgaactcattgcaaaacaacatatcagacagttggacaacatgaaaaatagcacaaataggaattgtgcataccttttgccgagtccatccatgctgctgatcatgcctgtggattcttgctagctgcaaaattggaagtgcttaataccgagtaaacggatttaagagatcagattaagtaaaggatttaggtcaatttgcaacagagctcattggtaatgagtaatgacaactactacataattcaccgagtaatataagtgcactacataactatgctacacattgctccactatgaccaaaacatcgttccactgtgaccaaaacatcaccaaatagtaacattatagcaataccagagtgcaataaccttgcaggaatccctaggtgaatagcacatgacaatttatgtggctgactgatatctaattctcgtaaagagcaaaattatcattccaaaatctggcactcccccattccccgtcccgctagcacactaccgccaacgcgcatgacatgcccgtctccccactccctgcccccgccatcagtcgcggacagagcaccaccacgagataaccagatcgaattgcccccacacacgcacctgcacgaaggcggcgactgaaatggaagcgtcgatgacagcgagcgcgacctccgccgagataacacgcatcggcaggcatcccccgccgtcttcgaccgaggcgccgcgggacatgccgtggcggcccatacgcccgggcaacgacgaacgctgtcgaagtagtagagagagnagnagnaggagtagaaggagtagggtgaggatcagggggccagagggcgncggcgcatctcgcggcgggcaggggatggcccagggctagggtttggtgcggaggccggagcagcaggcgggagcggaggcggaggcggaggcggccggaggagggtcagggaggaattgactggaggaggccgcgcctgttggattggaaagcgccccgagacctcggttttttagtcgtggtggcctcggtttctagtcgtggtgtggtgccggggtgcgtggctgcgtgcgtatgaagtgtggtccatggtgatgcgcggggggatccccacgtgaggatgggggcgtgtaaaccgtgaatatgcgaacacgaagggcccggaataccggattgatgggctggattcacgttcaccgtcggtacaacagtaagcttacgttggcgtacacccagggggcttacgtttgttcgatgtagatgtactacaatgttgaaaaaactcggagtaccatatgaagtttgttcgattttattttgaaacggagaaagtataggatagactatttttattgtgtctattttgtttaaatttctagatagataggattagtttttcattaaactatttttattatgcagtatatgtatatctggaacttttttctatttatgttgaattatccatactcctattatataggatgttattgttagcgtcgtccttgtaagaaaagcaatctgatcgaccttagtacttataggttgtttataggctattgacaattggcctaacaattagaagacaaggagtgtggttgtgtgtggggcgcaagtggagcgggagcatggatagacggggaggggatagagcatggatagacggggaggggattgcgagggctttacgctagtacaccactagatattttctttggtcacgacttaaatcgacttttttttttgtttggatgaaacattagagtaaactagatgaaaccccacgcattgcactgggatattttgctgagattggtagttgaatttgataggctaaagtggtataaaattatttaaagaaatattgaatttgatctaaggctcttgatgtcattgactatcttgctaaagtggtcatacatatgttgctcgggcttttagcattcatcacaacaaatcactcgaattgtcccttcaagatctccacatttgactcacggacgctatcaatttagtttgtgaaaaaaaaaacgcccaacatgacatatcaattttggcttccaactggctaatttttcattattattattattattattattattattattattattattattattattattattattattattattatgcacataatggctcaagtgcatcccttatcacaccgttagagagatggaggccaaccgtaaatccctaattttaagggaaccataatttgtaagaaaaatggacagaggccctgtttagattccaacctttttattcaaacttttaacttttccgtcacatcaaactttcctacacacaaatttttaacttttccatcgcatcgttctaatctcttcaaactttcaattttggcatggaactaaacacagccagagtaatgcgcccacaaatgccacaactagatcagtagatcactcattcgcttgtgctcacattttcagaaccgtgccaaagcatgaaagggaatgatcagcgtcttgctatggacatgaggtaagctgcagcatccatctcatatcccacaaagtttctccaccaattgcagtcgacaccggtagtcaacttctcgattttctttgttccgaggttaagcgcaaaggtccagggactgcttcctttgccgagggtgaacaagagggtgcaactcttctcgcagaaccaccgcagtttactggcatccgcactcttaatcttgaactggcggcgcaattgtccgatgccacctttcctcacccattctccggcaccaccacacatgtcatctccggtggtctcaaagaccattgatgccaaaccgacatatcctgaggaattcgctgcgtcgatgaagcacagcttccgttcaggtgtgacaccaagcagacgaaactgctgaatcgtgctgataatgccgtctagcggcatgcgcacctgtgtcggctgcggcgtgtcgaggactcgaggcgtactgctagactgctagtgtcgttcttcgcagcggccagtaggcgacggcgtggagcacgatgccgtggcctagcttgccaaggtcccagtttgtgagcttggggcctggcgtcttcttcgcctccatgctccagctgccggtgtctgatgagtaggaacggaacgcggtaaacctgtcacggttgtagacgatgagcacgcggaagaagttggcggacggcggcggttggtcgatgtcggcgtcggtgagcaatgtgcatgcgtacatcctgggcctgtctttgccagacagaggcggcagcacggccacgtcccccgtcatggggttgcagacgcacaggttgagcttgccgtcgttgacatgctcctcgctctggagctcgagaacgaggcgtccgttgcgggaggccactgggcgtgagagtgatagatccaggaggccaagggcgtcggtctggacgcctaacggcagcgcgctggcggaggggaggttgtagccgaggaggcgagagccgaacgccgtcgggacgaagcacgggggcgtcgagtagtcgacgatgatggcccggcgtttccgcttgcgcgtggtggccacggcggcggcgtcctgctccttgtggaaaaagccgagggcccggccggggagaagcggaagcgctcgtgacagagcgttggcctccttggccaccacgctggcccaccgcctgcacgtcgcggcgcagcggactacgtcggccgcgttcggcagccgggtgaaagtggccgcgagcgcgtcgtccgtgagagacgtcccgttggcgtcgtactccgccgtgtcggccccgctactccggcatcgccgtgacagccagcctccgcggtacggcgagggacgggcggcggcggcggcgcgtgctcgtccttggcgcaacggtggcatcgtgcgcgcaacagattggaatgaggtaacgatccaagggattcagcgatcccgtacttatggccggcgcgaagcgcgagtccgactcccaagcggaaaccgtcgccgcatcggaatatccgatgcacggggcttctcgcacgaccgccgtatcctctccctcctgcgccgctttttctggttgagcagcgccgccgaaaacggcgtgccgctacgctcgccccccgctcgcgttcacctgcgcctgggcacggggacgcggctaatgaacgcttatccccatccccccgcgtcttctcttcctactagaccataaattaaaaaaaagaggaaatttcacaaaactaaatattttatggtttaagttatagaaaatcacacatatattaacacttggcacttaagtacatatattttggtagtttagttttacaaaaccacactatcgatgaatagtttcacccgtgatattatgtggttgtttcatctagtctgaggacgtggtatcatattaatttcgtgcgatggctgataatagaatgtcatgtcctcgtcctaggtgaaacagccacatcatctcgcgggtgaatctatacatcgatagtgtagttttgtgaaactacataaccaaaatatatgtactttaagtaccaagtgtcaaaatgtgtgtggttttctacaacttgaaccacaaaacatgtagttttgtgaaatttactctaaaaaatatataaaaaacaaagttggaaaaaattatgtatagaaatatataaaaaaattttaattcaaattcaaatttaaaatgggtatgtaaacttttgacttataaactttgggtctataaactaatatttgaattcaaattcaaatttgaatcgggtatgtaaacttttgacttataaactttgggtctataaactttaggtgtatcaactttagatgtatagaaatactatatatataaaatatttgaattcaaattcaaatttgaatcgggtacataaacttttgacttataaactttgtgtctataaactttaggtgtataaactttagatgtatagaaatactatatataaaaaaaatatttgaattcaaattcaaatttgaattgggtatataaacttttgacttataaacattcgctgtacaaactttagatggataaactttagatgtgtaaactttaggcgtataaacttaataaaagaggaaaataaaaaaacgatcgccgccagcgatcaatcgctcattaggactttcgcctgggcacggccacgctccagcgcgagaaaattgacattttaccatcgtaaaaaggtattcgcccaaataccactatacagctgggattgaccgaaataccattctcaattaaggggctctgcccatataccattttcttccaattatctctttactctcatcattattaaccaaaatgctcctagttgaatcaatataagtatataaaaatacgtagattataaagtaaatacgccaaaaatagttttacatgttattttttttttctctacaccagattacatagtatgcaacgtactatctcaaaaactcacaatgttttcaatgatataaaaattatttttatttatgatgtaaagatagtgtcttatactctataatttagtgtaaagaaaagaatatatatatatatatatatatatatatatatatatatatatatatatatatatatatatatatatatatatatatattgcatgtcaagatatttaggtgatatatactctgtaatctacatatttgttttacttgaattaattcaattaggggcattttggtcaacaaagatgagaggaaagagagaattggaagaaaatggtgtttcggcgaagcccctcaattgagaatggtatttcagcgaatccgaactgcatagtggtatttagttaaaacctgttttgactcaggatgggaatggttaggatatggattgaaccaaacagttttaagtgagtttgttgatccatggtttaatagggtcaatccatcatgagtccattatatcactaggttatccatagatatccaaatggatcggctacattactagtagaaaaaaaaactcttatcacatcccttctttctatatagttaagacctaaagctgaattgtggttgagccacgtcacctgtaaatctcagccattgaatctaatctggactcttggtaacgcttcaatcccagcccacttctcttttatcgccatccgccctaccgatgccgccgccagatgcggtcgcgctcccttctcctgcccccgcgctcctttatcagagataacgttagactccctttatcagcctcgtgcgggcacctaaagggtttgtctgagttaatctccgacgtcaaccaagaaagtacagagcatacgactaagtcttccgtcttgctgtaatcgagaatttggattgaagtcaagaaattttatctcggcgggtacaccatctcttcattccgcattccttgtcgatatccaccaaccgttctcgagtaatcgagaaggcgcagagtctgcgacggagccttgtcaacatttgtcgtactcgccttagtcgaacttggtgtagaaccatagagacatggaaccttcgataatgtcgaatagaattttcctgaaatcaatagtcagaaaagaatattaaatagaaatagcccccgagcgaacgct

SEQ ID NO: 19123 - DNA, 8945 bp, Oryza sativa
  unsure (1)..(8945): unsure at all n locations
tggttaatacgcacggcgagaactcttacacgaccagatcttacatggtctttcgtctctgaaggatccgacaaggccttatctgctctgggcgtccccagccgaagttcccttaggttcctcagaggccttgtcaagacggcataaagggacattaggataggtttcaacgctaggtatcttttgtggtaagggatctctaggtaaaacacttggcgatattgtgtacctgatatcaactttgttgaagtagaggtaataggagaatcgctacacctctggtcaagaaccaggtagtagtcgtaactcaaccactagaagtaaatgtacgagagatcgctacaattgactggttgaggaccagtgagtaggtgtctctcgatcatttgaagtcgtagtacaaggaccgctgcgttattgctgcagtcgtacctcgaccatctgaggttgcggtgcgagagattgctacgtactggttcgaggaccagtgaacgagtagaattatctctcgaacaccaatggatgttgcggtgcaggagattgctacgtactggttcgagaaccagcgagcgagtagaatcatctctcgaacaccagtggaggttgcggtgcgagagattgctacgtactggttcgaaaaccagcgagcgagtagaattatctcttggacaccaatggaagttgcggtgcgagagattgctacatactggtttgagaaccagcgagcgagtagaattatctctcaaacaccaatggaagtttgcggtgcgagagattgctacgtactggttcggaaaccagcgaacgagtagaattatctctcgaacaccaatggaagttgcggtgcgagagattgctacgtactggttcgaggaccagtgaacgtgtagagttatctctcggacaccaattgaagtgctagagttggtttattacatgtgcatctcatgtagccagcatgactcacgcacccaacttatagcatatccagatgtccgttcgcaatcatgtcgggtgatcaagccgacggcgttcgcgaggagttatccgttaacaaccttttctcgagtagtccagccatggccggtgctatgagataggtcatcggtcttcgttggtaggttaggtgcgacgactctgcatttgtcgagatcgttctcgacaatacggtgtacttgaccacaacctactcgagtgctcaatggttcctgaaaaatattttctagaaggtaagacatatagcagagaatatcgagtatgtatttgaaaaactgtatggatcttctagtattatcaggatatagcgagcagatgtaaatatcaggcattatgtaaaccgtaaacaagcatgatttatacggaagaaaatagggcgagctcccagcgttagactgtagtcggcctaacatcgggaacactcgcacgacagatattgtataaaaaacatgctctagataaacataataaattattgattgaaaatatctgaaaataggtacggtaaattgcatataaaatattgcgtacctttgtaaatacatgtcggatgtatctatgaaattagtagattaatttaaaaaaccaatctaccaattaccttgttgcgcactcgttcgacatcatacgatctaacatcttttggtacgctgcgaagcttgaggcttggatgatctcgatagaccaagttgtcgatgacgacgatagttccgatctcatcggagcatgtactctggtcgggttagatctccacagccgaagtcgtcgagtagcttggagaatccatatcttaaacccatctcgtcaaaatccagaagcaccaaaatctccctacctggtgcgccactgtcgacgtttgatgtcacgattccggtatttgcatagtatggggatcgttggtactaggatatacgcgggactgaggtaaaagagacggacacagggatttttatataggttcgggcccctgaattgtcaggcaataaccctacatcctgttggccaaagccggtattgctcttattcaccataatcacaccagtacaatatttgggatagcctatctaactgttgtcgacatggcggtctgaaggtttgactcgtagtcgacaacagggtagtcttcctcctcgagttcatgcccggcgagatcaaagacagcactagatccctacggctggcctctgtagttaccggatagggtcgatctaggcatatctctgatgtcgatatctgacgtcttatcttgacgtatgttggcttgtattggctcgtggctttgtggcgtctatgttgtctgtatcccctctcctcctagggggccttgtatttatacccataagtgtccccttgtctaagtagaactaggaaaaccaatatagatacaatccgagtagtccttgtcgtttccatataaaactctggttgtctttccttatccggaactcctcctatatccgcaggttgtttccgtataggacatggtatgtggtgggtcctgccgagatttagtcaactactattaggtatgtggtatccataaccctgacacatttactcaccaacaatgagccgtccatcaccggcgattaattccatttatttccctcttaagcctctttcagttcctctttgactaaaatttttacagggctattgctttatttttaacactacacactatactttattcactttcaatttgatgacagtgtcaagaaatccatttagttcccatccgccctaccgatgccgccgccagatgcggtcgcactcacttctcctgccccgcgctccttctccgtcccgcacagcgccgcgcgagctgcggcgcgggcccgcgctcgcttctgctctgcacccgagcgcgcgagagagagatgcgccatgaagcgctccttcccctcccccgctgccgctgcgctcgcttctcctctgcccccatgcgcgtgcgagagagatgcgccgcgggcccacctcgcttctccttctccctcgcgcgcgcgcgccagctgcgccgatgtcccgccagccggcgcactcgcttctcctccccgcgtcgcactgtctcccgccttcccccatcccccacgcgccagccatgccgcggagctgcctccggcctctcccaattcttccagcggcggcggctggacgtgcgagcccatcgccatggcgggcgggaagatccagaagaagcggcacggcggcggcggcggaggaggaggaggaggaggaggaggaggaggaggaggcgggnnngtgattcccccgctgcagggagggatcccgttcgacaagtccaaggggtcctgcggaacccgtcgctggtggactccatcgttgagaaggccggcctcaagcccaccgacaccgtcctcgagatcggcccggcacggggaacctcaccaagcgcctcctccaggccggcgtcaaggccgtcgtcgctatcccacatggttctcgagctcaaccgccccatggttccagttctttaatcgttttctaaaatatattacaagcctaactaatactaccattctaggtcccgctaattttacattacctttttgctccagcatatgagattagaaattatcagtatacaattctgtgagttgtttcttcgttcttacatatatggtgaggattataatcatttggttaattcctacttcctccgtttcacaatgtaagtcattctaacattttccacattcatattgatgttaatgaatctagataaatatatatgtctagatttattagcatcaatatgaatgtgggaaatgctagaatgacttaaattgtaaaacagagggagtatttatcttgcagagataaattccttaagcaattcacaattcccaactgaatggtttacataacttctttgagatagcaaattgaaggtatgcatatatgtcaaaatcacgtctttgcctcttgcgatggcatttgttttgctgtgatctttgaaggttttaatatatgcgttcgtcagtatccaaattaaatccaaacgaaatagttcataaatttgatagatttggagaaaatagttcataaatttgatagatttggagaaaatagttcataaatttgatagatttggagaaaagaatattgatgccttctgttttttagtatttctttatttctattactgatgttttcttccaagcttcacgccaacatatataggaactatgtcagtcagtcacaaaagtaccgatttggaaacaatactgcagtcagatatgcgctctccatgctgatctccttcagatttcagtagccagaattgatctgttccccttctcctaatcggctgttgagctaccgatcatctccctctaggagcaaaagcatttactcaccaacaatgagccgtccatcaccggcgattaattccatttatttccctcttaagcctctttcagttcctctttgactaaattttttacagggctattgctttatttttaacactacacgctatactttattcactttcaatttgatgacagtgtcaagaaatccatttagttcccattcatccacatgacaatgttgaaaattgagttaatttatgaactctgctaggagtcattcaagcgtattggatgtggcttctaaaaactgaggtatgtataccaaaaaatttcagcatttatgtaataatttttagcttttgcattcgtcctgtgttgtttgctgcttggtcgctgtattgttgcagctgccctgttcgtgctgacctggatatgagtttgcctctctttttactccagaatttgtgtttactccaattacgagttagtatagaatagtggctatgttttttttgttattatttcgttcaaatttatgttacacaggatttaaacaagtttagatcatgagactacagatatctgatgacgttgttacaaaagttctcatcatgcatatattttagcttatgcttataatcaggttaacatgggcattatatatgtcctgatacattccattcttctgattgctatttgatttacgttttgcccaagttctgttatagaacctgtcatgaatccatttgatttgctattatcttaaaaagatattaaaagttttttgtaggctttaactttgataaactggatgcacatgcatttacttattgtcagtgcaaatacatccttgaggcatcttggatgatcccatggtgttttaattagttaggaaattttatccgctcattcctctaccgcattgatccagtcagtgctcgctcaaatttgttcattatacatacattggcacattctttgcatgaattgacaaaataccatatggaaaacactacagtgattgtgttcttgatcttgcttgctacatatctgtattatccttaatttcccgcagcaacgcgcggggtttcatctagtatatgtaaaactcggacccaaaatttttaaactcgtgttcatactataaaaacttatcgatttcagtcgaattttggtgggataatttattgcacagagaagcaactttgtgtaaattttgagcccgttatacacatggggcccacaatgcactactaaaatactaaggaaatttcattatatgtgtgtaaaactcggacccaaaaattttaaactcgcattcacatttaaaaaaacttatcaaatttagttgaattttgtaggaatgatttattatatagagaagcaactttgttcaaattttaagccatttagacatgcggggcccacgattgattactaagacccaaaaattctagttttaatgtgtgtaaaactcggaccaaaaatttttaaactcacgttcacactatgaaaacttggtaaatttagttgaattttgtaggaatggattattatatagagaagcaactttgtacaattttttgaatcattttatacatgtaaagttattttgggttgaaccccttaaacctaggttctaatggtttgatccatttatatttttggagcgacaaaaaaatccattaggacaaatttacggatagttttagtagataaatggatcgaccctatgtaagtttaagtgccttaatttggttttggtgattaatgacaaatctaattatatgagactaacgtttttatgagcctttctttgactagtcttatttggatatgaaagtaaaaatgatgggaggtatgtattaaacttcacatattctaacttggtatctcttgtggatccaaaatatagtgtgagctccctcattgatattgattgattatgtgcatatgcattccttcatatccatatgtatgcacatcttgaggggagcttattctatattttgttcattataagatctctaccttgatttgaaattatctttcatatcatctctttgtattgtttatatcggattattatctatcacaaaagagagaaaagattgaaagatcttggattaaacaatttgtgtaattgttactttggtgatagatgataaacaaatgtttatgggattaacctctcttttacataagttttcaacaaggttatttcccgataatgagatgtggtagatatgcattctttggtgatggaccttaatcatgacaaggatgaaattcatggagataaagcgatatgtatcacttcttatctcctactttttgataggttcatatatatgatttccatgttattgttatataagtgtgagactaatgtttacttgagtcttatcttatttagtctcctttacattgagaacatggagatcatgaaggtatgtgtttttttgtttatcttcatcattactacatatgccttctctatgtatataggataaacccccattggttcttctttacttatgcatacacttgtctctcttgtatatttctttgtatgcatatacttagggggagcaaatcctatatatttattgtgcatgttttagatccatgttgttcacctattatatatatcggatctttgcacttgagcttgcatacaagtatatgacacttatgatgttaatgaatactcaacaaacatatccatatctttcatatgcaaccggttggtcaccaagtggaggatgccaaccgatttgttgggactaatgttttcctttgaaccgtgcaaaggaatagatctaattgcgatgaggctaatgaatgacaccatgggttaatggtcaccaagccaaggacatcgtcatgttggcaagaataaagtcaagcttgtgatgagaataaagtcttgacaaaggatggcaaagacctcggcataaacatggttcaaccgaatggtcacaagtgttgatgttggctcaagcattgaccccaagttggatggcgcaaggctaaggtataatggagctaagaatgttttcttagtctttttcccggtcttggtgtttggtgtagaccggatttactagataggtgccgtactatcaagaggggtctatgaagcgagcatgtagatgattttgtgccatattagttcatatgcatataggtgcattttgtgggcttgtctagccaagtgtggtgagttttatcaagtcccaaacaaagagagaagtgggcacatcctataggtttgagtagcctcatgtggttatgtccggtggagtatcctttggagtgtgagccatttctccctgagaaaagttgtgtttcttggattgattgttcatgggttggatagccctttgaataagctttccatagagtccgagaacgccaaattccgagatccgagtcaaaagatatcgtcgttttactgacggttggttgtgctgaaaagtgacctgcggtctgaccgtgggccttaggtcggtctgaccagggctgttagccggtctgaccggcgtggtaaggccggtctgaccggccctattggtctgttgcactggtctggtttttggtggcgatacagagccgccagagccgcaactggtcagaccgagccgatggcggtctgaccgagccgtggacggtctgaccggccgcttcattgcggtcagaccgaccaggttgagtagtccgttacaaagtagtccggtctgaccggcagagcacagagttggggatttcgactccaacggctagttttggtggttaggggtatatatacccactctccagcagcaagggcaaggttttggcactccattgcattatcttgaacccttgcaagagctctcacacccttgtgcacttagtttatctagtaaggtgttagagagtgagttaagccaatccaagtgcattgcttcattgttatagctagtgtggcacttgatcatcctcggcaagcatcctagacttgttactcttagaggttgccgcctcttagacggcttgtagaggtgttgcccggtgacctctccgagaagattgtggaggaggcccggcgccggttgtgagtggtttggagttcaccaccttcggagtgaaggaagaactaccctagtgatcgaggctttggtagttctctccgtgggccggctcccgccttgcccaccccttgacgaagggggcgtgcggtggtttcgtggttgagcggtggagttgggctcgcctcaacggggattaggaaaccggcgagtttccgaacctcggtgaaaattccttgtctcttgtctcctttttttgtgcaaatttactttgagcaagtttacatactttgtgctattatcaccctaggcttgcaaacctcaacataggctagcttctttgtgcacttacttgagactagttgatttaggtttcgaattgtgcaaaaccattttgatttacgcttccgcatacaaaactcggttttagccaaaagtttgaaaaaccgcctattcacccccctctagtcggccttcttgatcctacaccttaaccattcccatcctgagttttgacgatggtaatatggtattatgccaa

SEQ ID NO: 19124 - DNA, 4040 bp, Oryza sativa
  unsure (1)..(4040): unsure at all n locations
nnnnnnnnnnnnnnnnnnnnnnnnnnnnnnnnnnnnnnnnnnnnnnnnnnnnnnatacttaagtactgtaccctactgggaattatctaatcgaaattcaaaagtcacaagcattctagcgcaaagatcacatgaaatagcctagtttctttcctttcgatacaaacgagggaagatgatttcttagttctaaccatagtcaggcacaccaggaatttgcaagtacatcaattgcacaacggaatacgattagaatgctacactgaaactcacggcagaatcgcacaaaattcaggaaattatgagatcacttgcagaatttgaaaatttagaacttataattgctagtacatcaaaaattcagaacgggaacagcgcgatacaaaaatttttctccaggagcaaaagaaaagaggcaacagcaacaagcactccggtcaggtgcaacgtgcttggctcacaaaagaacaagaagccaaacagaactgaacaggccacgcgacggccaacgccgagaaggttacatgcgatgcgaagttgtgcgaggagatgatgatacaggcgccgccctttcaccaggcttcaggtcggactaggacgccggccgccgccgcatcgaagcagaagagcacgcagatcaggtacccatcaggtctcgtcagatgttgcagccgcagcagaggaagaagctgcagagcgcggcggagaggacgacggcctcggcggcgtagaggacgtggaagagcgcgtcgtctaggagggatacgaccaggccagccttctccccccacctccacccgtagccgcgccgccgccgcagccccctcgcgccccctgcaaactcaccatgcctcctctcgcaaattccggatccgcgcgagcagattgatggatggatggggatggctctcctcctcagctggtcccccggcccggatggagatttctttgtttgaaatcttagaagtggaagatgatgagcagcagaagggctgatgggactgaagggtttttgtacgccatttgctggacttatgggttaattaggcccacgtttttccgttgcttagattatttcctactagcccaagttgctttcacgatttcagtacggttaatatagtgattcttttgccataaaaatatagtgattctcgtcttctcgagctgctatcatgggacctagtatgtgtgtttagtgcttagtgctgaagtatttaaaaacgatctgggttattggtaaaggaaagggaaatgttcctcgagcggtgaaacctaatggaaaaatcatggtttcttctgaatagagaagtttgtgtttttcaatcgggaagatatgaggttttgcttttgggtgtaagattacttaaaccacagatttgggcttactgtagtttctgagtttaatgtttaaatagtattgcgtgagatatatactgcgaatttcacaataaggatactgttttcgactaactgacaatatgtttcagtttcttcgcctttgaccactagctactcttaaataattaaattttgcttatatttatggacactaaacacttcaacatcatgacattttactaagtatttgcaaatatgttacacgagagacaagtggtcaaagtatgaaaataaatagtgtcgtataatttattcagaagcaaagggagttgtttttttttcccacgaagggtcaaggtgatatatcaaggcactgttcatttctgattccgaattttcatttgcacgcttcttatgcttctaaacggcgtgtgcttaaaagcaaatatttataaaattttatttgaatacttttctaaatatgactttttaactctgtagtagttaatttatttatttatgtcctcagatagtataaaaatagattattcattaatcctctaatttcaattatctcagggtttgtttgacacaattctagctctaactccatctctcgtggagctgaatgttagccaaacagtttaatgtccattaaaaatagaagtaaaactagatcgagcgctctaaacaaataaatatagagatgagactagtttaggttgctccacgaaacatctttgaaatgtttaggcaaccgatcacctgcaagattgtaagcttttattgtcagctcgtaataggacgcaacagtaataggtagacaaatccattcaacacaaaatgcatagcctttcttggcactccagggcttccaaagtaatggagcaattccatgctagattgaccctaacgaagacaagagtacaaagaccagtctaaaaaagagagtagtacaaagctaaactattccgaataatctcgccaatgcaaacagttgatcaactcttcccccttagccccatctcaaattcacaatcttgtgagcgaattcagagatgcgaataggaatattttgtacgtgtgtgaatacatatgagtaagtgcgtaagtattgtgagtgtttatatagtttttttaagtattgtgagcgtatgtgtttatacagtgtttaaaaaaagatcatatgaaaacacaagtagcaaaattagtttcatctacctaatataaatccttttagttgtgagggtagaactaaaaatccatatatatcgccaaattttacaacccaaatcacaagggagaacaaattgaaattgctccacccttttggctaatgtttcttaatgtgtatgaagtgtactccctccgtcacatgaaaataaatctgtagaactatgtgcaaattcctcctgtcaatttgcttttttataggatataggaagtacataaaaactatatataactactcaaaacaacccataatgatcctccattgatttaaaatacaatgctatttatatttcctacgcatattaaaaaaattcaaacgagaattcagctgtttgcaagacgcaactgctttattttccggattaaatcttttctggattcaacaaaggcaacgtattatggaaacccgtcttcccgaagctgacagggtttctgggtgatgtgcattcataacccgcaagtgtgagcccggaagtacgctctcgttctccgcatgcgggttgcaatcctcgcggcatccttggtaatccccaaacgccagggacagtagcgaccttgcggccgtctccccaaaccagatcggcgtcgggtctttgccccttttcacgagcccaccagcgcattctcgcagccgaaaagaggaggcggcggcggcggcggatcaaggagagggagcggagaagatggggggcggcatggaggtgcacaagaacaagtggatcgaggagtggaacgcaggccgcgagaacctcgagttcaacttccgctggacccgccgcagcctcgccgtcgtcggcctcttcggactcgccgtccccatcctcgtctacaagggcatcgtccgcgaattcgtaatcccctcctccgaaccccccctcctcttccttgccgtgccctcttgggttatccaggtcctaacgaagaatctctctctgtgcgtgcttgtttggttgcagcatatgcaggacgaggacgccggccggccgtacaggaagtttctgtgagtgctgcctccggtggatgcctcgagactgcgaccgggagaaggactctccgttcggtttgttctccatactgttttaattggacagggagtattttggagtgctcagactgttgcgtgggatctgtttgttgaataagctgtcatgacttgttgtcttttcaattgctgaaatcttggagattttattcggttaattcggctgaataacagtgttgcaatgttgtttgtgcgttcttcaggtactaattagaaccgtagtttgcttgtctcatttattaaaatctgaaatggattacagtgaatggttttagcatgtcgtttctctagtgtggcctacgtagtacgtgctattggattggctgaatagatgcagaaaattgatagcaccgatgcccataggcaaggnnnnnnnnnnnnnnnnnnnnnnnnnnnnnnnnnnnnnnnnnnnnnnnnnnnnnnn

SEQ ID NO: 19125 - DNA, 12344 bp, Oryza sativa
  unsure (1)..(12344): unsure at all n locations
aaccgtagtttgcttgtctcatttattaaaatctgaaatggattacagtgaatggttttagcatgtcgtttctctagagtggcctacgtagtacgtgctattggattggctgaatagatgcagaaaattgatagcaccgatgcccatgaggcaaggtattgaccaagaactttcttacgattaattatggctttgggagtttgagtgcattgatgttatacgggctgtttcatagcaacccaatgtaggctctaaataaaattgtatggattggaagctgcactgaggcactgataaagtaataatgatcattattcctatgtggcttggatgagatttcatttctagtctcaaaattattgtactttaccactcttcaattatacttgttccttggccactatgccctgtgtatttgctatacatgagtaggtgtctaggaccttttcagtttttgcctataaaaacattaagttactttttcttcagcacttgctagatatgatggtctgagtctgtgaacagcctaactggttgagtagtctcagttgcctggcaaatggttcatagcttatttgcataactttactgatatactgtagtatagctagttttttttttcttccttagtattttcatgtataaaacttcatatattcacagcgtttagtatagatgaaattgttagttacaatagctgtaactcatcgactaccgaaacaacaggtaatgctatttgagcagacctggagagagaacaggatttaattgcttttctgattcatgttgatggaaatgataggtaagagtacgaacagttttctgataataagttctgtagagttagcattcttgaactgctacagcagagtatgccactcccttttttgtggaaagggccaagcttcatgttgatggaagtacagttgactttcatcttgctatattattattgtattgtctggtgaagtcttatggaacatcttgcatactgatgatccattgactccagttatccactgaacattttcagcaaagtaatagatgaaactgtgaccataggccacatggtattagatgtgttgtgttgcatacctgtccatacacttctataactgggttttgttttctattgcactgtttcaatgagatttttttactgttagtaagaaaggtagattttgtgattttcttttgttggatatgttaatgtagcgtggttggttgaaagggcatgttttttacatactaggaaactaatttagcctgttctctatggaaaagatggtatgctagcaacttcaaaatctttgctgcttatatatggagtatatatatttgcatttgatcacgcggtcgatttgctgatgcaccattatcatatcatatgtacctatagcctccttcaaactactgggtatatatgttagattagacttaataaggctagagtattgttttaaaacatcgtgtatttggatgtcaccccatgcaccaattattagaaaaccattgtaaccatctcaacttgaacatttgatatctttaatttcttttatataactaaactgtcaccgtctcatccactccaatagctactgcgttgtatgaaacttgctagttcttgtttagttttttgcttccaagatgtgttcctgcttactgctggcgtgtataatgaagtatggactcaaaaagtctatgggtgatggagtgaccaaattgctatttcaatttaccagttgtggataacttcacagtgaccgtgttttattttagtgcattttttgcttgatctttagttgtctcttcgaagttcttaagaaccttcatcattcatgggctgcctcctttattttgttctgagcttctaaaatggaattaacataactgatgtggctgggtttactctttccttctgatgttacatgcggttcttatgcttagtaccaaataatcacataaattgcttttgacatgtcagtctaggttgatatgtcatcatagtggcacccaaatgaaaataaaatctgcctcatatgtcaaaatcctgaatctctctctcatagctacgactgacgaacttccgagcagaaaaaacatgagcggacacgttgtttctgaatattgcaggttgattgctggccatacttgtctagtgatgaatggtgatacaagtatcgaagccactgcccagaaaaaaacagaggtcagcctcattttgtgtattaagctgtcaacctatatcattggctcgcaagtgctctgccggtatctgaccaggtctacctggttaatgctacacttgcataaaaaaaaaatccatgactaagttcatgtttagcggtttagtgccatttctattcctcgtggttaatgctacacttgcataaaaaaatccatgactaagttcatgattagcaagtttagtgccatttctattcctcgcacaatccaatcgaactctgactttgcacggtcaatcttatctaacactgatagctactacggcaaaagaaataagaagagtagcctagtcttttcatggatactaccaagtttcgcctgtgcgtctgttgcttacgtcgcttgaaaattgaagcaagcaagcgacacgaagatctgcacggccaaagagaaaaccacctcgtggcgaactgcgtccagctcataggtatatataagctcttgatgctctctcctcttcttgcccattagcattggacctattggtcgttagtgatcacgctgggagctgcacgtacgttgaacttgcacgccgcgcaaccatgtccagcccgtcgccgacccctcctgctccccctaatcggcctccacagccacctccttcagcaaatccgccccaatcgccaccagctccccctgatcggcctccacagccacctccttcagcaaatccgccccaatcgccaccagctccccctgatcggcctccacagccacctccttcagcaaatccgccccaatcgtcaccaacaacacctacggcgtctactccaacaacacctncaccgtctccttcggttattccaccacaacctcctccagggaaccctccaccaccttctncggagaacccaccggcgcctcctccaggaaatgccccatctcctcctccggtgattccccccacgcctgctccagctccacgtcctccacctccggtggacccccctatgcctcctccagtatttncaccaccaccaccttcaccaccttttccaccaccgccttcttcagtgattgccccagtcccagcacctggtccggcccctactccgaatccggtaccttccccaaatcctaggcctaatccgcaattnccacctgctnctnctnctgctncggtgttcccctcaccacctcctcccgtgagccctccacctcttcctcccgtgaaccctccaccaccaccaccatccagacagaggccgagtccaacaccgtctccacctccgcctattgcaagccctccaccacccgaggtccaaaactctccacctccgccgccatcacccccaccaccacaggctgtcgaagcgcccaacgacgtcaccctcaccttcatcatccaaaagcagcgggaccacagtgggtgtgggcgtggctgtcgccgcggtggtcgtgatcggtctcgcggccgggctgatctacttcttcatcggcaagaggcgccgtcgccaacagcagcctccgccgtcattgccaggtacatatgctcgtatcacctttcctgggaaacaaattccttgccttcgcgttataaaggcacggcgccatttgaaatatgaacggttggctaaacggacggcataggtatattacgatgctgtatcgacggttgaagtaggtgtgtcactgcagctggtgcttgacttgctccttcatctaacggttgagatcgccagaaactatcgtcgcagctgatagatactcccaccgtcccaaaaacaaatccattcctagcatcttaaggtagaagtagtagagatgaagaataactaaaatacccttaataattgattaaagtagtaaaaaagatatgtagataaaaggtattgaagaaataaaacttatcgttttctgtgctaaggataggtaagatgtacggagggagtacgctttacgcttaaccttatcacacgcttgcacggctgttacccacgccccagtttgtttgtggtgtgttacagtaattccatctatttacttttgattacgcgggcgtcgagaatgatcatggtcaattggacatgaccattcaaattaaaaggcacatccacaccattttgaatattttgccagtgctaaccattatcgagttagcagcggtgtggaataaatatattttacaacataaaaggacaattacatgtttctcacatgcaaccaaatacttcctacatctacttttgatagtcatatttcatcttggtacatagactaacaataagtgattctacttatcatccatttaaatatgctattagtcatttctcgtaaacaagcgattcattaatatttacatttctcaatgcccatgtagctaatcttgtgtggaagaatggagagtcacgcattaaatccaagaaagtcattaagataatactccctccgtactcataaaggaagtcgtttaggataacgacacggtctccaaaacacaacttttgacttcttgtttctataaaaaatatttattgaaaagtgatatatgtatacttttatgaaagtatttttcaagacaaatctatttgtataatttttatattttcaaactcaacaacttgagagttattcatgatttatattcccaatttttgacttaaacattgctctaaacgacttcttttataagtatggagggagtaagttgttagattgaaatatgcctatcaaaaataaattttttagatttggaaatatgactataaaagtagatggagggactagttgccaacgattttgaaataatttgaatacatcgagttgaacatgccactcacatagattctcaagttcaactcgagctacagaaacaaataattcggctgtgaatagtgtctatgctgattatttgcacatttcggagaaatgggtagagtgcgaggacacatactatatataatcactttcttctttttttaaaagatgacgtcgttgactttttgtcactcgtttaaccatttatcttatttaaaaaattatgtaattataatttattttgttatgagttgtttaatcactcaaaatactttaggcataatttatattttatacatttgcataaaatttttaaataagatgattggtcaaatatggattcaaaagtcaacgatgtctgcatatctgccagtactaagatacttttttttatttgtgctctacaagtttgtgtgatctcatagagggattggcatacattttttaaaccaccccacccttgttttttttgtgatggtacgatccaacttcactctgttaatcgctcttttacgctatatcaaaactcaagcaccgaaggggagaccccgtggtttaaaatttaataaacttcgttattttttaattaaactaggaccatgacatgcaggttgccttcataaaacagaaatagaaagagaagaagaaataaagaagcgaaatagccatttcatagttttaaaatggtactccttcgactctgaaatataatgacatctatcatttaaaatttatcctgaaatatatcaattcttcaccaatatttttttcctaaccaaccataacctttcaccattgaaattctccacttacttcattttcttaaacaatcacaacattccccatttaaatccacatactttcttaatacccatatccaaggtaaaaattcatatattttagaaggatttagttttttgaattcaatttttcgtatacgatggcatttggtagcttcatgcaatgcctcctttattgtgtttcaagcttctggaataaaagtaatgtcttaaaaaagaggggggggggggggttgaaggattgtttacgctttggtgcaagtcatggctatcttcgttgctatacatgcttctttagttagtactccctccattttttaatagatgacgccattgactttttttcacatgtttgaccatgtcttatccaaaaaatttacgtaattataatttattttgctatgagttgttttatcactcatagtactttaagtgtgatttatatcttatacattcgcataaaatttttgaataagacgaatggtcaaacatgtgagaaaaagtcaacggcgtcatctatttaaaaacggaggtagtaccttgcaacagtttgacttatgcaacttgtcataaggaattacaattataaaaaaaaatgcaaccttctatcgtcagtaaggatattatcgggatgaaccattcatgcaagctaaagcatttggacctcggactagtagattcaatatgacgataacactatatgcgacacatgcactcacatgttaaacagattgttagataggttaagaattggtagtcgtaagagagaacgctagctaaatgcaatatttgatgaattaggtgatcacactttgagaaatgtcaattgtggcgagtataacacgtaactgtccaacttgcaatcatagtagaatatatgggaacattttttacaatatgcaagattcttctagtgaactattatgagctacaactacctttgttcttttcttcttaagcaaacgatggagctggttcctggtagtgccacaactttgaaaagcaagtattaagttaatcattcatcttgcaatatttgttcaaactagttatacaaatttctttaaaccctatctattatggtccaaattacacaaacccacactaatattgacatatgacacataaccctgatattatcgtcctaaagtttcacaaaaccacactagtttccattttgtcttcagatctaccatattttttttatacaatcacatgtcaaatttataaatatatttattctaaattttgatataagagtgtgtcaaaatggttagcaatgttattttgtgaaactttaagaccataataattatgttatatgccacgtgtcaaaatccatgtgattttgtgcaacttggaccgtaataataggtggggttttctaaaatttactccattttattttaggcgcgcatatctagtcgaaatagtgaagacaacatttgtgctcaacctatatataagtgatgtccaacttggcttaacccacctaatgtgaacttgaacttgatttgtatatccaaattaacatagagtgtgatgcgcaatccataagatatattgtaacacctatctttcggattgcacaaattacttatggattatagttataacagttcattttaccttttttttttaaaaaaaagaaataaagtctaaattatctttaaactattgtgctagtccgatttacactatatacagttgataaattgtgcatgataattagaatgtgtttacatctgttttcgcatcttagaacgtgattgatccatttatacatagcaacagcatgcatccaaccatcccatatactagtatggaagtgatgaaatcacttgattaaacatccgtttcctggcccctcatgatacagtcaaggaaaaactgttggccttgagtttgcgaaaggcggatggattcaattaagcccaaagccccaaaccgttttcagcaaattgcccaagaaaaataatcttaccttggcttgactttagagactcgcaagcttcatactcggagcagaaaaacataccgctcctgcgctccagatcgatcaactcagaacccaggttgatcgacggcgtagcttatatcttctgagagaacacgtaccgcagtcactgctcaaggaaaaaaaaaagagtacaagaaacggcaacagcttcgttttttttttctcgccgggcagcctgagtttcatttgtatttgcggtcaagcctttgtcatttgctcattttaaacactttgcgaccgaagttggagagtgagtatgctaagctgctagccgtctgtatctgaccggttctgcttgccacgctggcatcagaatgctcacgattacgcactgcggcgggggagctatacatatgccgtcgctgtcgctcgaggcaagcaacaaaaatctcttttcttgccccctccgtacggatcataccgatacctgcaccacgttgcacttgcacgcagcgcaaccatgtccggtgcggcgccaacgcagcctactccgcagccgacccctgccccgttgccgccgtcgccgccgcctcctcctccgccgattcctgtcccttcagcgacacctcctccgccacccccggtaacctcaccaccacctccaccggtgtttcctccgccacctccagtaccatcaccaaagccgacaccaacccctacaccggtgacgccaaccccaactccgccggtggtgccatcatctcctcctccacttgttccaagcccgccagcgcccaaggcctcgccgccaccaccgagcaacaacgtctcgccgccgcagccaccctctaacagccccccatcttcaccaccgcctccacagtcacccgatgcaggcaatgccccgtcttcaccggcgcctccgcaggcgctcattaatttatctccaccgccgtcgccgccgcagccggcgtcctcgtccgccccgtcgtcgtcctccaacgggaccgtggcagtagccgcgggcgtggtcggcgcggtcgtcctgctcggtctcgccgccgtgctgatctactgcttcgtcgccaaggggcgccaagccgccgccgaagccatcaccagccatcgccgtacccggtgtttccaagtaagttacgcgccctacgtacgtacttgcgtattgacatttgacgcgcgcgcgcggccgttgcacgagacaatgctacgtcgcgggcatgtcgacgcacgtgacaaccgcgcgcgcgcacgcatcgccagcgcgagagctccagttttttgcggtgtttagccctgatgaagtcaagaggatcgacagttcgataccgaaacggcggcattgcgtacgtagcgtgcctgcgtagcgcgttcgacctggacaccgtcttgtgtctagcggcgagcggttcaaacggcacgttcgcaccattctgtacacacgttaaggctaacaatgggaacagtactttaaacaccttacgcatgtgccatcttttcttgcaaacgcttgaaatagttataaaatatcttaagaaaactaagaacgtgtaagagcgaatttgacgtccacgcaaaagaatcattttgtgaaaaaaaatgcagttgtttcatacagttaaatttgtttttctatcaccatttataaatctaatttgaccttacatatctgtagagtaataatattagaccttatgaccttagttacatttggacaagacaaagtaaaatgctagggaccaaaattactccaactcggagtaagggcatgcatgctcaaaggtatagtccgatgcaagcttgtaggtattccaagtcggaaaaatgccctttcatataactatctcttgaacagactcttcattaatacatactccctttgtcatataatataagggattttaggttgtttatattcttaaaatctcttatgttataagacagaggaaatagaaaggagtattaattaaatcgctgcatgtgtcgttaactctcgttgaacgcttggtgttatctagtcttggatgtacaatgcttggtgctatctagtctcttcacttttttttttttgctaagagtcattgttgagcaattgttaagttaaacaacgatgtttccgtcttctctcctctcccttaagagactaaggtaactattatttcaattttcaaagggattaattagctgcctcaagtcacttaccttaccttacgatggttaagtcaacttgccacaaggattatcgatccatctgtccatccttacctatatatctacactaattgggaacattgtggtcgtgggccacttattatgatcatagatatctctctgtttcatattataagtcattttaatttttcttaaaattaaaattttaaattctaatcaagttaaaacatagcatttcaacataaaacaaatatatatatatcaaaatatgttcaatgtatatcaaaatagtttatttattttggtgctgtagatgttcctatatttgtataaacttaatcaaatttaaaaagttttggctatgaaaaaaaaagttaaaatacattataatataaattggggttaataaaatatatgtgcatttcacttcacgggccacttttaaagcccatgtatgtcgaccaaaacgtcatggcctacttctaaagcccatataatctatgtgataaaaagcataccattggaaattatgtgtacctttttagcgtttttttactttaattaaaaaaaacagtactccaaacgaatgcaactcattgcttattaatttcgatttttagaatcattaaattataaagataatactaaattgagacccccacataagaccaaatttgtagtgattaacttcgaattttagaattattaaaccaaaaaaaaaagctatagttgaaaattgaaaccaagcattagctcaatatttattaattacgaattcataactattgaatcaatacgatttaattgaaactccaaactgagtacagcttgatatatttattaattataaattttaaaattatcatatcaaaaggagctaaaatttaaactccaaactgaaaacaatttgaaatttatcgattacgaatttcagaattatattgatactcatgaaaaaagatgaagttgcatcttcaaaccgagtataattaggtactgatttattccaaatactatatcgattatgtgctgtttattgttgatttttttttcttgcgcgatgattcgggaatactggtgggcatcgaaaacgtgcgtgctgatcaccccagttagttgctttcgcctaccagaacttgattgatgcatacacagcaaaaacatgcatccaacttgccaatatgtatagacagtatatagtatagaattggtcgtgacgctgtgacgtaaccaatctcttgacagccctttcccctcatgaaacagtcaaggaaaatttctggttttgcatgtgcgataggcggcggattttcttaaccaagaccacttttcggcaagttgccaaaaagaacaatattctcccctcgatggatcgggacagtcacaaaacttttatcatcaaagcagagtagtggatcaatcgtttcacaaatcagaatactctgaaggctgatctgtgtccgtacttgttctgttgtctcctgagaaaacataaaaaccgcagccactgctcagaagtagtacaactgtacaagtcggcaagtggtttgtgtgattatgtttgttacttcacgcaatgagccgtctagccttgtccttggctcgctgctcgcatgtaaccgaagttggtgaggctgctcgctgctggtgtcgcgctgtctgcctgtatctgaccaggtcgatctacctgtcaaagactcacggttgcatcgaaaatacatgattaagttcatgattagcagtttagcgccattactattcctagcacaacgaagcacaaatgcacaatccaaccgaactctgacttcagcacggtcaatcttatctaaccacccaggctagctaactaccatcatacaaaggacagaaaaagattctcgttttttttaagagaagccaagttattgctttcgcttgaaccaggcgagcaagcaagcaaagccgaagaattgttacacggccaaagtggaaaccacctcgtggtgaactgcaaccagctcatagatatcttgcacgtaatcttcctaattagctagcccattggtatttggtcgtggtcgttgaatcataccgagagcctaacgttgcacctgcgccgcgtgccaccatgtcatctcaggcgccgtcggcgccggtcacgccggcggctccaccgccgcagacgccacccgtgacgcctcctccggtgactgctcccccgccggtctcaccccctccggtgacgccaccaccggtgactcccccgccggtgtcacctcctccggtgagtcccccacctgtgacacctcccccggtgagccccccacctgttacacctaccccggtgactccttctacaccggtggctcctccaccagtgccaccgttaccgccttcaccgacgccgaccccaa

SEQ ID NO: 19126 - DNA, 6243 bp, Oryza sativa
cagtgttggtcgcgcgagatcatgctacgtcgcgggcacgtcgacgcgacaatgcgcgacgcggggtcccccaagcctttttcggtgttagcgcgatcccatccacgcccttcgctgcggtcgtcgcgggtgaccgatggtggtgatagcgacacatcggcatcgcgtacagtgcgacgtattccatctcgtccggctcgtgtccgcggtcttcgcggcgcacactcgttagcgtttgaccattttgtatgctatgctcgtgaaaattttctccagggatgcatcgatctgtgcgcggcgattgagttgagctgatcgaatgttttttttttccctgttttgttgccgtgccacctgcagccgaattctacgacccgcaccggccgccgtcgcagcagcagtcacacgcgctgtcgccgagcccctcgtcgacgccgccgctgctgctgcagccgcactcgttcgtgagcagcggcggggcgtccgaggcggcgtcggcggtgccggggatcgcgatgatgggcggcgcgttcgggtacgacgagctggcggcggcagcggacgggttctcggaatcgaacctgctcgggcagggcgggttcgggcaggtgtacaaggggacggtgcgcgggcaagaggtggccatcaagaagctgcggtccggcagcgggcagggcgagcgcgagttccaggccgaggtggagatcatcagccgcgtgcaccacaagaacctcgtctccctcgtcggctactgcatctacggcgagcagcgccttctcgtctacgagtacgtccccaacaagacgctcgagttccacctgcacggtaagtacttgctgccggatgatgtaccattgttgcgtgtaatgctggggcttgcttgggctgacacgagtggttggtttctgcaggtagcggccgccccgcgctggactggccgcggcggtggaagatcgcggtcggctcggccaagggcctcgcgtatctgcacaaggactgtgaggttcaccttgtgtttcctccaaaatctaaggtggtgtttgggaatctctaacaaaaatataagtccctatgagagagacttgtgcttttgttaaaaggattaaagtttagtcctttcttcctaaacaccacataaatatatgcggaatctgtgaaactgtggttctgataagatggcatgctttgactgttgtcaggtcatcctaagattattcatagagacatcaaggcagccaacatcctgctggactacaccttcgaaccaaaggtaaatcgcgaaaatttggaacctgcaataattgacgttatacgcgtatttatcgcgaaggtgcacacatgtttgtacaggttgcagattttgggttggccaagtaccaagccactgagcagaccgctgtttcgacgcgcgtaatgggaacttttgggtaaacacatcaccatcacaaccacaacaatcaattacacttgcactcgtacgtcaaaagttcctcagtgcacgcaccacgcggactaaactttgtgctgtcaacaacttgtatctccagatatttagctccagagtatgctgccacgggcaaagtgaacgaccgttccgacgtcttctcattcggcgtgatgctcctggagctgatcaccgggaagaagcctatcatggtgtctcacggtgaccagcctgacacattggtttcttgggtgagtgggcttccgagtcttgaaccgaacacgtagatttccatttgccacggccggtgaaagtagtcatctctgtgtgtgtccaacaggcgagacccctgctggtgagagctgtggaggaggagaacttcgaggagctggttgacccgaggctggagaacaactacgacgcgtacgacatggggcggctgatcgcctgcgcggccgccgccgtgcgccacaccgcgcggtctcgcccgcggatgagccaggttcttgccaaaactcctcacaccttcactgaacaaacacaaacacacagcacacaccgcacggcttctggtttcagcaactccgtagcttgtacactgaaaatgtggacactcgaatggtcagatcgtgcgttacctggagggcgagctggcggcggaggacctgaacgctggcgtgacgcccgggcagagcgcgatgcagcggacgagcggcggcacgacggaccagatgaagcggctcaggaagatggcgttcggctcggccaccggtacgggcaccgtcagcgagtacacgagcagcgagttcagcgagccaactagcgagtacgggctgaacccgtccaccgagtacaccaccagcgcagccggcggcgacaccggggaggtgacggtggacgtgcagatgacggccggcgccagcggcgaggcggccggcacggagaggctgagcaggcggaccaccgctagacgtggcgggcgggtgtgacagtgcgacaccggaatttcggtgccccgcccggcgagcccggcgacttttagccgtacgtgatcgtcaaggttgcgatcgaatgaattaaatcattttgttcgtgtatatatacacgtaatgctgtcactgtaaattaaactacattccaaatcccgcggttgtttctttggttttcgaattcatgcaatttttgttggagtggaagtttgtaaattgtacctaccttcactaaccacccaggttaataaacatcaaagatgagatttgtttggaagctggaatgattcgtcttctccttcccgccctgaatatatgtactaaagattctgacatgctacaagttgactgaaagtttcatgttatgttcagatccacaatcgtgccatcctattatcttttcgtttttgaaaactaagctagattatgctggtgctatatcatgtgcaggttgcaacttggaatgaaatgctcgcttgagagcctatgtcgcctgacacagtcgatgggccgaccgatgttgtgggtgcctgggtggcaaacggacccaaagatcataagcctattgttaagtttttttttaataggttccgttaaaaaaaagttgtttttaataggccaagccatagcaaccatcagtacgcagtccctcgtacccgtttagtgtcatatatggatctctattcatttgtgaccatatcaatcgccctttcagtgtggaagattttttacgccccttttttattgaatataggatgagaaaaaatgtgcaaaagtcaaaactttacagaaagagaaaaaactatgggatgatctgtgctaggtatttcactcctatcagagcttaaagttttggcagcctctcacgtgggttagtgttgagaattctttgtgttgaaacactatcaggttcctttctttctatatctcccatatgctcagtaagagaagaatgcggattcctttcctgggcgtcccaggttgctagccatcgttgtccaccagctatggactaatgtggcggcgttctagctggtcggcttgctatactcctgtgccatccaattcgttaggatgccccaaattatccaggtgtatctgtactccatgaggagatgaaccgccgtctcaagggtgcgtctctgcacaagtgcagtatgctatccccaagtcgtaggcctgtttgaagttcagactctattttggatagccagccaagcgaaaattttacatttgtttggtccccatggcttctagatgttcgcattgtagttcgtgttgatggcttcgaggaactatgctttctaggctgagcctaccatgtactctccgggacttgtgagtttccaggtgatttcatctaccacatctagggttagctacacactatccactgttgtctagagggtcactagctagtctagaagctcggttatcattgctcctaggatcaagaggtataggtcttgcgactaggtatcatctgcaatcgcctctcttaaggttctgttctttcttttggagatagcgtaaacctgtggcaacacgtcctttggttggcgtccacacttccaggttgactcccagaagcgtgctattgcgccatccccaatggttattcgtgtcgctgtcggtgacatgggaccgggagtatcatgactagaggcttgggcagccgcggtcacccacgtggcctgaccccctcggggggtcgggcccgagggggacgtgcccaccccctcctctgtctccccgaggggtcgagccgctcctgtttcggccccgagggctggggcgccctgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggcctgtcacacgcctcgccccgtcccgtcggaatgatgagagcctcttgacactcgtccctagctggagccggcgtggtaactcctggagttagcacgtcagtcccgactcgattcatgccaggcttcatcgcaaccattgcaaggaagtcactgtatgaagaagggcagatgtgcggcatgctaaactgacgcgtggtggagaagaatgactggtctgtgactggactgatgccggtcacgtcatcggcagacaaccgtgctcccacgttgcatctgcttccggcggagtggaggtaggtatgacccatcccatcggagggtcattcagacagcggccattgcagatctcctcctattaatgaagaaatgacagggtgatcccctgtgtccgacgagcgacggcgctgggcatcactcaaggacaagcggtgatttagcttccaggcggaggcgtgagtcaagatttggtcaagatagggtgggtccccacctagaagaagagtaggtagaagtagtgcatgtggtatccccttgagatataaaaggaggaccttgcccacctaaaaaggggggaggagatcgagagtaaaaaagaacgagaagagaaggaaaaatgggggttctagagcttgaactctcttgctctccatttgctctgtaactccttcacacacagatccaccagaacacaggagtagggtattacgcttctcagcggcccgaacctgtatacatcgcccgtgtcttgtgcatttgctctctcgcgaacgttccacagatcgagggtgaagaacctcactcagcgcccccggccgaaccggcaaaggggggcctgcgcggtctcccggtgaggagcttgccacccgcgtcggtacactcttgggaggatttgtgccagcagttcaccatgaacttccagggcacatatccgcgccaaggtgaagaagcggacttgcatgcggtacagcgaggggacgatgagtctcttcgctcgtaaattcagcggttctgtcaagtccgcaataccataccgtgtatccccgcacacgcggtgatctacgcgttcagggggggcgtgcggcacaatcgcatgctcgaaaagatcgcctccaaggagccctagaccaccgtggagctttttcagcttgcggaccgtgtggctcgcaaggaggaggcctggacctggaacttctctggttccggtgtggcagctccggccgcccccgggtccgccgctcggtcagggcggcgggacaggaggaggaagaagaggtcggcctatttcgacgacgaggggcacgtcctcgccgtcgagggcgcttcgcgggccacccgaaaggggaggcctgcgagcgacagaaagaaggaggccggtgctcccagcagggagcgcccgaccggcaagtggtgctccgtgcacaacacctccctccacgacctcgcggactgccgcgcggtcaaaagtttggctgagcggacgaggaagtaggaggaggagaggaggcagaagcgccgtgagggcaaggtcccggcggcccccgccggcaaccagcgaggtgaggccaagcagaaggcccccgccgaggacgtcgacgatggcgacgataacctggggttccaggagcctcaggctactgtcgccaccgtcgatgggggagcgtgcgctcatgcttctcgccggagcctcaaggccgtgaagcgagagcttctggccgcggcccctacccatgaggcgacgcggcgggcgcgatggtcggaggtggccctcaccttcgaccagaccgaccacccgccgtgcgttgcccgggg

SEQ ID NO: 19127 - DNA, 751 bp, Oryza sativa
agcgagcgcgtgtggcgaaggtagggcacaggaaagaaggagttagggcgcaagcggcgaaaacaaggggaataatggcgaaaggaaggaaacaaatcccttcctcagtgcctttatactcttgccaacgctgtgcccggctactcgcttctcgcgcccactatttcgccccctcgtttctcgcgcccacgcttccactaatcccattcgcccgcttgcggcgcatgaggtggatatgcggttgtggcagtcgagatagatcatatcgtgcgcgcgttaattacgctcgccgaccgaagcgacgttaccatatctccagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgaccgtttcccttaaagagggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtccccccgagggggtcgggccgcacccccctcggccccgagggccgaggcgccccgacccctcatgggtttttg

SEQ ID NO: 19128 - DNA, 5667 bp, Oryza sativa
acccctcatgggtttttgctccgcgtatgggttaggtgagcacagtggggctcacctaaccacatttattgtggtttggttgagcgtgtcacgccgcatgtaacgcagtgcagtgcactcgtttatccggtctgtgaccagtcacagaccggtcagatcgcgggttaggtggtgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttgtgtgaagaagggtgagcatgtaggttgctaagctgacacgtggtggacaagaatgaccgacgtgactggtctgataccggtcatgtcgtcagcagacagccacgattccacgtcgcgcctgcttccggcggaagtggaggtaggtatgggccgtcccatcagaaggtcattcggacggcaaccatacaagtctccgtctgtttatgaaaaggtggggtaagtccccacaaaaaagagagaaatggtgcatgtggtatccccttaagatataaaaggaggaccttgcccactgagatgtggaactggatttttccagattagaaacccagaacaagggagaggctggctcatactttgtagctcctttatacacagatcttccaaaacacaggagtagggtattacgcttctcagcggcccgaacctgtatacatcgcccgtgtcttgtgtgtttctggtctcgcgagccttccacatacagagagcttagaatctctccctgagtccccggccgaaccggcaaaggggggcctgtgcggtctcccggtgaggagccccacgctccgtcactcggatataaccatgactaccttatgtattaataaatcaaaggcacatatgttctacattagatttacttgttatatatttgaacaaccgttgctacacaatgagtttcgtgtgtttttgtttgcagagatacttgcttggacgaaagaaaagagaccgagcataagaaatgcatggatgattgaagaagttgattggggaccaaaccaagaccttttccaagtattctttcatctcaccacgtcacttttggtccatagaagacaagagataaagttctatacgttttggactcgggcctcctgacagcatcaacttcaaacggacctagccgctgatctagaagaaatttcggggcccatgagtacttgttggaaagcttatgaagtctactttcagatggttttggttccacatcaaaactcctaccgagctgccgggaatctgcaaaacaagtcatgcacctcatccagtccgaatctgattttgagttttgggccttgtaattgtgtcgtgggcttagcccaagggggtgtgcgccctatggaaaccttaggacgttcctaatcatatttattcagtagccgtcatcgtttagagtcgggttttgcttagattaatctgtcgagaatagtttcgccgctagatcggtttgtaagaccccaactcgtgagcttaatcattcatctgcaattttggttgttttctatctcgctcttgtttgtgttcttcgattggcaaacagggattagccttctcggcgaggtcatccgtgtttcgacacgggtgataaccagagaagacgtggtgttgcgattgcggggctcaagagcgtgcgcgttcaagaagccggatcgatttgtgtcgcgactctgcccaaatcgttgtttatcagaacctttcggaagatcgggaaccccagtgcacatcaccaaatcccctttcttgctcactcgggagcatcggctctcccctcctctctttgctgatgtcgacaggcagcacggccggcgagccctgacaacgcagatcgaggggcggtgcggccggcgagctctggtgggcgcagattggggggcgatgtgtctggcgaactctgactagtgcagatcgaggggcgtgtggccaacaagctccgggcggtacggatcaggggtggcgtggacggcaagctcttggcggcacggatcaagaggcggcactcccctgaggtggagccgacgagctctccggctgtcgctacatcaagtttccccagtgaggaatcgagtaagctggcggagtggatcaacctccttgccctagtcttcatttcgctcattcctctccgaccgctcctccttcgccatcaccgcgacccgacctgccccccaccactttttcccatactccagcttctccccttcctcgtcagcactcggcagcatcgccaacaagctccaagcctgctcggatcttgacatggcggcgcagaagaatggggaagatttgggagcagcaacagaaaggggaccgtgctcgcaccttctttttcgggcgtgaggaacctgaaccctagctaggagccgcaaaccttgcaagggcacgggacccacctccttttctcctccacatcaacgttcagcaacgaggtcactcgccacgtcgttgcactgcgaaaggcctgaagaagcgaagcttcgtgtcaatatccataggttgtcaggtgggcaatgggacgactacattattctaagaggacaactggttgcagggatttggtgttcgttctcttgcactggctgtgcatgatcggatccttgctagcattaggaggcgtaggacagtggccgaggcgctactcggccgcagatggaataagggacatcaatggtgctatggggattcaaaccatcctggattacctcaatctttggtcgctcgtacaatcggttgatcaactaagtaaccaaccagactcaataatctggaaatgggaaagctcaggtgattactcttccagatcagcctaccaatcattgtttctcggtcgaatacctttccaatccacgctgatatggaaatcacttgcgccacctcgctgccactactttacatggttagtggcactaaatagatgttggacagttgatcggttgtgcaaccatggactgccacacccaaattgttgtgtcatctgcaaggatttaaatctccggctatagctgccgttatagccggagaaagctgctggcaatagcaaccgctacgatatgttcaatttaccgctatgttttctttgacgctattagctgcttttagctgaagattgccgctaaacagaccatctattagctgccgctaaaggccttggtgggctgaaattccaatgaacaagcccatattaggtgaccgtgtggctcaagtgctcaacaaaacctaactctctcgctctctcctcctctccgtgattgcagcagcagcggcggcgacctgcagtggcgacggcgacggatgctgctgtggctgcgaccggcaacggcggctgctgttctcagaggcggcggctgcacaaatccctctccctcctcactcttcttccccaagtggtggtggcagctgcgcccggagaaggcagcgatggctgcgccaatccccactcttttcccccaaccccaagcaacgacggcggcgaatgcatatgaaggcccactcctctctcccccaagcgccaccaaggcaccaagctcgaacggcaggcaccatgtcctagcggagtcagaggcaggtaggatttcttgctttgatgttgtcgagtgttgaagaattgaagtgttttgaactattttgaatctctgatgttgtcacgaatttattatgatattggcaagtttatgttcaatttttgcaaatccgctaaatggcttaactgcagctatagccggccatagctggccatagctgatgaaaagcccagcagctaaagggcttagccagagattttaaaccttggtcatctgtgatcaacacgacgagagcatcgatcatttgttggtcgcatgtccagaatccagacaactatgatggtgggcgctcagagcaattgagcaaccacattccatctttggctctgtaacagtcggaagaaaaggacggatgctaccgaatttacatgttctttaatgtaagacttcacttatatggttaaacatatccatcatattttgcatgtagggttgttttggtttgaagccccaccaaaagtttattaatgtcaaataagatttggcactaacaaaattttggtaggattgtgttgtttctaactctattgaatggataagattcgatctccatccaaatagctaacaaaaactgttcaagaataccaaacaattgataggagaagaattgacttcaatccaaacatgccgtaaacgatgactctccggtaacaaattgtaactgtccactcacaacggggcacataaggaaggtgcatttgcaacctattatggacaagttaggctcacgtctggcaggatggaaaggaaggctcattcagcaggcgggaaggaaaacactggttacctcagttttgagttctataccaacatacttcctcactgccttgaaacctcccaagcaattcattcaggacatggacaaaatgagaagaaaattcctctgggcggggcatcaagagctcagtggtggaaagtgcaaagtgaattgggaaaaggtgtgctcaccaatcaaattaggaggattggggattcttgatctcgacaagtttgcaagagcgttaagactgcgacggttgtggttctagtgggaatgtccacacaaaccgtggattggtacgcctccgccctgtgatgatcttgataggaagattttcgctacggccacaatggtctcaatcggtaatggtaggaaagcagatttctgggaatcaaattgggtgggacaccagccactcaaatatcttgcaccaacgctcttcactcattccaaaggaaagcaccgaacagtacacaaggctttgagcgataatcaatggatcagggacattaggcatgacttaaccttggcgctggttcaagaatttgtccaagtccatcaacagatttgggaaagtggaataactttagtagaggacaccgaagacactatcctttggaaatggacaaacaacgacaagtattcagcaaaatcggcatacatggctcagttcagcggcggaactggatcaagagctgccaatctgacctggaagtgttgggcaccatcaaagtgcaaaaatttcatgtggctactactgcaaaacaagatttggacagccgatcgtctacaactccgccaatggcccaacaattacttttgtcagctttgctacaggaacttggagacaacgcaacacctcttcaaagactgcccctacacaaaggaagtatggtagagggtcctctcaagattaaattgcaatcacactcttgcaccacacaacgacgatgagggcttgctggaccggtgggaaagaagaactagccacggcgacaagaacaaagcgaaaggaatgcgctccattcacatgttgctcggttgggagatttggtgcgagcagaaccggcgagtgttcaaaagcaaagaggccacaatgtcgtatctggtgacgaagattgtggatgaaatcaatatttagataggatgcggggcaaaagatttagctagaatagtgcacaatagcgcctgattgtaaccatcccactcctctgtagtccc

SEQ ID NO: 19129 - DNA, 908 bp, Oryza sativa
gtacataaacaatatgatagcattgttgatgatgtattcatctgctgagtaccaatacacaagcacctgcaacaagaagtatagcaaattgatatttagcaattcaagaaccagctagtggatatgtcagctactcagctattattgtataaatcagacttactggaacattggtaacaagtgctagtatagcggacgacgagaaacaaatcagtgacacagtagctaaacttgcaacctgcagagaagcaagcattgatatagagaattacagatccgaaataatatatccttgaagattgaagaaattcggatagactgaatggtcctcgtaaaaacacatactatttttcataatttatgctactatatatgaaatactccagtatccagccaatagtagagccccgcttggcccatggtgtggtgttagtgcaactagtcccacatcgagagtttacataagttggggccagcatataaacccgtacattgcaatcataacacttctgagttgacccttttacacaaaaggggacaaaagtgtaagtgaggtgctctttatacatgggctcacttctcagaagagctgggctcatacagattattgaagcaggagtacgcatataggggcatcctgttttttgtcatctggttttataagcactatgaccatattggaatgatatcttaaagtatagaatttatcagaactgaaaccaaaagttgtatcttttgaatatatgaccatttattcaattaatttaatattgtatacgatcattattagtttgctttctcatgattttacaaaatacaatacatgcagcaaatgataaagcagtagagagatgcaatccacaaattgaatgattctgcaagagttataccttccgcttctcagatga

SEQ ID NO: 19130 - DNA, 720 bp, Oryza sativa
agggcgaattcgagctcggtacccaacacaggagatgagtctgctgttcgagctgctattgaagagttctcaactgatgttcaacctgatgaagatagtattttaaacaagttaagaactgatgtccttttccaaatgtaacttgctgcgcatgcatttattattctattattgaaataaattgacactggaatgacaatcttacttcgataggctcccaactatcaacaaatgtttctctgctgagactatcgaggacatcataaaagcttttgtaaggattctttcaattacttgcttgaaaagtgttgagttcctcagactatagaatattcatcttggtttcatgctacaaaataatctaaacaacaataagtggacagtattcatcttatgcccaaaatatatcatcgtcaaccaatagcttctggaaaaactagacacagttacacgcaacaatggtacatcatccggcagcaagtacttaccgtgcaggtggaactcgagcgtcttgttggggacgtactcgtagacgagaaggcgctgctcgccgtagatgcagtagccgacgagggagacgaggttcttgtggtgcacgcggctgatgatctccacctcggcctggaactcgcgctcgccctgcccgctgccggaccgcagcttcttgatggccacctcttgcccgcgcaccgtccccttgtacacctgcccgaacccgcc

SEQ ID NO: 19131 - DNA, 736 bp, Oryza sativa
  unsure (1)..(736): unsure at all n locations
ttcagagtattctgatttgtgaaacgattgatccactactctgctttgatgataaaagttttgtgactgtcccgatccatcgaggggagaatattgttctttttggcaacttgccgaaaagtggtcttggttaagaaaatccgccgcctatcgcacatgcaaaaccagaaattttccttgactgtttcatgaggggaaagggctgtcaagagattggttacgtcacagcgtcacgaccaattctatactatatactgtctatacatattggcaagttggatgcatgtttttgctgtgtatgcatcaatcaagttctggtaggcgaaagcaactaactggggtgatcagcacgcacgttttcgatgcccaccagtattcccgaatcatcgcgcaagaaaaaaaaatcaacaataaacagcacataatcgatatagtatttggaataaatcagtacctaattatactcggtttgaagatgcaacttcatcttttttcatgagtatcaatataattctgaaattcgtaatcgataaatttcaaattgttttcagtttggagtttaaattttagctccttttgatatgataattttaaaatttataattaataaatatatcaagctgtactcagtttggagtttcaattaaatcgtattgattcaatagttatgaattcgtaattnnnnnnnnnnnnnnnnnnnnnnnnnnnnnnnnnnnnnnnnnnnnnnnnnnnnnnn

SEQ ID NO: 19132 - DNA, 557 bp, Oryza sativa
gtttgatctcgaccgggtcttgtggttgctgaatgctgagcgatgtgcattcctttttcttcaccttcttcttctttttttccttttctctctcttttatttttgttctcttctctcttgcactccattgtcgatgatattggttgttgcagcagtgacttgaccaatagtcggtacgtaattttgtaatctgtacatagcaaggagataacataagtggaatttagccgaatttgcatgattcacatttttcatgttgtgatttatctgcgtggcaccaatgtgattcttctcgtcttttgataggtctcgatctgagcttaaataagccacttgttctccctatgcctattatcttgtgaaaaaaaaatactccattcgcgatggaatttggattgtaagatagacgaatttgactgttctcggttcatggattgaataattatgaatgacaggtagagatttcattactgttattcagatcaacaaggcgttaagtgttagcatttgccatacaaataatgatagccagaaaagaagggaaagagatcagcttt

SEQ ID NO: 19133 - DNA, 547 bp, Oryza sativa
cacgacgcaggcgcgctcttgcagcgccatggcgcgcgcctcaagggcctcttcacgctggcgggacgccgattcggtctccgacgcccgctgttctcgggcagcagcagcatcaagcaccccctgggcggcggcgagcttcttacttagctccgcctcccagctcccatattgaaggcggagggtgtcctgcgcctcgttcatcacggaggtggcaatgagggcagccccccgctcctccttcactttcttggagatctccgccagcaccttcttacgggtttcaagctccgagacgtgccggcggtgagccttacagcccacctgcaccatggactgcaccgagcgtcgaccctcttcgacacgcgcccacacggtgtcgagctacggccgctctgactgcaagacctccacctgggcgcttaacccatccaacaccgtggtgtttgcggcagccaaggcctgcagaaggggctctgcgttcaatggggcgatagaaggcgtggggcaaagccgccttggaaaggatgccacgcgggtcgggccg

SEQ ID NO: 19134 - DNA, 690 bp, Oryza sativa
  unsure (1)..(690): unsure at all n locations
nnnnnnnnnnnnnnnnnnnnnnnnnnnnnnnnnnnnnnnnnnnnnnnnnnnnnnnctgcggtcacccacgtggcctaaccccctcgggagggtcgggcccgagggggacgtgcccaccccctcctctgtctccccgaggggtcgagccgctcctgtttcggccccgagggctggggcgccccgaccccctgtggtattggcgccacgggtgtgggttaggtgggcacagcggcgctcaccaaaccacttttattgcggaatggacaagcgcgccacgccgcatttaatgcagcacggcgcacgcatatccggtccgtgaccggtcgcagtgtgtgaccggtcacagaccggtcagatcgcgggttaggtggcagcaggcggactgtcacacgcctcgccccgtcccgtaggaatgatgagagcctcttgacactcgtccctagctggagccggcgtggtaactcctggagttagcacgtcagtcccgactcgattcatgccaggcttcatcgcaaccattgcaaggaagtcactgtatgaagaagggcagatgtgcggcatgctaaactgacgcgtggtggagaagaatgactggtctgtgactggactgatgcccgtcacgtcatctgcagacaaccgtgctcccacgttgcatctgcttccggcggagtggaggtaggtatgacccat

SEQ ID NO: 19135 - DNA, 1001 bp, Oryza sativa
  unsure (1)..(1001): unsure at all n locations
nnnnnnnnnnnnnnnnnnnnnnnnnnnnnnnnnnnnnnnnnnnnnnnnnnnnnnnnnnnnnnttgcaatacctctttttgcctaattcctcagccgatgggattgtatgaccagcaggaagttgaatttgcttttctcggagtagcagatcaaagatcttgtcaactttagtaatatcaaaatcatacttctcctcttttccagaactttttacccattggcatggtatgacctttttactcctcacccacttggctgcagctatttcagaatcgtcctcgtcatcatccgacccatacatgtacggacaaacatgattaaccttcttagagtttttcctaacttccgcagacctatgctcatgcaaggttactttctgtatcagatgtgacaagctatcaaagtcttcatacgagaatttctccctaatcggagcaatcatatcctaaaaagccagatcggctaactgggcatcagttaaactcaaactaaagcatttgttcctcatctccctgaatctctgaatatactcgtgcacaggttcatcatgccgctgcttaatcgctgtcaagtcggataatttcatctcatgaaccccactgtagaaatagctgtggaattgattctccaaatcggcccagctattgatcgaccaatacggcaaagaggaaaaccaagtaaaagccgatccagacaaagataaccgaaataacctaaccttcagagcgtccacagccgatgcttcaccacactgagctaagaatcggctaatgtactcataagttgacacaccatcttgtctcgaaaatttggagaagtccggaactttgaaccgattgggaagaggaactctttcaaaccactcagggtaaggctgccgatacaagcttccagtctcttttggtttaagcccaaactgttccctcattacgtcagcaatcacatnnnnnnnnnnnnnnnnnnnnnnnnnnnnnnnnnnnnnnnnnnnnnnnnnnnnnnnn

SEQ ID NO: 19136 - DNA, 1010 bp, Oryza sativa
tatgctaaaaaagctgcttttgatgcttgttctttttggtacttctatggtgatagcggatggtgttgtcacaccagcaatgtcaggttcacatatttctgatgcgttgctcattgaatttctcttcaccgtgtttaatgatcattatatatgcttttatgagtgatattgtgctagaccaggttttctctttcctgtagaactaattccagttctttctattggtaaaaatctgcagtgatgtctgctgtcaatggcttaaaggttggaatatctagtgttaatgaaggtgacctcagaatttcagtttattgacacatagcactaattgattcaggaaaagaattaagtctgtactgtctacgagtacatcatacttactattaatgtgaaactttggcaggtgaagttgtcatgataactgtggcagttcttattgtcctgttcactctacaacgatttgggtcaagcaaagtggcgcttgctgttggacctgccttgttcatatggttttgctgccttgctggaataggaatttataacatgaagacatatggttcagctgtattacaggcatttaatcctatgtatatatactattattttgaaaggaacccaacccaagcttggatgtcccttggaggctgtcttctatgtgctactggtatgtgttttagccatgttgttaatgctatttgtgatatattattgaatgctaaattatctaagaatgtgcttacttctagcgcatgtcttttttccttatttgttcctgagtgaagtgcggccggtccttaaacttgtatagatgtgtcatctaggtccttaaactctcaaaatgcatttttgggtccccaaacttttcatgggtgtcatatagatccaaacgggctccaacccgctccgtgagatgacgtccacacagtgggatccacatgtcaatcatgtagaaaaaaataaaatttaaaaagagaggagaaaatgatgtttttaattttgaaaaataaatg

SEQ ID NO: 19137 - DNA, 18876 bp, Oryza sativa
tgggttccagttcctttttgtacctcagaatgaaagatttctctttcgtcgggtctgtccaaagagctatcatatgtttcgctgcattgctaggtatgtatgtcaattcttttccagacttgatagtaactacaaatgtttctactacctccatttcaggttataagactttctagcgttgcccacattcatatagatgttaatgaatctaggcacacatatatgtctagattcattaacatatatatgaatatgagcaatgctagaaagtcttataatatgaaacagaggaagtatctcctaaaatgaagtaatatttgccttgcattctctctttgtgctccattgaaggttggagataataaatgtaggtacttgtgttttatgctgtgtccatctgtttgtgtttcacgtaatgcgttgaatctgctaaaaacagcttgctttgttggcatctgacagttttgtcaatgtgcagctggggctggtatccccttaaagctgtaatatgtttgatatagtatcatactgttgtcacagtgggggagccagagatggactatgccttcctctatatctctgatgttttgatactcctttaaattcttgtcagaggttctattgagctttggttctagtccctgacatgaaatgattcctttgggccatggggtctatctctgccactaacttcagtgaatgaaaattgatttctttaaaaacttatcttcagttacttgtctgtagctattgaactactttgttttgtggagtccctttatgcatatccgtaccaaagtatgatagtgctaatatttactagcagtgattctatgtctgttgattaacatttgttttattcgtcctggcaaatatagctgttgcaactttctacccatgcatatctacccccagcagttcgtatcagtagttatatgtcaagaagctggcctgatagaccccatccatatagctggatattgaaatattgaatatgtaatctgctgtcttgaataaaatgatgcagtgtgtgatgattgagccggttacgtagctatgatctatccttttttaagcactgattgagccattccttgtgtaatcttcttcttcttgttgcatgttaatcattcatggatggttgcaggtatgggtacaaggacatacgcaaggaggactacatatcatttcagcagcttctgatagagagtctcgagaagttcatgcggcgggaagcccaagagcgctccctagagagtgaccaatacgacggtacagactcagaagaggaggttgcatcagcctcgtcaagagctctcgtcggtcccaatggcagtatcaattctctcggtgttccacctgccgaggcggctggtactaccgagcacccaaccattggatcgagcatgtcgttcgacggatcgctggatgaggcgatcgatgggaggggaagcctcgacgacgagctctcgttcatccacaaggccaaggagtccggcgtggtgtacctcctgggccacggcgacatcagagctcggaaggagtccttctttgtcaagaagctggtgatcaactatttctacgccttcttgaggaggaactgcaggagaggaatcgcggcgctgagcataccgccctcccggatgatgcaggtcgctatgcaatacatggtttaagggccttcagctgttctgcataccattttgtacttcggtggtaagggcactttaactcccattggatagagtggcaagaggttttcaaacaggctgcttaccaccaacagaatcatcaaaacactaacaaagctaatactactgtttaaccgaagccaatgagaaaaaagaactagtccattcagcgacattaacaaaaggtcacttttacctacactcatctttatgtctgaatgtctccttgctgtaattcaccaagacgctgtcctcctggggtgaaggcactggagcctgaatctgctgaatgcaagccttgtcatgtcccagccaacacaaaacctgccctggcggcttttgcttgtccgcttgtgtttagaagaatcggagacagggcagagctatcaattgtcacagctgcacggctgcgccaatcactcgaatcaccgagtatccttgtacacgccgtacgcccctcctcctgcccgctctaaatcaatggctccccagatcagatcgggcgttctccttcagtgtactgcttaccactactactggctcagagctcagtatttaatcaggcgctcttgatgatcactggagtattaacactcgaaacctgaagcatcgggagcgtttgtctccagtcacgacgatgttgtgttgctgcgtgtcgatggttcgcgcgattgcggcagcgtgtgttgggtgtcagctcagctcacggccgtggtgcgcgtcgcgataagcgtgaagagattgattggctgtttggaattgggaggaaagattgatggatgggtggaaccgaaaatctccggaatgcgagatacgggcactggagcctggagtgaccggcgttcatccatccaagccctgcgtgagcgagccaggccgggtcttgttgacagtttcgacgccttaagacgtgtcgtttaccatggtgtcacgtccatttctttcacagctacttctagtagctctttcacagctacttctgatccatggttagcggttgattactgtagcagcatggtagcaaatcatgtattaaatatctcgttagattcgtctcgcaaaatagcctaggggttatggaataaattttgtcaataatctacgtttaatactcctaaataacaagattccggagggctatttaatagcctgaaggatccaaacaagaccctggtagctctttttgggtaagaggatttacagaggaattttacagtaactgaattttacagagtccttaccatgcctggtaagttttcttataccgctacgcggtgataactttcggccttttcccaatcgagggtgttcacaatcaagggcttctttggaacaaagggtgttttgaaatttttggaggaactcaatccaatgaaaatattttccgatcaaagaaatagccgtcctaaattcctttgcagcccgtttggttggagagagtttttaggagggattgagagtttagagggatgagattattaagtgttttgtttggttgggagacatgagaattttggtggaatgaggatggagaattgaggaaagaactcccaccttttcaatacctgggtagggcaggtaattgggagggaattcctcctttactttatctaagcaaatctcagccatccgtttttattaatgacctaatcttcaactaaactctctatcaatttccatcacctctaccaaacaagatattgggattaaaaatcaaattctcatcttaatcctatcatcaaactcccaatcccatttcatccagttaccaaacaagccgttgaagtttctttggattggttcaaaacatagaaatttgaatgttagaagaattttcacatgaggtctaaccttttgaaaaaaaatcctatgcctatcgctcttgtgattccagtgtattctgtgctatatctaaatggtcattttcgaagttttcttgtattttttaatcataggatttaaagtgctaagataatctaatcttgtattttttttctatattaaaaatcccgctttaaaaacccaagtgttattaccttgtggcttcagggtcacaagcacatactttgcacgttatttgaatgtctagattcatccctaaaatttgaatctttttggacagaaggagtacacatctctatggtgcatatagctaggaatatagtgcaatgcttgtgtacgtgatgagtacgtagtacgtacgtttatcctacctctgagtctgaggtgagtgaataagaaaaggacagttgtcctcatcccctcatgattaattgcagttagtaactaatggtgatgagcgtactgatgatccttgttactactattggctgatcgatcgatggacaggagtgacattccatggattaagacattggtgattggtgaagccatttggtgtagttagtgatggcagagagagaaggcgggaagggcacgtgtgatgcaatgtggcccacagcttagtggggaggaacatgcgtgtatgatgtcgctaggagtgggtgcatcatatcatggcgtccatggaatcaatcaactaatcctccggttcttttgcctggttctcagctgtgtactgtttagagagagagagagaggaattaaccaatcaaaccaggagtgttacttacgctaatcattccctttgagggagattattattacctacttcttcctccgtttcataaagaatatatttatagccattcttgataaactaatattccctccttgttccatcccagcaaatacctctgacgtaaagacatgaaagaattattatcacctcgtttgaatcactctaatgaaaacaataaggcaaattttgctacaaaacactgttattgtgtggttttagctatgggacactgaccaaactcacttttggtggaaacacttcataaacgtggtaatttaccaatggacaccgtgtcgattaaaataataattttcagttaaggaggagagagaaatcacgtgaaatgtcaaaaatacccttgcgcctacatgacagctctccatctctcttcctctctttctttcttttctttctcccttcttcttcttcctcccgcggcgggtgagcagttgcgcaacgcacagtcggcacgacggcccgagccgggacggcccagcgtgcggccggggaagcagcggcgcaccgccgggtacccaatgccaacgacgacgaggtgcaagcggcggcaccgagcacacaagcacggcggtggcggcgacgacgacggcggtgcagctggtgcggcggagcatgtggccgggtcgagctcggcaggggctcggcagccaccgggggggagaaggaggcggcacggggaaaaaaggaggagcagactggcagcggtagggagagggccggcggtggtggagaggaggaatggagggtcggggcgtgcacggcgggccggcgcccgggtgtggctcggcgcgtggccggtgtgaggtggcgtggcggtggcttggccacgcgctggggagggcgacggtgccatggtgtggtggcggaggaagaacgaaggcggcacggtggcatggaagggaggcggcgccgaggaaaggggtggcgtaggtggtggccggtagcggtggggaaaaagaagggggcaccggtggctcggctggggaagcgggaaggccggcgcggcagagtggtctcgtgcagggggggcgggccgacgacgcgcgggtggtgggtggtgatggtgcggcgtggccgtgcttgagtgctggctggctcgaaggtggaacgaagggaggcggcatgggaggaagaggaggtcgtcgtggcgatgcttcgtcgggcggtgtcaccgaggaaacagcgaccgggagaagagagaaagaaaagaaagagagagatggagagctgacatggggccaagggcatttttgatattttacgcgatttctcactcctactcaattagaaattattattttaatcgacatcgtgttcattggcaaattaccacatttatgaagtgttttcccccaaaagtgagttttggcagtgtcccacagctaaaactacacaatagcagtgtcctgtagtaaaatttgccaaataataacaatgtgtataccccatacgaatagagattttgaggataaaggatataaaaaacaaattaaagaggaggaaggtgctagtgcaatacatgtatgaatgcacatcttttgttatgaaaggttgtaaaatgtgtgtttcttttaaaaaaaagtgattgtttcttatattttgggatggatagaatagtgagaagaaatgattaccgttttccctcatcaatacttttggtcacaatttctaaggtccaattaaatgaacatgcatttttaagccaaaaattttaaacgttacagataaaagtgtttttggcacggagggagcaatccctgaaacagtgtttgctatttttctattactaaattattaggtttatgtatggatcgatgacgagagttttcaccgggtagtagtgtgcagtaaattggaattttcaccgcagccggccggcaggtcctgtagatgctgcgtgcggcgctcatctgcatctgcacggcctggcgctaccgccctgggaacctaacaaattcagttgggcgcatgcagtggcagccaagccagcgcctctgggctctctgcctcagcgttcagcgagcatgcagctccccctctggtcaatagagtactaagaacacgtaccttgtcctcaccatggccgcgcagcaaagttaagcttggtttttactctagtaatctgcggtgagatttttgtctctccctgtcatacttctcggccgtaattaagatagagctgtgctactgaatggttattccaggcatcctatcctagatggtttagaaaaactgtcaaaagtaaaactataccccaactggcatcgtttgcaattttaccacaaccaaagttacaattttaaaaacaaatctattatattattaaaggaatagaaaaaaaaaccttcacgttcgctctcatggtctagaaattctcacattaatcgaagaaaaagaaaaaacagagtccatatagaaatacaatttagaaatagctgaaattcggaattaaaaaataagaaatattagaagaggagactagagtctatatagaaatacaatttagaaatagctgaaattcggaattaaaaaataagaaatattagaagaggagactagagtccatatagaaatacaattaggaaataactaaaattcagaattaaaaataagaaatattagaagtagagtatagagtccatataagaatttaaaactaactaaaattctgaataaacataataaaattataagtagagtttagagttcgtataaaaatataatttacaataactaaaattcaaaattataaaaacattggaagaagagtctaaagtcaatataagaatacaatttagaattaatacttctaaattaaagagtattgaaagatgagtttagagtccacatagaaatacaattagaaataataaaaattcagaattaaaaataaataatattggaagaagagcctagagtccatataggaatataatttacaaataactaaagtttgatattaaattaataactaacacgtatataaaatacaatataaatattatatattagtagtttcgtcagggtagtacaaaatttaaaattatatgacatatataattttaatatatctgaataatacattgagaaaacatatggagtatgttattatatgacagaaaatataatggtgctagccgtgcaatctgcgcgggccaccatgctagttaaaattaattttgatgatttttctcgtagtttatttttagtattgcctttaaattcaaattgtttaattaagacataaatataaaagttttaccttattttttttaagttgctatgtttattttctttcacgatttaccagtcatagagtcatagtgtactcccactgttaaaaaaaaaactcaacttagtacaatgaatttaaacaaattgtctagattcgttatactatgaacgatcatcctcacctaaattaaggcatcgttcgttctggggagataggggagattgagtctcgttttccgtgcgcacgcttttcaaactattaaacggtgtgttttttgaaaaaaaattctatagtaaagttgctttaaaaaattatattaatctatttttaaaatttaaaatatttaatactcaattaatcatgagtattaaataaaatatttaatactcaatacgcttttcccattctcctcaatccccttctactaaaacacacccttaggtttttttggatggagagagtaaattgctgaggaaatgatggctgtgttattcagttccacgtgagagaccatgcaaaggctacattgcagacaaatcttccttttctggtaagattaacttagagtgtcttttgtgtggaactatacgtatgtcataattttaccgaagattactccatatgaaccatctataatgagagatttcgaacgttaaataaaacatgaccattttttattacgaggaacatgataaaatgttaaccttgcaaaaagttgcaaatgtttatccgatccgagactggtgccgcttcgtccttaattaatttgtttggaaaaacatcatgggaccccgcttgtcagtgccgtcacacacaggcacacttggggaaatcccgaagttgcagtttctgatgtcatttttgtctgacggggggcgtggtggctactctccttccaacgtgagatcatcagcaaggaggaaaaacgcggccggccggcgtacgtgtcgtctccggctgccatcattcacgacaaggaaaacatcgatccgtgtatcgttcgatcgatcgacgctggatcggatcgatggcagcagcaaattaacacagcacgtacacgcgcgtgcgcaagcagggcgcggccgagtcaacccggtaatcgacgagcagggagaaacacaagcgcattttgcatgcatgcgtgccagtacgtacgtgtgtctgggctggccggtcgggcatgctttatagtatactccatccatctaaaaaaaacaaactttaactcctaatacaacgaatatggatagaggattgtccaaattcattgttatagacaggttggtttttttgacagagagagtaccttgttatcgacatgaaggagaaaaaatacgggtactctttgagattatcacaaaaaattttatattattttgtcaaatactttcaaatgtaactaattaaattataatattagcattactacaatgtatcttgagtgtatgtttgtttccgtttgaaaaatggaggtagcgcatcagtagtatgctcttcgtgtgaccagtagatcatgggtttaaacctccacctcgtgcttgcaaaagacaaaattttcttcggctagcacgaaccaacccccataaggcggtgcggcggggaggcttcccctcccccgcctcttctcgcctgcagcaacgggaggcctgctccggcgtgggtgacctcgagagggcaggctcctctgcctctaaatcgtcgctgcgcaccctgggtctaaccgctagcctcttctccacccactcttcctctgcttcgcgggacctccacccctctgccttttcgtctccttccccacctcatctcctctgcgaactcggttctgctactccttctactatgttttgattgaagctctagtttttcatgtttgttcttgtttgttgtagtttgtggatgtggatgaatctttgtttgtggtgtgtgaatgtggatggatctctgaatgttgtcatgtggatgccgattttagggttccaagaagtgctagggatttcaaaattctttttgaaatttatttttttgagcgaaaactgttatagcatgtaggcattctaaatcattcatacggaaaaaaatgtctttctaggcggaccatataactcatccacttgcgaaaatatattatagcaggcggccacattaggcccacttgtggtaattgatcttcacacgcggttaggccgctcgcatgtgaaaatgttgattttcacagagctgcgtgtaagggggccatgcacccaaccgtctgcaaagatccattttgactgtatgcaaaaaccttttctatagtagtgatagtagctctgacttcgcctaatcaacaaacgcacagccactccgcagctgccaccacactgcattgggggaggcatgggtcacctagacacaatagtccatcacccctatgccgagcatctctctgccatgaaagccaatgcctcctccctgatggcgctccgtacaaccgaagaaataagcctaaggaggaaaaataagcctagccaataaagggaggtagattgtcatctaacccattgactgagcctatgacatccatgccactaccatccatgtcgttatttggccagatcagacctctgcctccatgagcactgccccgtgcctccgccatatcagcgtccctccatcgagcgaaccactccgcagtggccgtctctccctcccacttcctctcctaccattggccatggacaactagcttcatagaggttgttgtccttcctctacgtttgcttgtccgcactgcacaaccgtcgagcacacgaccgccatcgtggttcgccgaactacacgggtctagccaacttgcccactgagtgcgccttatttgcctatccctagatacaacaacccgcctctccacgcattagaccaccaaccgcgccttgcgggcatctctggtcaccatgcacatatccgattgaagggcgtcatatctagctaggaggacgccagatccagttgaggaagcgttggatctgtttgttcccatccgcttgttgccatcctttttaagcatgactgtgtcaccgtcggcccttcttggagaacgagggccaccgaggaagatgcatgaaggctctgttgttgtcgtcatcacaaccgcatagagctccatcggtatacttcggtggcaacgagggaacgaaaggtgggaggttggatagcgatggagaaacgctttggtcacctcccatgacgtcccacgggagcgacacgagagtgcagggtctatactttcgtttccatcgaaatttgggggtcagattttttttttgtcatgaaattatttaaattaacaaattttgactaaattttacagtaataaatttaatcaaatttaaagaaaccaaaaattaattgcgatcactgcgagggcggtcttactactcatcttttttcgtccgtaatttcttcattttctttaatcaacaacgtcctgtagaaaactggatcccgtcttgatcttgcaaataacagtatccaaaacgttaacacccccccccccccacccacgcacacacacacacactaatatatggtcgttcttgcatgctacaggcattttcagaagatgggagtgaagggatgataagcttctttggcagcagtggctcctgtagatagcacagttacctattgatgggagcaagggctagctatcatgtactactactagcacgatgtgaatgcggtcatccaattcagagcccccagttactccgccgtaccccgcaaggatcgcgttccaatctctcgctgcctgctgcaaatgcggccgctgctgcccgcgtcagacgattcaactttcctctcttgctactcctaatttctttctcatttttaaccggtgcaaccaagccgatctttccaactacatcgatcctctgttgctttccctttgtgcgcttgtgtgtgtgtgcgcgcgcgcgcgtgcgctctcatcggctaggcggtttttcttcggcgatggctttgattctcgttcgatcagacgatcaccaccccattttcttgctcaccgtacgttttatgaactgctatgtgtaaaaaaataatacaaaaacgtttttttaaaaattatataaatctagttttgaagcttgtaatagttgctgcttgctccgtccgtcccataatataagagattataggtggatatgacatattctagtataataatctgtacagacgtcacataaggatgtgtcacatccacccaaaattccttatatgatgggacggatgaagtaattgattaacctaatgacttattttattttgtgtgcaatgaaaaagctgaagcccacatctctttcgatcgcaaccttcggggcaaagttgtgagcatgaaaccatcgggagtatctattttttacagtcagtggacttatatgaattattcttatgatctacatgtataattaaacaatgttgaattctaacgaaggattgttgatatatttggacaaggattaattgaaagctcaagtcacacttctaatgaaggatttgtatgaagtttaaggattagttttggttttttttattttgcaatatgttcttgtgtattttttttaaaagtgttattcagtcgaagcctgcaggggtggcgtagaatggtgatgaattcggtagggttaattattactgtgtgtagtactgtattccatgcatagtgagcattgatcgatccaaattgatggcaagaaacattggactgaataagcatgacttctacagtacgtatgttgtggtgcaacatgtcagattcatcaaatacccttaattattgtacttagtgatgaacaaagatgtgtagctcctacgtatatatgcatgtatattctaggaaaatacttaggatggacatgttggtgagatccttcttaaatacttcctccgtcccagtctttctagcatttaaaaattgtcctaaaatttctccccattttaccccccaaccatcatcctatatccaactatgcattattaattaaggggtattatagtttttatctttaaaccttagtacatatatgctaaataacctagaacgataaatattttgggatgaaggtagtagtctatatatgaaagttggtatacatcaatattctaattccagtacgtgtgtattgcagtggtggagagtactttgtaaatgtatacaaattaaatctatttatgttctcctttcatcataaataaatgtgccgttttttcttacgtacgtactcaaacccggcctagaacttcataataaattctgttcacagttatactttatttaaatttaaatacccccgttttaattatacaattcaaaatcatttatcgatcactctcactgttagacaacaatactgaacaacgcatgtgccacgtcgaatatatatacactaaaagtaaacactactgatgctaacacaattgatggaaaatagaaatgcatgcatatggatgcatatacaaccattcaccactgcagaaaagccctaattgttgactaatcgtgagatgtggatagttgtgaatagtcctcgtggtgacgtgatacgaaacagccttcttatggtttactattaggcatgatatgcataattaataaatatgataattgcgagctgagatcacagaacaaaagggatagaaatggaatgctcacacacatggattatatatatatggagtagaccatatatattgtgtccttaagaagagaatggtgtgtgtatagacacacacagagaccaattcatatgaggaattttacagtcgttaagaaaataattttgaggtacctaaatgttacactaaaatttttggtatcttgagatacttaatatttagaggtacaaatttttacatttgaaaatatggtacctctaggtaccttctaaggatagtaaaattatccaattcacatattttgtgatactgatttaatttgttagtacgaagtgcagatcctacttaaaaaaaaacatttcaaccagagaaaacgtcatggatctctatatatcttgtcaacattttctgtatataaaagagaaaatgcatgcctacaattaatatatacacattattgacttaattatatatggaacaattttactagctatagctagtttttcaccgactatatataattgttccgctgttccatgcatgcgtatcatcaatcaaggaaatacatatatatattcctcactgctatagcagaaaagcaaacattttattgtctacttatgtcttttcagtacacgatcgagtaatggcattggttgtaaagcacatagacagtagtacacagtaccactggtaattaagcttagctaatataaattggctcatgcatgcacaccagtactgtagttttgcagggcctgtatgtgtgactatattttttttatccctatgcataaatttcaactttaattatattgtacttttagtttaagcagatcttggatcgatgattaattacaaatataatgccgatttcagaatgaatatgtgcgtgttgcatgcaagtatatgtcacacgcatatattatgacttatgagagtaatcttcatgtgtagaaacaaccaagctagcaaggactgtaatattaagtacgcatcaaaatgcataatattaattatcgaaggtaggatatatgcgtattccgagtactattactgttgtacccatctacagttaataggtcagttcttacatttttggtgacgtggaaccgacatatatacttatacaaccgtacggttctaacaaaaggattaatggcatttatgggttttaagctgttgcaacaacatcaaacagtgtcattcaacaatcaaaatgatatggatgagtaggtacggattatacacctagattttgagtgattgtacaactgtcctaccagaactcatgcgagctacagaggtagaaagacatgcatatggtgatttttgtaataataagatggatgcgagatcaatgggacaagtgttctcgaaaaagatggagagccatgacaaataaactatagctagctagccaattaggaaagcaaagcaaagcaaattcctagaacacgacattattccatcacctagctagctaggttctgaataagtccatcacatatccgaccttcatgctaattaaataaattaatttgatacatagatagatatatgttctcactagctagagcttatatagtacgtacatatatgtgctagacgtatagatagcttataccggttatatgttcctaaaataatttctcaaccatgtaagatctgttatatatactagatgaagttcaacattaattttaaaaccatgtcagtaattaattaattagtaatgcaaaacccatcctatttcagaaggctaattttctttcagtgtcaaataattaatttctttcactcatatgtaaaaaaaaagggtgatttttaaggtaataggtgttggcccagaaaggagatacttaaattcggcgacatcaagttcctttgtattttggattttttaaaaaaatgcaaagtcatttttgacaaatgttagcctagaagtaaagaaatttagcacattggaacaagcatcaaagtattttttttaaaaaaaaggaacaaactaaactcagatgagaattcataattaatataactactataattaagttaaaacacatatatagctgaagcaacaatatttaaaaaaaaacgaaattccaaatcaaatcgttttcccatttcccccatatgcatgcatctccacataaattgtctccatttgtccccccatttaattgttttgtttctatctacctttccctttcctgagtgatatgtactatatatatgtaattacctagcagttggtgtgaacatagccagcatgcatcaaaatgcgtctccgagttgctacgagacatgcaggtaagaacaagcaaagcagccatgtttttggcctctccagcagccaagagcatgcacaaaaaaagattctgaccagaagctagcaacacctccatgatactagcactaaatttgagtacatcaccactactggagaatcctatgatccatggcagaaaaaaaaaggagagaaagaaacacatccatgagaagaagccagccagcgcagaattcaaagatcagatcacgcaacaccgtcgccatgaaaaagagagctaacaaaggtgttaaagctgcaagagcatcactaaagtgagacatgcatccatccatgcactaaaagtgatggagtaactagctagctatcacactacatatatacatatatgtatctggagtatccatgtgtgaagagaactataatcctaggtacacacagaggagggatgtatatatgagcaaattaattaatctgtgaaaagaaattcacaatatatatccatcagaatgaacaaacagaagttttaatttctcatagctcacaaagtcatcaatgatacaagcaaagttttgaacaaaggaaacccccaagagaatgagaaaagaaagaagagaaaaaattcactctagaagaggaacaaggaattggacgacccttaacaagtccaatgcatgagaactcaaaaacagttctctaattatgctgcaaggtggtgatctaaagagtactattataacttatacatctagagtacttcccaaagccaaggtagggtaattaaccaattaaacacaccgattaaaatgccgagatgagagagagagaaaaggtcccccatatatgttcttgcaccaccacaccgccatggatatgccgcaagaacttcaagctcttctcatgtatctatccccccacaccgtatgccctatatacaaaataagctactacataccacccaaggaaggagatcaagaagccaagaagccaagtagagctagctagctagcaaatcaagtagtagcaacactagctagtgcacttacactttctttgcttctcttctcctcccatgattttgttgatctctccttccttcttgttcatcaatgcatcccaaattgatcttccgctcgccgccgcctttccaagatcatcgaccggccggagacgaggaagaacgcggtcggtagtcgatctgtgttcttgatctccttcttgatcgaccaccggcgatgaaatcttgcaggaattttttttgggttcttcgtttggttgttgaattggctgctctagctagctatttttctgcctatgagatgatgatgatctcttctcttctcttctctctatctctctccacagtgtgctctctctctcatctcagctttttttttccccacaaattacatgttattttttagtcaagagatcgggaaattaactcagggaaaattaaggtggaaaaaaaatagagttaacgacgacggcgaacggcgacgagctagctagctagctagcacagtcggcggcgtggaggcggcgcgcgcggcaggctgggctagctagaagagcgtcgctatggaggatccgcagttggcgaggtccggccatgccgcggcggcggcgccaatgccgccgttgccccagtagaggagcgactgcgcggacggcgccgtggaggcggcggcggcgctgaccgccgggttcatcgacgcggccgcggcggccatgagcgcgtccgacgcgatgatgctcgcctcgacgttggacgacgacggcgtcggcaggtcccagctctgctcaccggccgccgccgccgatgacttctgctggtggtcgccggtggtggcctccgccttgacttggagctcctcgagccccggcacgatggagccggacaggagcggcgcgtagaagccgtcgaggaggccaccggtggcgccgccgtcatgcagccacggcttggccgcctggatctgcgcccccgcggcgccgtagccgaggccgagcaggtgatccacctgcgactgatgctgctggtgcatctcgaacgcggccgcgtcggacaccaccgactgcatggcctggaagagcccgaggtggtcacccccggagccgccgctcccgagcagcagcgacgccagcgaggttcccccggtgagccccagcgccgacgacagcgacggcagcgaccctggctgcggcagcgccagcgacgacgcgggcgaagtcccagctgcaccgccgccagccgacgagacggccgccgccgcccggcttcaaggcccgcccctcccacgccgccaccaggcgccgcgccgccgctcctcgaccgcttgttcttccggcacccgccgccgacggggacgttccgcagcgtgccgccgcgcgtccagtagcgcttgcacgccttgcaaaagtgccgcggctgcgacagccagtagttgttgtagtagcagaacttggtgttcgccgagtcgcaccgcgggcaccgcagcgcctccgccctcgggtccggcgcccccgcccccgccgccgccgccgcgccaccaccaccaccacctccactcctccccgccgccacccctcccccacctcctcctcccgctgcagccgtagccgcaccccccgtttcagccatctcccagatcacacaactccacaaaaaaacaacagatcactccagaaatcgatcgatcacggcgcgcgaggcctacagagagaaacaaacaaacccaaacacaaacacagagggtagcgagaagcacactaggaggaggggagggggtgggtggggttttcaggggggaaggttcgctgacaagagctagaaaacaaggcgagcgtgcactagtattattgagctctgatggcgataccaccactctcctcctcctcctcaccaagtagagagagagagagagagagagagagaataccaccaccgccgccacacacgcgagatgaacagggtgggtgagtaggggtagacgaacaacaagaagaggaagattgagaggtagccttaaaacctagttatatagcgatgccgtcgtcgtagaaagcgtggtcgatcgataacggggattgatcgagcggagttggagttagtatatatttgtatatagcaccagtggtgtggtggtcgagtcgtgatagcatctggccatgcccgccgcggttgctacaaaccatttgtgcgtgctagcttgtcaacaaactgacggtatgcaagtgtgtgtgccgtggtccctggttagcttagcttagctagcctgggggggcttgggttattgatcaagtgtgttttagcttgtaaaaactgctactagtactgtgctag

SEQ ID NO: 19138 - DNA, 24456 bp, Oryza sativa
acacacacacacacacacacacacacacacacatatatatatatatatatatattaataattatattaattaattaattaatttgcactatggttatatatacttggtgtcggtggcatgtgagggtagttattttttgtgtattactaattgttacgcacaaaagtagaatttggattgcgactactttattcttacatcatagattcagaaaaagcctcgaatatttgtgttttgtactaaatcaattccaaattagatgtcatcttagacaattcaaacatgaaatatttgtgggcgccattttatgtagaagtatctcactaacattatatttctttcgtccctgaatttcatatttctttcgtccctgaattttaaactccatatttctttcgtccctgaattttggaaaatgaaaaacgaaattgcaaacccctgctcaagacttcattgatgactaataagaccataaaatcaacgtagccctatcttgtgccattggttttcaaatatcaatttgatatgtctatggtttcttaattgccctccgggatccaactctattatcaatttgactatatataatcatatacatgatttattatttggttattgttatcgttaagtacaaatgaatgtatataaaaaggtcctggacttttgcagaaaatggagtttgtaacttaaaactaagtgattgacaatataatatcattatcaacatgaacaaaatgtctcattcccctaatttagccgcaactccaactccatgatatttgtttttttaagttagaggtacccaacttctatgtttctttaagttggctggagctgtacttaaaaagagaaatgcactgtaatgacatactgtattaaaaaaagttactgttgataaacatttcaatcttggtcaagatatttttcctgtcccagagaattgcagtacaccatgttagtttccctaacatcattttctttgtttagtaaactcacttctcaagctcggtgaatatacaacttatacatctaaactacgctgcagtttgtacgaaggtttgtttaaatttattatactagaaatcgtcatgttcatcttagattagtttttaggggatggagaaaacacaccacagtgttaatttcattaaccaacgtaaaactcgatttctagaaacgtcaatcttagatcgatgtgcataaatgacgctgtcagatcaatgtacaatcccacggtaggacccggccgctcctgatagactacaagtccccaaacagtaaagcatcaactcgcacagtgctacacttccttcataaaaaaaactcaaaccagaaggatatgtgtcacattcgaatataaaaaatctaaataaaattttgatatttgttcatattcattttaatataataaatctgaataaaattttaatatttattcagattcgttgctcttcagtataacgaatttgtacaaatatttaatatttatctaaatttgttgtaataggagttacgttttttaagttggtttattttagaacgaagggtgtatatacacaccacagcacccctatattatctgtgattatctcaaccaaatgaccagtcgatgtaggagtagcaacaaaccgaacaaagatactggctagctagctacctctagctcatccatctatgcttagctctagctagctatagctaaaattaagaaatttgctgaggtagacagtgagaatcccgaggcccccaaagtttttcgcgtcccccgagaagaacaattgcccgctgttgttgcagtcacttcccttttcttttctttttactcgtgtgtcccctcttgctctcgttttatactacactgctggtacttttgcataatttcgctgggggtcccccgtgagattggccccaggaaaagacgcacggaattaagcagtgcgactgcataatactccgtccataaatacgagggatttaaccatgcatattattttaccgaaatttaagatttaaactgaaattattttgatttccttgaaaatttactcactggaaaagattatgccgagcaaagaagcaataaatgtagtggttgtatagattgataaagcagtactttaaaaccctataatatatttacggagaaatggaaaaggccaaaatcaattagatggacggagtacgtactactagtagattagatgcacgagtaagaattccccggagggaaaacgacaaggcgtcgatcggccgtccactgctcatcggtcggcagggcagattgacacgtggacccaccttgcctgtgggccccacggtgggggagccggccagccgggtgcagctagcgttgcctctgtgctgcgaacggtgtctgcctgatcgatcgatctattggccagccagaaccgtccgatcgaacgttccgtactaccaagagcgccagattatccctcgaggtaaataaaagaaaaatctcagtgtgagcaagctagcttagcctagctttttctttatcttgccaaatgtgtgatgcatgcaaaaccaagaacaatcactacaagcatccgtaatttttttaacggccaactgatttcttggcagtaaaaaaacagccgccaagtttaaatatgttgttaataattctaatttgtatcaagtagacatgcttttttttttgtggctgagaggcttaacaacgaaaattgattcaaactaatgctttggattgaacacggacgataagtttaccatatagcaaactcacggttcgatcagtcctcacgtgactatagtctcgatccacacacgtacagagagttcgtgcctagagagaggccggttgaggccgttggtgtcctacgtacggggtggtggtggtggtgcatgcaacaggcgtgcgtgggctgtgcttgtgcacgacgacgacagggcatgtggacggacagctcacagctccactactactcccttctaccggccgcgcactatgcaacgcatggatgccattgcatggatcgatggatggatgcgtgcaggtaagcctctctgtttctctttcgatgagtgagtcagtgagtgagtgcactggctatctatctatctatctatctatctgtactcgtccagctctacctatctgtcgatgatcgatctcacgctgcatgcaggcaatagctgctagctagctggaataggcccgtttagcaagctagagagaggatgaggagagagaggtgaaagtgaaggaacagtgagtttggtatctaccagttttgtcgctgacagattgtaagaaggccgggaccgatcggtcggccggcccggcccctctctctctctctctctctagatcacacaatatcgtcctgttgacgcacctggtgcgtggaagtcttgttgcgcgtatgcatgaatgcatgcatggggcttagcttatagccctcgaggtagcactgcccgagagagagagagagagagagagagagactgtgcgtgtgtgttgagatcaggacggacggcgtagtacgcactactgggggggcgcagcatggcggcagtggtatagtactatactgcagcgatgaatcgatcggggcactgtgcgtgtgtggttggtacgtcggtgcgagcaccttcacatctcccatgacgctgctccagcacagtaacattcgtacctcctcatccgcctgcctccctctctctctctctagatctctcctcgccggcgatggcggcaacggtgtacgtccggctcgttcattctgatctcatcttcttcctcgcacggccggcgatcggccggccggtgcaataatctgcaatgacatgtgtcgagtgagcatcatcagctagttctaattttcaccgtgcacgtataaatgtgaatccaatggacaatgcgctagctcgaaagctaagcatcgcctagcgtttgcatcactacttagaaaaagcatttttgtagacgtgagttttttttccaggcggacataaccctcggaattaaatgaccacctacaaaaatgtaaacgaggtgaagctcgctatccgcttgtgaaaatctattttcgcaggcagaccactgcaaaaattggcgtgaaatataaatagacgcgacatcactagattttttttctaagtcctatcctctcgtctccctcacctctcctctccctcagccctcagctctcctctccctcagcgaccgtgggcattcggcgacgggggcggcgggaaccgacgacggcgacgcgtgggggcggcgggatccacgacggcgaggcgctgggttggcgtcgacgacgacaaggcacggggacagtgacgctcgggggcggtgacatccacccctgacgcgccttgcctcccctatccctcctagatccggttgaagggggcagggggaggcctatggccggcggcgcggggcggacggcggcgaggcacggccgtgcggcgacaacgtacgcatgcagcggtggacgcgggaggtcggcggcggcgttcccacctcctagatccggctggcggcccttcccctcccatcccggatccagtagcattgtgaggaagggcagcgatggctgcatgcagcggtggagggggatcctctagagtcgagcgggaggtcattggcgttccccttccctcacggatatgatccggctacgttgtggggagggcgcgggctgaggcgacgcgatcattggcggcggcgatggcactcccactcccagattcggacgggggcttccctcccctcccctcccctcccctctcggatccaactacgtcgtggggagggccaccggcggcggcgggctggcgcggtgagcttgtggcgcgcgcagctccctttccctccctctccctctcaaaaccatcgtggtggcacagctcgtggtggtggtggtcggagggaagggcggcggcgggtagggctgggggcagccaattttttttacgctgaaaatattttcgcatgcgggtagatttagctgcctgcaaaaatcattgatttccgccggcgtttggatgcaggcggaggttatggccgcctgcaaaaatatgttttggccattgtcgaggagagatcctctctagcgggcggtcgtgagacccccctttattagttcggccggggaagatggcacgatgatcaagagcgtacttccgcttgcagtctagctgctagatcactacctagcctctgtgaaagacaggagattatacaggttcgggccgctatcgagcgtaacaccctactcctgtgtgtagaattgtggttaacttttacaagaggttttgagctttaagggaaacccaactgttcttcctttcgagctcaagttatctgagagtcatcccctttttcggtggtgacggtcctccttttatagttcaaggggataccacatgcaccgtccatacctactcctccatgggagggggatccacctatcctggatcagaccgccctccgtgccttcaaccggaagcaagatggttcagcgcccccaggtggggcccagcaccattctccgcctgatacgggggacatccctgtcattccctcttaaatgcatagagactttggcggctcaccatgcgcgtgaggggcgcccctggtagtgtgtcgatgggtgatgaggacatcctccactattacccgctggcaaagacgccaaagtcgggcggcgaccgtgtaagcctttgaataatcccaccttgcttagcttgggaggaggaagccaccttaaaagggagagccacccttcccctattagactagtcttttagggagattgggcctttcctcgagtgggtgtaccgaagaactgttggggtccgggcaaccttaatttgttgggcctcggtcaaccccacctgggccggattgttatcatttggtatcagagctaggcccttgttaagggggtgggaatgatgaggacatcctccactattacccgctggcaaagacgccaaagtcgggcggcaaccctgtgagtctttgaataatcccaccttacttagcttgggaggatgaagccaccttaaaagggagagccacccttcccctattggactagtcttttagggatactgggcctttccccgagtgcgtgtgccgaagaactgttggggtccggacaaccttaatttgttgggcctcggccaaccccacctggaccagattgttatcaatgggacggggcgtacctgcccctactccgcttgacacagggcggaacgtgggggcacttccacccgtcccatcgcctgcgactagtcacggaccggtcaagcttgattgacatgagtcaatcgagcggcgccgcacgtcctcccacgctgcattaaatgcggcgcaggacggttgggacgccgcgcattgaaggcacggagcagcgtttctcgccccgcctgctctccccgccacgtggttgccgggcaagggcctcggggtagcacgccccgaaaggcccgaggggtgtgacgtgacaccccgaggccctctggccacttcagcgctacccgaggggcgggggaaaacgaggccacgtggtcacgcgacttagattagaaggatacttccctcgactgtgcgtacccccgagcccttttcaccgacagccacatataaaaatgttttttttctagtagcgcattgtgtacgtgcgtatccagttgcgtagctagcgcatgtaaataaatatgtaatgatacacttacatatgtgcgtgcgtgcatatatgcatgcaacacacagtccctgtacaaaatatatactgtactatatagatatagccagtgccagtacgtaacactgtcgtcctctcttgcgtgcgtgcacgtacgaacgagatgggaaccggacgccgctcgcaattcgcaaagcaccgagcctgcgtacgtacgtgcgtactttcaggaaccgcgcatcgacaccactacgagcttaccacgacctgtttcacgcacgcctttggtcctgcaggttgaacgtaccgagaggtgcgcgcgcgaaattaaacaatttatgtagccaaacaacaacctatctttttcacgaacgcgcaaaaaaaattgtacgccaatatattcagggccggccttagggcagtacaggatcgcactgggcctccaaaaattaggggcctccaaaatattaatactatggtattagacttgatgggcttagagaaaaaaacagaagaccgatcgacgatcgagtatatcgtgactgcttgattgtattttaaacttattagtgtgaaattcgttaatgacaatgagtttttaaatattatcttttttttaatggtgaatttttttccgcaccgggccaccaaaaagttagggccagccctgaatatattagaagaatagagttttttttacccgacacactcagccagaccgacctatgtcaagagaggaaaaaacaaagattaaaaaacaaggaagaaaaagaaaaaaaaaactcgtacaacggtaactctgctccaaacaataacctatcaccgagtatagttgatcgtcaataaattactcatgtcatttaaaaaactagtcgttttagatgtgattggatatttggatatatgttcccattacacatagtcttttaaagacagatgaacattccagggattacgcttacacaagcagagtctaggaaatggtcttcataaagacagtctttgtgcatgccaggatagacgccttcataaagagctggatatcaaagataacatcatcagtgccacgtgtatgcaggagcaaaactcgtctggtttaaaactgtttactggttgcaatttaaactgtttttttaattagttatgcgaaagaactgtatactttgaaaagtaaaaaaggacatatatattttaagaccctagagtgtaatggatgaaaactgtggtcctaatacacgaaaagaacatgacgaaaacgagctgcaatgcaactacattatgactcgaaattaaaggcgcagcaaaaagtcttttaaattcgttcatgtacccgatcaaatccgagcatatctcagttcagtcacagtccattatattgcagttcatcaatcaacaatgcatatcttaagacaaggacaacggacgcgcgtactatgttgaccactgtccgtccaccaatccacactccgccgtcttaattcggtccatatccgttatacaattacatgtacttacatatcaagctctctaattacttcatccgtccctaaatgtaagtatttttgagattgacacgggtattaaaaaagtaggtgagaatgattgaagaaggtgtgtgattggttgaaaagagaaaataggtgaaaaagaatagttgtgattggttgagaggagaaggtaggtagaaaaataacttcattttaggacaaagtattgtgctagaaatagctacattttaggacggaggtactactaattaccaaaagcaaagctatgtgctcccatccgttaagttaaacgtgtcaccaacaaatatactagctgtactgtactgtactgtactactactagtagtactacactacattgcgaggtgtcaacaagaaaacagagaaattaacgagaggaacaccagagagacagagtagtggacagacagagagatgcaaggaaccatcaagcaagcaagcatggatcgagggtcgatctgagcgcatcccgagattgggggggtttcccaagcaaggccaacacctcgccaaaccagcaatgattagctccactttgtttcaaaaagagaatgattagttccactgcgaggagaagagagggcagcagaaagagagagtgagaggcagagtgtgtcatgtacgcgcatatgtttgtgccgatagaggcggccgacaacgcaattaagccggtccgaggagccattgcccggcggccggccgtccccgtccggccggaaaatgtccagcgtggtggcggacaaaccacaacccaacaacccggccacccagcgacgcgcacgtacgtactcactccctcctataaaaaaaaacgaatctagaaccgaatataatgtatatattcagattcatagtattaaaagtatcatatccgatattatgttggttttttatgagactgagactgagtcattatgtagtacgtgaatgatcatcgctctacctccggtgacgaactgacgatcggcccgcatacataacggggacccacctgtcgggtacgtagagcccctccgtacgtatacgtaattaggtactccggctctccgtccctagtccctaccagccagggtctctgcgtgtccgtacgtaccgtgggcgcgcgcgcgcagtgcaacatgtaggcacacgtactacacgtactcgtcgcccccaacaccaaatacctttgaggcaattgcaaatttacatacctttcactagctcgctatacatcaatacaacttaacgaatccaaaccgcagaataacattccgatgaaacccgtgtctggagacggcacaatatagcaaattttctcacgagccaacgagctgggcaacgacccaccggccggtactctactactcttttccagccggcgacgacctatgcacagtgccaatgcgcctgcacccacacacgcgcgcgcgaatatggcggcgcagccatctcgcaggcacgcacgcgcgcgcgcgcgcgcgctagctcatgtgtcgttgcctcttgtcacgttgtgtgtcgtcgcgctcgctagctaagctactggtgtgatggatgatgttcaaactgtcgaaacatggatggatgatccggccgccggccggcctctcggcgtctacgagaatgcgcgcgaattgaaacgtggtagtacctgagggatcgatcgatcgagtactactggtggccgtgcatggcaactgacaagtcgcgtccaataattaacttacacgcatgtgtggacacgagcgtgcacatgggggagagggtactctcctatagtagtagcatctctgcatctgtcgtgtcgtgtcgtgtctttgtttttttcttgttcggtcggtgtgtgcatctgcctgccgtgtctttgctgagaagaaaagaatcgaccgacgaccgaccgatcgatcgatcgatcgaaccatgcgtaatattattcgattcgagagtagaccggctttggccgatcggcgcgcggtcgatcgacgtacgacgtcgacgcgcgcacgcggccgggcggcgtggcgtgtgtggacggaagcggcagcggcagcggccgaagaaattgccgttgttgattgcaacacgcacccacgccgccgcgcccggcggggcgggggtcaaagccgtgtgcctcgcccgcgcacacccaccacacgcacccactccgtcagttgaaagcgcgagttattgcttaattagagcaagtttaatattatagctcaccgctggcttcaaattatctatagtcaacttaatagtcaattcatacaatagttatataaaaatatactacacaatcaatatctggtatcacctatcatacacacatacgtcttatagtccgtgctgcagctgactacaaatctgtagtccactgcttttatatatcatcttttatcttcttaaaatatgtttatagcaggtttatagtctgctatgctattgtacctgctcttagcttacgatctcgtctgtttgcttatgctcatactcctacttatcagccaaaatttaaatttgatgttgattttaaggttttttttcatcgaagtttatttttcagttgttgcttttggatctctaagaacacgtatataaaaaattttatttacaaattaccattacttttcatttgtaaaaataccgtttggcttattccacgatggggtcgttagttccttccgagatcctgcttgtttggagttgctaattctgagaaattaaagcgtgcagctgataagaatacagaaaaactggatttctgagaagaaagaacatgataattctagggttcttaagatttgaactatatgagattttttttaaaaaaaaattgtacctacatatcgaatcttagattttaagtacaaatctttgtctggcgcgctgaagatttaggggaaactgacaccgtcaaaaacttcataagtatggcattttcagttttgctagctgtggcttacacgacagatgcatgcatatatgagtgggatacacagtgttactttaacttgcaggtgtggcaggagagattctctctggattagctagagctcaatcagcacgagatcgaatgtatctgagtgtgtttcagatcaattactcaataatgacagattaactagattatattatcgaacgtacgacgcgtgtgcgtttgaatgggacaaatgaaagctaagggaagaatcgtccggtctggagctaagctctcgagctaagtagtgggtgtcgccatcgccaagtgtaagcgtgacacgtcggaatggaccgatgaacaggagaggaggagggagggacagagagaggtggaggccgggacggacgaccgtgtgtcacgtcgtccctttgttgcttgtccggtccacggtgaaaaacaaacgagaaagcaatataaattatacagtactgtactgtattattcctgtgggcgtacagggaaacgacaacgacgatcgtatccccaatccctagcttggagaggcaccggactattcctgcacagtccttttttttttttgtatttgtaccagtgtaccacttaaaaaaaaccaataagacataggagtactagtttattgtggtcagtctgtcaatttcatcttattatcttattacaaattgataggtgatctcccttatatgaaactagttcaaaaatataattgtaatttgtgtatatcagattgtaaaagtaaaactatatttgatatacatctcataactttatttataaaaatatgattgtattttatatagaaaaactacgaataaccctctaactatcgaggatgatcgaattagaactcaaataccatatatttttaaccctggactttctaaaccgtacgaattaccctccaggactgttttgggcggttttgaccaagagcttacacacgtggtgtcaacgtggcaatccagtcagaaaaataatagtaatagatttgtagggtccacctgtcatttcatctctgctctctccctctctcccctccctctctgctctctccatggatgggaatggtgtgaaggaggcgggcttggcgtgagggaggcgggctcggcatgagggcggagaccggatttgcttcaaggtggagcgcttcagctagtggtggcggcaccatcctcaggtgtaagctcggcaaccatgccaacgccgcaaccacatccttaatttctccaccgctagcaccgatttttccgatgggaacaaggtgacgcagagaggggcaacacctacggtgtcgcccaagccgcgcgccatcgcgacctatcacactgccaagtgtcgcccgccgctgacccgccggttcatgcgtcgcctgctgcctctatcactggccacggctatgcccacacgggctcgagcccctcctgccaccggccgctaagcagcgtcgtcggcctagtcctccctgctcagtttggggagagagagagagagagatggaggtgagggaagggagaagagagagaggatggggattaaagagatagagaaggggagagtatgacatgcggggcccatggattttaaaaataaaattgctaactggattgccacataggaccaaaactatactccggtttgaaaaagggggttatttatccggtttgcatagctaatggtgtaaaatgtctggtgtttgagttcagtgggttaattcaattgacctcgatagtttaggggtaattcttttttttccttttatatataactatatatactgttaggcaccacaagcactagaactatatttgatatacatctcataaaccttgtttatatagaaacgattgtattttatatgcacctgtaccatcagggcaccgcttgcactcatactaataatgttcattgggttaaatgcattgaactagccatattctgatactaattgaaggacttaaaataccttacacatttttaatagctagcttacgagttgaggggataacttttaaacaagatatattgtactttcaccaccaatgtgagactgaactctaacatgttaaaaaacgtgtccgtagaaatggtaaatttacttagtgaattgcttgtttcaggtggtcaaatttatgagaaatttcagtcacctgcagcatctagaataaggggaggcaagaaaagaggtgagataaagggagatggtagccatggcttaacaacgatgacaacatcaaacttctttacgatcttttcatcttccgcatcatgagtgacacctaactatgatagaggacccacggattagacttaaggttttgggggtggggattttggctggtggaagagagtggttcaactcccataggcttaaagggatgggcagggagacggtggattcatggtggatggcaaacaagagcatgtagcgaggtgacagtagtgtacgtagttgggtctatggggctagaggggggagatgggcagggtcgacggcagagagcgtcaaatcaggagaggttattaggaggtggggaagagccgctggagagcttccggccctggcaagcttggtgacagcgctatggggtgaggtgtgtgaggcgagttcacactaacatggcacgttgtggggagaaagaattgcatgatataaaattattctttatccaaaaatattggtatgatttaggcgtgactacaatttgtgagtgtttttatgtgcctaaaaaaccagacaatcccatgtgtttaatagtattgtacacgtaatgtagtatgcatgtacgtcatctacagtaggccacatagccacaaatctaaccagtctggccacacacagtcggccagcctctagcttacttgcttattggtacgtaccagattattgcatgcgtagccagtagctcgtacacagatcacatgcacgcatgatcgaaacattattcgatcgtataataatcttgccgaccggcgccggtcgatgatctactcggcagtacgtgcgattttttagatgagatctgaaacttgcaaaaacgaaatatcacatatagatcaatatttctacttaaaaaaatcaataaccatccatatgccataactactacctcctacaaaaattgttcccttgagaatggttcaaaaattgcatgcaaaagacaatttttgcaagtgtgtttgttaaaagttcacttgtgaaagtaacatgttaatagtgaaagtaacatgttaataggcccgcctgctaccagtctaccagatcgagctcacccttaaaatatcaagtcacccctctctctcctcatcctcaccctccacttcctccatctcctccactgcttcctctccacctcttctttcctcctcatctctccatcggcggtgggcgagagcgggagtggcggggaactagcggacggtggggagggcagcggcgctggatctggtggtggggaggtcagtggagggaagggaccaccgcggtggatccagtggtgtggaggacgcgacggttgattcggcggtgagctcggcaacggtggacccgtcgggctgtccctcttccacgcggatcccaccgcctcggcttcctacgcgcatggatacaacgcttgactctgacagcaaggagtgctttggcgacggcgaggacgaagcccgggcacaagaatggtggtgacgaccactggacgcgggacctgctagggtttcggacttttttggaatttttttactaacttttctttttatcttcggacggcttaaacacccacatcgcatgcggttgctctacccgcataaaaaatatcaatttccacatacacctaggtgcagacgggacatccacccgcctaacaaagtcaattttgatcggagataaaaatcgtttctgtagtggtaggttcgagctagcaaggcgtggatcactttttcatctctacgccgaaccagtcattacattccattgattaccgagagctaatataagctaacacggtttattagcaataaaaaaataatttatagataaaatttttatacatatattctgagcgggtgaaaatccacattaaaaataatgtaattaagttttaaataaaatttaaaaagctgcagggccggattctttccaaacgtacgatcgaaagtccctcgatcgatcgccgttcaaggcactgttcactcctacctgtcgccagtgtatgcatgcatacgtgtactgcaccatgtacgtattactacgtgtatgaatgcgtacaaggcatgtcatgcatatatgcatccatgtctctgtaacgtacttcctccgtattttaatgtatgacgctgttgactttttgaacaacgtttgactattcgttttatttaaaatttttgtgcaaatataaaaatattcatgccatacttaaagaatatttgatgataaatcaagtgacaataaaatagatgataattacataattttttttgaataagatgaatggttaaacattgattaaaatgtctacggcgtcataaattaaagtatggagggagtatgtagagagtacatattcgtcgtagtcgtcgacagcaacagtctcagcatatagtgacagggcaactaggaccaagccaagcgggcatgggccagcaatgatttggcaacatcgatgtagctagggttctacagtggtatatacatacgcctgcatgcatgcacgctgcatgattgtatactgttataattttacgtactaaaatttgtcaccattcatgcgcacgcatccgtgtgcgtgtaaataatcaataaccgagtaaattcaattctgctcaagtaatatttttcttcttttttggcctttttccccatgactcggaattaattgaagcatatatagtagtacactgtagcacaagaacagtgaattgaactacagagacctctggggaaaatatttaatttaacccggcctaaagtacatttgtccaagctagcgacaatgaaaaatgaccaaatcaattaaaaaaattgtgatttaagaggtataccgagatattattaaattttacgttacaaaaatatgccttctcaggaaccatagtatcactcaatcaattataactacggatttgctataaatgtgacaccatatttttcatgaaaaaatgtattttcattgtaaatctctaaattacatacgtaattttactgtatttacaatgtaagtctaagtttgaaaattacatatttaagttcctaaattatatatgtaattacactaatcacatctgtaattatattacatttatgctataattatatttgtcaccatatttttaaatagacccttataactaatcccattcttaacgcgaaagcaaccgtgttaactgcccgaagatttctgtctgtgtttcgcagcatcaatcatctccgagcgaagaaaaagggggaggttcggtcgaacaagaacaacaatatcctagaccagtgcacccccaccgcgctgcttgatcgatcgagctcatattgatcactgaataattattgattaggttgaggtgtcagacttgcaggggtcagagctgctatacctagctagctaatcagagcaaattagtcatgcatgctctcccaacacagtccggcctctgacccatatgcacggccgtccacgtactatagcccgccatgatatgatgccctggctggctggccatgcatgcatgtggattagttgccccaaagccatcatcatggtcaatgtcatcataataatcagcctcattagccatgatggctcccctgatttaaccagattaattccaggacccctcttgctctctctctctctctctctggtccatgggcaattgggcatccatgtagtagctaggagcagctagcagcagcatccagctgataatcagtggtggtactgtcactgtggtgtggtgtactgaattttcaacatatttgtactactgttacagcatgcaccggcctttggcttagcttcttcctcctccagacctccatccatgcatccatgcactgggcacccactactactgagtgaggagtgaggaccaactcctccccaccccaccacccccaaagtgctgctgccagaatgtggaccagcactagtactttgaggaccacattttgcatctatctcctctccttcttctccctctcctccttcccccatctgccatgcttgtctccttggaatctctctctctctctctctctctctctctctctcattgtgcttgttgttgcttgcaatttgcatggtccacctctagctaacaaagctagatagggcagacaatgcatgcatggatggatggaacaaggctatggttagagagagagaagctagctagagtagtatatatgttgtttctgacgaaaatatatggatgcaaagtacgtagaggatggcgatgcgtgatatggctttttcgttaaggtgtgtgtctcgtagctgctgcttcttgatctgctctgatgaaatttttttttctgattgaattgctgtcgcagaaatacaaaacacggtggctccatctaagctagatcgatcgatcggtccactcttttgtacaagagacatcagctcgatcgatcgatcgatcgattggcatgtgaggatgctgcttgcatgcatgcatgggctagcctacgttgtactaggatggagatgtgtgcggtttttgtcgacgcatatatataaaatgtggatgattattgagcatgcaatgcatgcattgtttgttctcatccgcacctcctcctgcgtgcaggcagcatgcaataattctgatgcatcctctagtggaattagtactctgtaaaacagtaataatgcagagtacagagatgaatataatgttgattcaaccatgcaaatcattgtgatggctgatcacttgttgtttactgaaggtaaaaggcgcctgctaaataaaggggcacgtctcacatatattgacttgataaaacagtagcgtacgtagtataccatgatgttatacatacagatctgtatgtataacatctaagctagatattcagatgttaaaaataattgcgaatttggctatacttttatgatgaaacaaaacatgttaaaagttgaaactgagcagcatgtgtacgcgactactctcatatgttttttcttcgataatttcttatttaaatatctcaaagctctggttcgtttcaattgcttctagcggcggggacatctcctgaacaggttgggcgaccgcccatgctccgtcactgccatcttcactacggattacgatcgacgtataaaaaaattggtagatcatggagaaacaccattaattacccacccgggctcgacggtgtcgctggctctgccactgatcacttcataaaagacatgcatggtcgtagaggtggctaaagcataatttgtacgtgttccatgtcactctaaactcaaaggacgatgtgtgttctttaacctcctctctgttgcaaaccacacaatgcagcctcatctgtgtggagcaacaaacgacatggcatgctccaactgtctttgtcattccaccatccatcgtgtttcacaattggcgatgtgaccactaaaccgagacaaaaattatacacaaattgtgaaactatagcccaaaaggagatgaaactgtccacatcaatacacttggcagaggcgaatacgtctctaattctagagtttagaccaagccaatatacacccttataagagtcaaatgtagttttttttaggcatgtaaaagggacagcacttaatagcgtatttcttttagttaacaatgaaagagtataatgcatccgacctctgcattatatcaagagtgcatatatacaaccgattagtttgaccaaacgcatgatcgaagagggtgaaaagagggagagattgtgaagggagaaggtgagatagagcagctggctgtctctatgggacccatggaatgtcagtgcagcccggcctaacacatcggagtaaacaatgcatgggacttaatttctctctctatctcggtctccatggcggccacaacgctagctgcagagcggatggagagtaaaagaatcgaatgtaggtgaagaacaggtggatcttcctcgcaaccaccatacacacacaaatcctgcaaaaacattccatcatcaaactaagcacatttgtttaatccctccctctatcatatctcacccctaacgttccaatccaaatcgatgcaaatgattaattatctctcttgccctgtcatggcagggattagatcagtgctggggcagtgtgcatgcgctgtgtgaagcaataaacaaaccaacgggtactaatcgacagccaaaatactgcaaaagattaggtaggaagagatcgaagaacatgtacgcacaatcacatgaggggcacctacgcgtgctaatagtttatgtgggaattgtattacgcggattgcattgtttaggctgttcttgggtgcaaattgcatgcacggatatgtatagttttgttatatattatttgtggaattaaaccggcacggaatcccaggggaatgtcggtcacttgttgcttgttttcttcttgtttgatcggaggggaatgtctgtctgttccttttgtttttctagtggaatgtttattggaaatcacaatcagtttggggccatccacctgagactgctggttttgaaatgttgtgtaaaataaatgcttagaatttattgatgttcttcagcagaaaatgctgggcgcactagcttgtactccctccatccacaagagttagacatattttatattttattttattttcaaataagttaatcatatttgtagtctttatgcatccaagacttaaatggagaggtaaattaaatatttgatcagaccccagaagtcatattattacttattggttgtatgcgtgcatacactccttgatcttagtgacaaaagtaataggtgtaacttttatagaaagagagagtatgtgtaaaattccaagcatggatgctagctgcagcacttattctcaatctatatgtgtttaattgaatctatctaacctaatataaatgtaataaataaccatgaaatctaattcctttttttttaaaaggaaaacatgtcagtaatgctgacgattctatccgaataaaagagcaagttgaaatcgatctgatccatttatctagtctgtatgtgttgtttaattaggtggtcttcagtttcatagaaatatacaggacgggcatgggacatgcatggccggccatgaaagttcttcgtaacacactgtttttattaattagtaattaaattgtgacataaatatatgaatattgtcatttcagtcggtggtcagtcaaggtttactgcagacatattccaggacagtgttaggtgtcgtgttaacaataatttagtttgttttaaactttagaagaacttagaatattgtggaaagagaatataatcgcacaacaatacataatgctatgtttattattaaaagtacactaattagaggacagcaggcaaatctacttgacaggggcttaatttatttataggcgagtgatgcgtcatcctcatcttgcaagcaaaaatggatggcccaaacaaaggattggctcctgccaagaatctcacacgcatccctaagctagctagctatgcatatgccgcatatataattggatggttgcatccatcacatggggtatgccaatttgccaactccatgacctgatgatgaaacaaagatgccatagagagtagaaaataatatagaccagaattgaattgaaatgaaatattaatgggccagctacatgatcatctatcagtgggcaccagatctgtaaacaggatgggcaaattcagttaagaaatttcagggaagcatatgcatgtgtcttgatcttgttttttttttgaaaagagtgatcttgttgtcgtagttgaagtggttactgttgcaagtagaatatatatgatcatctattcttctagtaactccagctattgggagagacaagagagatagagatggatggatagagagaggtagtaaacctaattaaccagacttttcttaaaggcctctgggatttttgattttgactgctgtctgtggctttgcttcttggagaaggatgccttgtctagcaatcatgggtagggttacatggccggccggcttcagcatgcattgggctgtgtgggtgtttggtttaagcattctgttcttgtctctttgcactttgtatcattgctgtgttattcctgaactttattgatgatgaaggaattgaagcagctagagggtttagcttgcatgtgtgtctaaatgaattgagatgttttatacacaatgtattcatatgtgatagtagtaggtactactagtactatatacttcctccgtttcacattattagactttctagcattagccacatttatatagttgttaataaatctagatattaatgctagaaagccttataatatgaaacggagggagtaccatacgtagagttgaaatggagtagttaagtagcccacacatgcatacctacacacattcatgtgtgtgaaagttgcattaattgggtgttacgttatttgtcgacccttcatcgcctacatagccacatttgatgcactaattaagaaggctggggatacatcgatcggtggtagttaattaattaggtgagctttcaaattaagaaagcttggccttgtcttttagttgtcgtctcacaagtcatactcatggagatatatttaagactcgtgaataatgacttgcattggtcgtgttagctggatatatacaattttttttgggtaagcatgcgaatgtatcaggtcaaaattctcaactatactagtattattattacttagtgcttgttgataagctagtatacgtacttccaatatttgattgctgggaccatatgtatacctagctagcaagcatgcatccatgttcctctctgtatgggctggagttatcacatataagaatagtagtagtatagtactacgagctagtgtactaagaatccataccatgatgtacatccaagtgagaccaggaaaacctctagccaaatttgtactatgttgtttagctagctagtgtcatcggttctgacctttttatataaggaaagatgaattatatcctcggtctctacgtttaggatgcatacatatattttttttatgtactcctctagtctaaataagtgcagtcaatatgtttgaattttgattgttaatatctcttttagtatttcaattcatgcaactttagaaaatggattataacttttctactatatatttttgtagtttttatacttataagagattgttaatgtctcttataacttttctctgttatacatagtaattaacatcaaatagcaagtgtcacagtgaccatgtcagtgtttatagtgataaaaaaccttattctcatgttcatgtttcgagattaaattaactagagttagagatggatggatttggctggctgcccggccggccttaaaaggaggaaacgccagcatcgattaacagagtgatagagtaattagtagtagctacatactagagtagtagtagtgctccaatacttggtcaccagtagcacgtaaactaatattattcctggtccagggatagctaagctaagctgattaaggtagcttgtggagagaggagagggatcgatcatggtgatggccatggagagtatgatgggaagaacaaactaaaggagagaaggtagctaggggggcaggggcatctgattccctgattccccgatcgatcgatccgttggctcggaactcgagaaaggaatgtcggcacgcgcgcgagcgatgcaccccactgcaccctgcgcacggcccatcatcacattcagattccaactcgaaatttccatgcagtcggtcgatcgatcgattgaaattgaacccggccttgctagctagctgctgcttcttacatttgccacccttgcatgcgtactactgtactctcgccatcctaaaaaaaaccaattctatagatataacatcttctagtataatgaatacggacaagagcatgtctaaattcgttgtactagaaaatatctcattcaatactatgttggtttttttatgggacggagggagtactaagtaattggaactagctagccgtagagaataatcaatcatctccaaagttggcataatactccctccgtttcaaaatgtttgacgccgttgactttttatcacatgtttgaccgttcgtcttattcaaaaaatttaagtaattattaattattttcctatcatttgatttattgttaaatatatttttatgtaggcatataattttacatatctcacagaagtttttgaataagacgaacggttaaacatgtgctaaaaagttaatggtgtcaaacatttcgaaacggagggaatataaggcatggtcaaagttggcacggtctccaaaactaatgtttaacttataatttcttatatactataaggtttgtagcaacaaaattataaccatatgaaagtaatttaaatctcaatctaataatatattttttaacaaataaaatttatttaatattatactaagtgttagtcaagtgttttaaaggttgaatcttaaaatatgtgcgcgtcttatattatgagatggagggagtagtatgtactctttatattctcctgatttcctttttgatgtggctaacctatgaatctacaaccttactaatgacttcgattatttttcacgtatttaattagaacgagtctgttgctgctacaagcatatagtgcatgctagctagcagattgattaattcccgagttatcagttcaaaaaaaaatccctatggtccccaaaatataacaaattttattcctcagaatttatcccaaaatataataacttcaccaacattctcttcccaaccaatcacaatcctccaccattcatttttcccacctacctctactactcatccaatgacaacccttcaccactcacttctacctgctttcttaataaccgtgttcaacactaaaacttcgacggagagagtacgtaacactgcaaagaataacccaccgagacgtacacgtggatatattggatcgacactagtaaagaaaccacttttggccggtcgactaaaa

SEQ ID NO: 19139 - DNA, 2884 bp, Oryza sativa
cttatcctcttttctcatccactcttttctcatccacaccaactcctctctccctccatctctaatccttatcctttcccttcctccttatctcttttccttcttatcccttcccaactcgatcccgtgtgagcagcaggagggggtgggcggcccggccggcggagggacgcgaggcgggggccggcgcggcggcggccggggaggaggggaggcagcagccggctcagccagccgacggctttgcttcgttttttttctttttttttcaaagaatttgtgatccatgtatagattgagatgaagaatctgtggttcattgtatggattgagatgtataatttcttttttggaatctcattgtatggatctgagatgtacatgatttgtgtatttgggatgtttctttgatttggggtttgatttggaatgtataatctgtagtgtatatgattgattgatttgtgtatttgggtttgattaaggaatatgcatcccacctaatttgggagaaaataaattagagattaaatagtaagtaaatgaaaaaaaaaactattgcccgctcccatctttattcccgagtatttgaaccgggactaaaatatggatctttagtcccggattcatagtctcgattttcaaatcgggactataggggttacgaaccgtataaaaacgatttctccacaagtgcgagtttcgaaactgaatcgttggccgacggcgcgaaacgctaattcgatcggccaactgatcagcgagcgcgcccgtagctagagctagctagctgcatgtgcacagcactgtgcagcctgcactctgcatgcaaacctaggcaactgtgcaggtcggtctcggcatcgagatctatatcgctactggggcatgccgcatgccggcccgcgcgcgcgcgttaaccaccaccagcctgacatggcgcgcgcgcgcgaccacgtacgtactgcgcactgcacgtacgtacgcactcatctcatctccaacagtcgaaccgcgcgcgggagggatcgatcaaaaattgcctgcgctgccgtgcggctgatgcccgtgcgcgggcgtgtagtcgacgatcccaccggcacgactcgcccggtcggtcacatggtttcctaaaccgccggggctagccggcaaggggtactgcgcctcgacggtaagcacagttatcagacggtaagcacagttaacacgctataactgtggtaaccgtgaaaaatcgtacgaaaccgtgtaaaatttgtcaaaaatttaaattatttttaaatttatttaaatttaagaaagttattgtggtttttctattaccgtaccctgcggtaaggccggtaaccgtgtggttaccgatggtaatgcaaaccatggtcagcccacgtacgcgcagatgactttcggccattttggctaactagcagacagatgatcaaccacctagttgatccgcgctaaaatatgctactctattcatctagaatataagaatttttagattggacacaaccattgagaaataggtagaattagatgtgatgaaggttgtgattggatgagaagtgaaggttggtagggaaattgaatgttggaaggttgtgatttgtttgaaaaaaaatgtcggtggagaagtagatataattttgggatagattttaaaggctaaaagttgctatattttaggacggtgagagtaataaacaatttcggttaatttgatcctgagaattaaatagtgccattgatcattcataattctttatcaatttcctttcctttattaaccaagcatcgcaaggacacacgccgtttacggctactaccttcatcctaaagtaaatatacctactatgagatctgagatattataggatgtcacattctattatttcttattagatttgttggttttaaggaggacaatcttcgaagatgagtgatgtgatattttgctactttggcatggagattaattggaggtggtcaatcgatcgtgtgctcttatacttgaggtttgatattagcggcgatcgattggtcgatggtccaaatcatctagccaaaaatacgtaaggtgaaattacataccggcgtacgtagtcgtacgtgtttttttttttttgcgctcttatcacgacaagtaactcatttcccccctacgatctatagctatttggttcctccctgttaattattaccacgcgcgcgcgtgttacagacccgtacacccgtactgtccagagcgtgcatgccctacaaccctactactcgctgcacaatacgcccacggtgaccacgcctagtacgtactcctcctagtagccagcaagcgtggcgacaacagcagcgaacccagctaactccaacgacccaaccccgcacaaaccccagctccagctgcagggaccatccaatccaatcacaaccacccagctgctgttaaccacccacgcacccaaccaaaccaacggtgccgcgcgctctgccgctcgctcgagtgcgcgcgagaccgccgccgatcgaccgatcgatcggtccgcaggcgcgtggccggtgcgtgcgtggtcgcgcccccctgcacagccgcagcagccagcagcagcagcaaaccaccaaaccctatcgcgcgtacgggtttttgatcagagatcaccatgcgtttcgccgcgatcgatcgatcgcgcgcgccgacccgtcatcccgtcaacggcatgtggagagctacaggccccgtgctggccatgtgatcgggctctgcctctgcagcgcgcgcgcgcatgcagatcgagcaggggcagcgtgcacaggcacagctgatcacggggaaacaaccggatcaccttcggtgcacgctacggtgcgggcgcgcgcgggc

SEQ ID NO: 19140 - DNA, 8666 bp, Oryza sativa
gtatcagcgtgactaactgaccatgttaacgtttctgtgacgtgtcagagctaggacagaggtaggtcggctacaggagctgagacatggtatggaactcgggccgatcgataaatggggctaaaattagcagtaacagttttccaggggagcccagaaaagcaagaggcaccaaccagatctagcgaccacgtacgtacaacaccagaaatcgatctttaatttcaccccttccgacgcttctagctagctacaggagtacctctcatcgtcagtcacagacgcagaaaatttcgactgccacaagcgcgcgaccatggtccatgggtgcaatgcaattatatgcaaaaacggtgttggattaacggggcgtcaaacacacagcaaacatccttatcattcttcggctatagtagtagccacgattttttgacggaaagtagtagccacgatgacggccactccttgaaccgcaccacacgcgcccgtgcacgaccgccgcatatataccagtgatccttcaaccggcctggccggccggcaagtcaaaccgagccatctgtactacggcttggtttagtatcaaatttttttctttaaacttttaattttttcaatatatcgaaacttttctacacacataaacttctaactttttcgtcacagcgtttcaatttcaatcaaattttcaattttagcgtgaaaacacaccctacacctggtagctggtacttacaagtaattccgtagtacaatcagtgtcccggaataaattaacttaggacagagatctgttactaaatacaatggtgtgtacttgttactagtagatgcatggttgcaatacgcgaaccatctacgttcttctatagccactttttgttagcagagtacgttttgttttggaagaaaccgtccagcacaacaatattcacccaacctgagcgttataactggatgacatgaatagatagattataaccaaacggaaattgctcatatcgacaagttaaccattataaagctagcaaatagcttaattaggaaatagtatatttttaagcaataccgaggtaaaaagttatgtgtcgcatgtttttcttgtctgaaaacagtcggatctctggccgttgatggtttgatgtacggtggataaaggcttgagggatgcagctttcctttttatcgttattaatcctttgcctttttttattagcatcggatttttcctgtatggatgatgacacgttggttacatcatagttacatactatttacactataattacatatgtaattttaaaacttacatatgtaattttcggatttacatatgtaattttatgacttacgttacatatacactgaaattacatatgtaatttagatacttacaatgtaaatacatgttgactatttattgatgaaaaatatgacaccataaatataaatatagctactcccagaagattttagggaaatcgtaaatataaaaacgtgacacgaataatttgtacttccactagtgtggtttagaacacgtcgtaagaatagctagttgcggcgcatgacgctccccaccttacgtcctccgacgacgggatcacgtccacgataccccgaccgacgaaggcccggcctccgcgaccacacgaaacagaactgccagcagcgaccgtcagcctgggccggggacggctggaattgggcccagcccctgtggcctactacacaccatcaccgcctcatcttatctgatcgcgccctttgacttcacgagccgtacgctcgttgcttcgtccgtttccgtttggtctcgctcgtcgcccactgcccacaaatctcactcgatctcgaccaccatggcaaaaaaagaaaaaaagaaaagaaagaaagaaaaaactcctctagacgtgacagacgcatggtacctagtagccgctagttggagaagaagatactgtacgaaatttccatctggcccaatagtagatgtttcagctttcaaagtggagatgtggcacgttaattactgctgcacacgcacgcacagaggaagtgctacgaagttacggaaggtatcttatactccaccactttacacacaggcaacacgagggaatcgggaaaaatgatgaggatgaaacgcgagatgcgtatatgtctcggtcaggataggcacagggaggtcttctgcttggccagttgctggttcagcttgccgacgagctgccggttgctgcacaggtactcctggaaggacatccggaggctccggagcacggccgcgtcgctgccgttggaggtcgcgttgagcagcgtggagaagaggtttttccacagctccacgttccagtacctgtcaaggggcaaaatggcagcaaacagctcctgttacatatgccatctaatctaatctctgatttatttacgctactgcgaatcatggtaattactactacctttatcttaaaatataactaactagcataggatgagatattttctaaacctgttcagattcatagtactgaaaaatatctcatagtagctatattttgggatagaggaaattatcaaagaggtgtataggcaatggcatcaaagcaccttttgaacggcgatgtgggctggtacatgtagcttccatcgggcctgggcgtcttctggatgctcatctgcgtcccatgtagcatcatgtgcgcgatgacgcagaggccgtaagtgtcagcctgcaggaagaaaccaatcaaccaaccaacaaacaaactggcagcgtcaggcaggggttgctttcagagatgtctaggtgagaggaggttttgagtaagtagcttgggagggtacagatacctgaaacgtccaggctctctgttcctgcatctcgacgcagctgaacccggaggttcggcagtcgccgtagaactccgcaccggatgggaagaggttcaggtcgatgccacggccccagtcaacaaggcagagcccctggaatgggaatcctataagcatcaggagatatccagaacatcttaaccaagtttctcggcgtgttgggaacttgggattgagaagctgacctgattccgctcggatcttgtctcgcctttgaaggtttcgtctgtgatttctccactgcacagaccaccacacgcaaaacaaagatgcgggtgaacgaaaattacatgtcgagacaagggctaaagattgaagaggtgaagacttggatagcgagaacaaaaaggaacagacactagcattaggtttactctttctttttttttcaggcgtaacatgtactagatgggttataattgagttttggccgaaacaagccaatagcagcaaatggccaacaaaaatgacaaaaaaaatcgtcatctcagcggaaacatggaggatggagccatcaagcaagattccagtaaccgctcatataaagtaattgaaacagtagtaaatcagcaaggatctttgcccccaccaaacccaacatctggggccaacaaattgaccacttaccaacatgcttgttgttatgaccatccatgtcaaatattttcattgaaaactatgttattagatcagtttaaatataacatctagtttataaaagttgtagatggttgtgaagcttggagtaaaatatttacagcacagacatcatcacccacaaacatggtaacaagatctgtccaaaacaaatagcaagagaatatgggcactgggcaaatggacggcacacaaatattgcaactagaataaatctgtcgattttatgaaaagtaagatgtcaatggtcactggatagttttgtgtgtgtctgtgtgagagagagagagagagtgtgtgtgtgtgtgtgtgtgtgtgttttgcccatatttcagttagagatcacaagaggaagagggaggaagctccatcaagtgttctaacttgaaagctaagctggttacctctacttaccttgggtagcaaacaagcatattgtcaggcttgaaatcaccatgaattatgccaacgctgtgcagtgtttccaacatgcgcagcatctctatagtgtaatatatgcatagaacttcatccatatggcgttcaagtactagatgagaatttataacatcctgcaaaagatttgcatcttatcaaacacagattcactaatccgggcacaaaatgctagttttgcatgatcatgatctcaaaaaaaaaaattaatacataaagtattttaccagaagagttccgtatggcaggtaatcacaaacaagcacactgacatcagcgtatacatgcacttcatgagtgtagccaaagcttggtctctggaagtaaaattattttgcagtgtgaatcataattttacaattacaaatgttatggtcttcttaaagataatttctgtacctcaatatcagatacgcgcgtatcaagctggcgatacatgtaaaattcccaaggaaatggtggtttctgaatctgcaaacgggcaagttcagtagaggaatctgatgaaaaaagcaggcttcagtaagacaaatggaagtatgactcacctttaaagcaaccaggtcttctgtattaccatcgacactggctttgtaaacttttgcaaaagcaccagtaccaggagaacctttgatctggtactttctaccaccttggtgcaacaaaagggatttgtaactaaacttttgttatgtcatcaatataaatggcctttttctaaataaaaaagggtatatttcttcctttttttcaaggagcattattatgtattcattgtgacttacagagcatggatcataaaggagccaaactacaaaaatgattatagttttggtaaaagactgacaagcaagaaattatagtttatacctaattcaatgactttgtttcttaaaacattctgaggcgaagttaatggcacctttccatgatagaccttattgctcttatgatagccctgtcaaggattcgggcaaccgtccaagatgagagctaagataaacactagcgaatcatatagagtaaatgcaacttacagcgaacttcttcagatcaacattaatgttctccaataaattattcatagtagactcagaccatggatccagcaaaataggttctttcttttgtattttcgatggtttcggctagcagacagtaacaaaaaaaaatggagttagtatggtgaatcatccacaaagaagaatagcattaggcgactataatatatgctggctacaataatggccagtaatgacaagtaaaagaaacaaaaaaaggtttttgcataagttacttcacaagcttaacagggttatatagatattgttcttcgaaaacatatagaaattgcatgtctcatgtttctttatctagtaatgattagtccactcaagcaggggcagggatgtagctttcaatggcacatcatgtggcttcagcccgatatttcattttattctttgcttttgcaatttgctcgattttctctatttatttatgaattgaaccgtataagaagattgtttggtatggcactgttatgctgatagtgccctatatttatgttctgacttcactatggtaaagctgtgcaaatgcactcccgattctatcaatgtaccacatagcataaataatatatttccgagacaaactcataatagaacacatacaccacaagaatcagtggaaagtacaacctgaaattcattcccaactatgattaaactaaataaaatatatccctaaacatataataaaaaaagccactctaaataactagaatcatgctatttttgtataaatagagttgcaggaatgacagaacagaaactctttccatgaaaatgtaaaataaaccgtcatgtatttagttgaaatagatgttatagatgttcgagctagtaaagatcggcaagtacaaagtagatatcattgtgattagccccaaataaatattaagttcacaacatgcaaacatgcaaataaatgaataaattatgtagaatgtatcacagttcacatgcacagaaatgtgaagacaattatcctattgcttgccaaccttttttggaaaaacaaatgttccaccacagagaaatatcatgtaagaaacaatatcaaagcagttcttagttcttactgctgcaagtttgtcagccttgtgaccaactgaccatagctaaaatactaacaaatctacaacacagccacaatgtcctgattactaaaaatgcaattgaatatgaaatatgtgaatcatttgacaaatattcaaggactcaactaatgtccattccaccacacagttatcatacctgggcatcggcatctgcttcttctacaatcttctccaagtgttttaaaaatatcgtatgcatcttcttcaaatgatcaagtggctcggcttttctggtccacggaaatgatttgcgatcacatcaacatgacaaatttgacatcagattgttgctgcccaaaaagttcacttcaacaaaaacataattcagtgtcatactaacctggaaataccaacttcatacaccttaccagcctccagcactttccccttactgaagagaaacagtgcatatgcatcatagagcagtgcatgctctaaaaacattcttttctcctccaactgcttatatgccttatcaaaatcacctattgcatccgcctaacatagaacaaagtgggggggaaatgagcaaaaggatagaaaatggataaggtaagaattgaaacttcaaagccaaacaattacatagaggatccagatcttgaggagtcgggggtctgtggagtactggtaatcgtcaccatacttatcaatgcattccattacacaaatcttgagccgatcaagcgctgctgcttcaaattttgggcctgtcctgagctcatccatagccttgttgatagacctgaataccaagtcagaaactaacataaacgaatgcatacaccaggactggggccctgaccaggacaaacaaaccgcagtgatacatagataaattatgcatgaataccagcatgtgcatgaaagattagatttaccttataaaatagatataatagtaccaggaacataaaaataagttatatatgcaaagtttttaccaaaaggacctatcagaaagcagcacattagtacagaaggagcacagaaagtgggcacattacattacttgacagttcaagaactgataaaggaataagagaaccgtctccacatgaacaagctaatccttcacaagaaaaatcaacctagctgcacaaaacaaatcagctccaaaactaaatccttcccaagtcccaacactggacattacgagtgaccagtcacaatgtctcggcaaaatgcacttctgtcgttgccagacactcaaacagtggtggtcataccctttgcttttcttttttttttttcggaacacacacgcccccatttctcacatttccgttcgtccaagttcaactgcacactgccactgagcaattgaacaggaatcgcagaggcgaagtgtcaaaatctaaatcacacgcccaattaactacataactcagaggaagggacagaatcccagtacgatgcgtacgccacacaacttgaggcgaaaccaagcattattccacgcagcgctacggcggaatcccacgcccccaaataggacctaaatcgaagggaacaggtgctgatatggatactgatctagccattacctgaggtaggggaggatgggatcgagggggggcgggggcacctccctcagaaccctaggcgacggcctccggaccgggctgaagccggcggcggctgctgctgctgcctcgggcaccaccaacggcgtgcgttcgagcagaaccatctcccgtggccgccgaaagaagccctcagaatcctgcggcgatcgccggcggcgagctctccgctcccgtgttggggggtggtgaatgcgtgcgctgtctgtgtggagagagaaagacgggaaggagatggagcggaagaggggaataatttgaatttcgaatggtttgggatgcggatcgcttgggcttgtgtagccatttttgaggtttaagcccacttattactacagctgtttagtgtttacaactggttgaagatataaaatggaccaatataatttttgggattttttttcgtgcacatagcgagcaaaaaccgagcagcacagctgaacaagcgcacagcacaatcagatcggtgagagagagaagagttgtggaggatggataaacatgcaattttatggccccaaatgtaaggccgagtttatttctaaaatttttcttcaaactttcaactttttcatcacatcaaaattttcatacatacacaaattttcaacttttctatcacatcgttccagtttcaaccaaacttctaattttggcacgaactaaacacacattgtgttcgtttctcccctctctcaacttttaattattctttttttcacacacaggtttttaactgctaaacgatatattatttgtgaaaataattatagaaaaattacttggaaaattatattgatttatttttaaaaattttaatatacttaattagtcatgtgttgagtgaccgtcagaacaaactcagggtaacgttgtgttcgggatgg

SEQ ID NO: 19141 - DNA, 6303 bp, Oryza sativa
aaatgtaagccggagtttatttctaaaatttttcttcaaactttcaactttttcatcacatcaaaattttcatacatacacaaattttcaacttttctatcacatcgttccagtttcaaccaaacttctaattttggcacgaactaaacacacattgtgttcgtttctcccctctctcaacttttaattattctttttttcacacacaggtttttaactgctaaacgatatattatttgtgaaaataattatagaaaaattacttggaaaattatattgatttatttttaaaaattttaatatacttaattagtcatgtgttgagtgaccgtcagaacaaactcagcctaacgttgtgttcggtatggtaggttagtaactaatccttcggtatgtaacatggaggattacattagcatatgattaattaagtattagcttaaaaaacttataaaatagattaatatgatttttaaaacaacttttctatagaaaaattttgtaaaaaaaatcatcggtttgggaagcatatgtgcgaaaaacgagtggtagaagttgggaaagggaaggaaagaacacaatttaagtatctttcttatcgtataatgtactagccaaatatttatatgttgtaacggattattcaaaatagaaaacatatctcgtgcatcctcgttgaaaaaaaaatattagcttcaacttggtaaaaacaagacttgatcttaaaaggcaaaaaaaaaaggcattgctagatttttttttcagatgttatatgattataaagtatgtacttgttactaaattatgttgtctatctcattttaaactaaaagaaactaaatagtttgtgagtttttttaatcatgatggcaagaagcaaattaatggaaaaataaaggactatcttgcagcaagagcagttaaacactattaatacacacctactccctccgtcctaaaatgggttaattggatccatatcatcgtaaatataccatattgaaaaaaatgtcactactattcatgaaatcggatagatgccactgcgatcttctaaaattagaacaatgccactccatcatgatttctgtcgtctccgtcatattttctatcaatggtgccttcatctacttcgggtagatgccactgcaagcagcacgcctacgccagaagctggccagcaagctccgggaaggctagctggtggtcgtggacggcgacgactccacgcggtgatcgtggactgtcgaagagggagccggaggaggagggcacggcggatggtgaaggaacgggataggaggatagctcctcggtgagggcggcagtgagcgggccgcgcatctgctcgagctcgtcgatgagcgcgacgatgacgggctaggatctctgtccagatctggtgagagagaagccaccaccgagccgctgaggtcccactgtcgttcatctgtcccgccgcttgcccgttcagcatcgacaggctcaagcgacaacaggttggagcatggggcgcggtggcggtgacgggagagatgaggagctgctgcccaggcgcagcgacaacctcccctccgcttctttcttccatgccagggaggaggccgagccgcatgacgctgctggaggctgtggacacagagctctcctcgtctcatccaccggcgtctgctctcgttctccgccgcgatcactgccatcttgccctgccagcacccacactctgccaccgccgccaccaggcccaccaccaccatcaacaccacccaccacgacggcgtggatctggtggtggacaacctcgagctcttctctggtgacgcggatccggcggttggccggcggctacaaggggaaatcgacagtcgatggccggcggcgcggtggagttgatgtctctcccctcctcccttcaccgatgttgacgccggcgtgcctaaggtcgtcgccccgcggccctgcacctctctgctccagcgacgggagctccgactccaatggcggggataggagctccgactttggtgtggaaaggtgatgatgaggatggcgacttgacggggaggatggcgacgtgagataggaggacaaaaaaagtgacaggagtggcatggttccaattttataaattttcaatggcacccagctaataatgtgaagagtagtggcatattttcaataaggcatatttacgatggcatggatccaattaaccctaaaatataagggattttgaggggatatgacactcctaggactatgaatctggacagactcctaagaagtatcatatctaccaaaaattgcttatattttgggatggagagagtactccacaccattgcaggataaagcaacgtagtactcacgagttatattgatattattatggttaacatgtcagtggtggtggtggtggtggtgacgacttttttttaagaagtagtatatagtaatacaagtaaattgtgtatatgctttagttttctcactactaatatatccagatatgtatatgttaagttgtgtttttcagtacttgcttaatttaatataatatttattgaattagtattttcaatatatgtatagggttgtggaggtaatctcaccccttgttgttatagtatggtgattatacttaagtttggctattaaacgaaagaaggtagcctgcgcatacgcgcgagcatgttgtttaatcttatttgaaattttattattatgaatgtttatgtgtggatgatatttttgaaatattgttttactctactttaaacgtatgttcattaataactgttgggcatattacttgaacctgtatatcctcaaatttattagaaaaaatatgtcccaataatagagttagttcatatctatttatattgtgtgtgatttttttaaaaaaaatttggagtttccaaactttatataacattttttgttttgtatgctatagatgactttaggtaacattttaattttattatatattaatgaaatatattttctattaaaaatataactaatgatacttcttcatctgatcaaagatagacttatattacttatattcccctgtcacataaatcgaaggaggtaaattttatcccaaaacaatagaagaatttatacgtaaccaagacagtgattttctaaatattaccacgataatctccaaagtaccgtatcatattttgacaaatatgtatactgtagtgcatgttcgttcggtgtctggtttgttttccacatctattgtttctaatcacatgagacacctttagtaatttggagaatacatatgtacatttaagttagtgttgtatatttgtcaagtgttattcacacttaaaatatgatgtgaaattattatcataacattaattattacatgccggctccatatttgtgatgtatttatggctatagatattagtagtttatttatttaaaggaatacaaccggatcacaaattggatatataattttaaaataatttaaaagatagaatacttaaaagcattgattgaatattttatatttacatttgtgtaaatttgaagattattatatttttatctttaaattgtagaaattttttttaaggactgcccattttttggcctttatcataaatacgttttatgttattccggcaaacaatataagcattattatttttttcaaccatatataagtacggagtactttttccggtcaacagttatatatttctcatatatatgtatataggagaaacaattaatctaacggtgtaaaatgaaacaactaaattgtgttgttttcattttcacaaatgtaaatttaaattagtattgtatatttgtcgagtgatatttgacaccctaaaatatgatgtgaaataagaaattatcaaaacattaattatatatatatatatatatcagccttgtatgttaagatcgaacatttcatatttataatatagatttagtttaactacgtatatttacgtaaatttgtagagtaatatatttatctttaaatagtagataatactatttcaaaagaccatcgatctttttcgaatgatacgcttttttttgtttttttgtttttatagtaaaggatttcgaaaatactatttaaaaagaccaccgtgagtagatttttctttgttccgaactttcgatggatagcggttaagttttatttatttttccaagtcgtatgtacgtagggattacttacgttttttttctttttctagcctaattgttatatagttctcccgtatacgtacacagagtaataagttattagtttttaaaataaaatatatctaattgtttaaactatttggttcaccaatttaattaaaaatcggcggtgatatttgcttaaatttatatagtaatagattttctttaaatattagaaaactctattttaaatataatcgattttttatggtactacacacgtatgttttttctttgttttttttacagtaagtccgtgcatagtttttttctttaaataaacaataggtaatatattcattgttttttaattcttacgtatgtacgtacatatggagtactcgtgtttttgttttgtttttccggtgaagtaagtgtctttgttttctttttccggtgaagtaaggtatgagtttctttttaaataaaatacatctaatgtaaggtaagattcatcgttttctattcttacgtatgtacgttagtacgttacctgtacatacgtatatacagggatggatgcatatgtccgcgtggggtacgggggaggactaaaatcagtttaatttgttttctttttccggtgaatagtaaggtattagtttctttttaaatcaaatacatctaatctaatctaatggtccaaataattgggtccaccgatttaagtgaaaatcgacggtgagattagacattgtcacgtggcggcctaggagcgtttgtagaagtgccacgtggcggcttgagagcgtttataggaagtttaatggacctttagtatataatagaagatagatagatagatagaagatagatagatagatagaagatagatagatagatagaagatagatagatagaagatagatagatagattacgaaacaattgctatacatttttgccaagcgtatgacatgtttcgtggtagaaatctaaacagttgccgtcttcgatttaccataactgaagtttccaaccgcgcagctctatttttactacaagagcagttttaatagtagataaattacggcaaaatagacatatatcgagagaatagataaaagaaaaataagaagtactgacttttatgtgtcatgcgtgtgaaattaaggcgttgatttaatctatgtgctgaacaaattatcaaaaggtgagtgttttggaaaatatggtgtgtcgagttttcggacggtgaatagttcaatcagctctaggaggccgatcaggtcagtggtgattggatggtctgaccgtgttgccgacagtcagataaggttggagtcgattttgggttgatttcgtgaaatttatagattttcttcatgtttgtgacttatagatggtttatattcatatgtgatattattgtgtgctgatgtaagtcaagttggtgcgagattgtactcacatatgaagtttttttccatgtgtaggtgttgcttgagactatgagagtatacccggtgatggattaaggctacacttggtagaagttgaggtctagacgatcgagaatatcacgctagatgctcaagctagagaacaatgagtgtggaggtgaagtttttcatatggcatacatatagtgttatgtgtgtatggagagagtaattaaatttggattggagtccaagtttgaaaagattggagtgtggagttgtatggggatactgcttccctggtttagtaggtttgctggtgattagaagtactagttctagttggattcatggttagaggaagccacattgtggtataaatagatgagggtttaagactagaatagttctagttggattcatggttagaggaagccacattgtggtataaatagatgagggtttaagactagaatacatcgactttctggtagagaaaatttggttgccggatgttggagatgtgttcccaacccctgaccattaaagacatgtttgatcatcaaagacctagagaagaatctttcaatcataacagcaccatcgaatattgaggtccccttcatctaatgaagacaatttcaacgtagaaaaggcaccttagtctagcgaag

SEQ ID NO: 19142 - DNA, 38674 bp, Oryza sativa
gtataaatagatgagggtttaagactagaatagttctagttggattcatggttagaggaagccacattgtggtataaatagatgagggtttaagactagaatacatcgactttctggtagagaaaatttggttgccggatgttggagatgtgttcccaacccctgaccattaaagacatgtttgatcatcaaagacctagagaagaatctttcaatcataacagcaccatcgaatattgaggtccccttcatctaatgaagacaatttcaacgtagaaaaggcaccttagtctagcgaagatcgatacctctccggtcatatcggggtttcaattctaattcatgagttgagagagaagtgctttagatgcactttgcaaacacaatttgatgcaataaatgtggttttctttacatcccaacggtctagcgtacaccataggagcaggcagaccgaaggcagtgacaacaacagcaagctggcgaagagactgacgacttggagagggctacgcgtcggacgtccgatgctttagggaaaaatcagacgctgacgtcagcgcccgatttatgtgcaaaactatttttaaactggtttttctcttaagatacttatccaaatcatgatccgaataattcgtggcaatatattgtactatcacaatgataatttttctatggcaaataactatactttattgcaacgatttacgatcatgttttattcagtatttttgttgtaataggaaatgagctatcaccacaaaaaacattactattgcaaaaaaaacatgttctattgccacaaatttaatttttgtggcaatttacatagtacagggtacttttcactattttctattgccatgatcaacaaattcgttgcaataaaaaaattagcatatcataatttaacttattcttttcatatggatacagattaggacgaattttatatgaaatttatagctctcgatgagatctacaacttaaatttttcattcgaaatcttttaaatacttaaattcatgattcaaatctcagttaggaagtctcaaatagaattatatgcatttttaaacaaaattgatgcgtaggtgagttggtcatggagagcgcgcgtgagggagagagatcttgggtttaaatcctagccatgacaagatatcaaaagaaaataggtagaatgataaattaatattgaaacatttaatttggtacgtagaactaatgccacacatggagtggtggctatagttatttattgcaacgatgtgaagtgttgcaatatatattttttgccacatccattttatggcaatatcaaaatttattacaactaaataaaaatcgttgcaataacttattaccacgctatttattaccacggctagtaacgattttaagattgtggcaacatgtatctattgccacaattttagcattgatgctacgattttttttgtgataaattatttttctagtagtgcgagttttaattttgtttgagtttcgttcggaaatatatcaaagcaatttgaaagtgtttcttaagagaacacataaaggtttgcaaagagcaaaaaaaaagttgagcatattaaaacttcacttttgagttgaaatttgtaaattaggttgagtggtggattataggatctctagaaccttgtgcaccccgcgcaagagatttaggtggcgacccaaaacgtagcctctaccaccccttcctccctcctcctccgcactaccgtcactggatcgagcaataggaaaccgcctagtgcttattattgaattatttttaaatgttgcacgatgttccaccaggtatatcggaattgtttcactaagtagatcgaaaatgtttcactcgtttaaatctggtgttgtttcaccttatataaaaacaatgtttcagcaaatagcggaaaaatgttttagttcactgcaatattagatctatacacagtgaaacattataagtacactaagtggaacattttttggtgaaacaaaaaatgaaatgaattcccttaatttccaaaatatgtgggttttttattgcaatgaaatatttcagttcactgcaacattagatctataaatagtggaacattgttagtgcactaggtgaaacattttttgtggaacaaaaaataaaccacattcccttaatatagggtttccaaaatatgtgggtgatttattgcaacggcgcgttccactgcaacatttgatccatacacagtgaaacatcatgagtacattagctgaaacattataaaactattagttgaaacatcaaaagagaccacatgcaacattaaaaaaatcaataaaaaaattaaaatatttttttgtcgaaatataatcatgtgtggtcttgttataaagatttaattgtaacgaatttagtggtgcaattagatcgtagattagataaatagtttacgataaaaaaatcttttgaagaaataagaaaagaaaagattctttgcatactggcatgctgcagtggcagacagtgtccgatttttctccaccccgttggtcgtccgggggtgagcattttcgtgacgacttcattgcggtttgaccggctttgatctgtttgaccaacacatctccatcaagtttgagggtttttttaattttggaaaaaagaatttagtttttggtgtttctaccaaggctgccttgatattttacgttcgatcctacaatgtgagagttagatttactcatttacatatgctttaagataaaatatacatattaataaatatatataagataacacacgttttatcgtgtggttgaaaaatccggattttaaaaataaaatagttgcagttttcgaaagcctagagaagtgtattctaaaaatttaaatttcaaactgcgataaaaaaattatttttaaaaatttaaatttcacattgggataaaaaaaattaagagtaaattgtattggtggtacacaaacttattaggtaggtgcaatttagtacatgaacttgcaaaatgctcgttttgatacacaaacttatctgatccgtgcgaactaggtctaaaatagcttggcaaggttaattttacatagctgatgttgattaagatgtggcgtggatacatatagtgagtataaatatttataaatttgttctctactttattttgaatttcgtttgtttctaatccttgtatcattgctcggtttttttatatctttctctacatcactatatctcattctatctttttattgaacatgtgtatgtctaagtagcaaccttctcatacacttcatccatttcacagtgtaagtcattctagcatttatatctgtttaaattcattaacatcaatatgaatgtggaaaatgctagaatgacttgcattgcgaaatggagggagtatatgtttacgtagtatcctaattagcacataaatcaacaaaattagttatgtaatgtccttttgaccttagtttgcacgtgcaagataactttatgtaccaaaacgagtattttataagttcatacactagattacactcacctaacaagctcgtgtaccgctgatgcaatttacttcaaaattaaagtactagtagcaccttttcaaataaattttgtaaatattttctttattttcaataactttgtactactagtatatctgtaaatggtttagtactactccctccgtttcaggttataagacgttttaactttattcaaagtcaaactactctaagtttgaggaaaaaaatagtaatatttataataccatcatagtttcattaaatctataattgaataaattttcataatatattagtcttgggttaaaaatatgagtactactttttctataaaattagttaaacttagagtagtttgactttcactaaaatcaaaacgtgttaaaacctggaatggagggagtattaaaatttgttttctttctagttctaccaaaaagaaaaaagaaaaattgtttggttggtggccatcccatccacccatccgggctgactccggcccaactgctcctctctctcgcatcggggtcgctccctctctcggctctcgcgctcgctttctgtctgtctctgctctcgctccgccgccccgcctcctccgttcgccgagcgcccgccgcgtcgccggccgccacacggccaacctcttccttcctcgccgccccctcgcgcttccagttcctcctcctcctccgtttctaactagcgaggattagggttagccctactaccttcgcgctcttcccccaacccccgcttcgcttcttcctcgtctcggtcgcagcacgacgtccgcttcagtgagggaaggggagggagagggatggatgtgctgaggaagcaggcgagcaagttcaaggagcaggtcgccaagcagcagcaggttcggatcccagatctggggcccttcagtctcagtgtttgttagggggaaggaatggttaattttgtagcgggtgcgatttctccgtttccgttttggacttagtcggagggttctgcgccatgagaaaaccaaatagaaatggcgacgagatggctcgctgttgcaggaattttttgtccctgggatatcagatttaagctgtgaattactattcttgtatcgcctgatctgttctctgggtggtggttgaaatgtgaaactaagagctattttttatcctttttagatatagtttccccttctgtttgccagctgttagattgttactgattttagattaaatatattttccaccagagtgtaaccattaagataaagtatcacaaactacagatttaatagcaacattgtcacaaaactacaagtttagcaccagtataatcacaaaactacaacattttatagcttgaagataacattagtgttaagggtttaaactctaaaatctgtagttatgtgaaaaatttggtgttaaatctgtatttttgcgatgttttggtcaaagtatatgtagttttgtggaatttactcttaatacaggagtaattttgtaatgaggggcaacatatgcttgtaaacattaacattatgtgtaattttagtttttatccaagttactcagtctgtcggtcgggtatgttcgcaattcttacaaatggaagacatcacgtacgttaaccttcctttattaggctcggtcgcccaattgacaatttgatacaattgtcatagtgcaattatatccatgggaagctttaatttggcttagttgtcacttataaaaccatgccgctctctgtaaatgactaaatattttcttcttggaagtgtctgctagtgcttcatgtgctatattcatggtcaagtcttctttgcttacatgtttacatttcaggctgtgataaagcagttcagtactacgggctatgaacattcagacgctgttgtaattgatgaagttgaattacagagacatcaacagcttgagaaattgtacacttctactcgttctggaagggtaaggaaggagaattgcagatagcataaaatacatacctatgtaatatgatcagctggcagcaaattaatcttgcatttatgttattgatatattgctggtgtatttcatttgacatgtctgatttattcagttcattacacaatgtttttaagacattaatacagaagagaatatttgcatgattacgtgaaatacttcccaagaattccattttcagttattaaactcaatgcgtgcatatatgctaacaggatttccaaaaggacattgttcgagcggctgaaggtttggtttctattggaatcaggcatgttgaagtgggtatgtggttcatgccttccatcctctgttagcttattatgtcatgtttggatttgcatgcttttccatcatttttatgcttgaatggtgggaatattaatgaggatcagatgatagaacctctctaccttccagaatatgaggtgtttaatttgagggatgagctggctgtaaaatcacctgatccaaacttctaaacttcaccttctttgtctgagagcatgatttatcatgtttcacgtggccagaacaccaatgggaaaacgaggaatgacaatacccacaaaaaccatgtgatgacatcataataggagtaggacgtgctcatcatgaatggtgctatctttagctaaatgtactagaatggaaacttcgctatcgattatcggatcctgctaacttgataatatttattaccactttttgattgggctgccagtaaatgttgtgaaggggcttttgggaattgagaaatgttctctcaacttgcaaaatcagaggatgaatatgtgacaaaagaatatgactatcaaataaaaatttgaatttcttgagcctgagaccttttttgtgaagacaaggcaatggttaaaaatgtatgcaaggaatcctttttcaaaaagaatagcattgcatgatctgctcgaatccccccaaattcaacatcttacgagtgataccggtatacatttttctttcttttggtcacaggaacaaaattttcagaggattgttatagatatggaggtgaaagtagtgctagtgatgaagcccttgcaaaagcagcatctctgtatggaggtgctctaagaaatgttgagaaagagtacgaagaatttaatagaattttatcttctcaggtaacttttttggatgttaattagtactgttctcacacagacaaattttgctggcttgtgcacagtaatgtttatttctctgtaccctgcatttatgttgtcaatcggtggtttttcttagtatgtacatatatatggtattttgaacccttcttttgttattcttgtatgcctcaatagataggtgtatctctctggtagctgtacgaggagctactagtctacaaaaagagccttgctactaccagtgttctaaaagtcggtgctaggcacagggtagctgcctcaatttggcatttgatggtgcattatgctgctgcccagccttgagggctctagtatttttatattgatgttctagtatctttcttgtatgtcatatgcttgctaattggttggaagccgctagtcaacttggttctaggagctgcctagactgcatattggtgcccctagtcactaggcacttgctcttccaaccatctggcgcctagcgactttttgggccatagcaagaaataactgtcctttttttgttatatcaccaacataatgcagtcagcctagcactcaatcacttaggctggagtagagagaatgtactggaatttgcaatgaaatgtttatgtgctgagaagtgcacatgcatactcaagcctagatatgtatatactgatggatctcatccagttcatatctttacattggagtatatcctaaaagtgtactgatggaagggaccactagagatctcatttacagtccagcatattgaatatgctggaagtcctttaggctgatgattgtggaatccgaatttttatgctggttcatcctattcaataattggaaacttgtcggtgcattaaaaccaagcagtaatgatgtctcaccgcctggtcccaatttttgccctatcttctctcttagacacaattttctaggtctattgatctaagcctggaaataaaacaccatacaacattttccctttaccttttggtgcacgtgatttatatagttgtcatgcaagcgatcaccaattcaccattattttgaagatgcagtttttgtcattctttttcagtgcatactggggcttagccttcaattaaagatctctagaaatttaagatctgtagtattgcattggtccttcaatgtattttacaaatatacttccatttattttgaatttcagactatagatccattgagggctatggctgcaggcgctcccctggaagatgctcgtggtcttgcacaacgttatagccggatgagacatgaagctgagatccttgtatgtattagcaacttgttccatattgcaagcaagcaatcttactattgctacttctatgcttcatagaatacttttccccattatgtatcttaaccctcttgtttgtcatacagtctgctgaaattgctagaaggaagcaacgggtacgagaagctccacttgctgagcacactacgaagcttcaacagtctgaatctaaaatgatagagcacaaagcaagcatggctgtgttaggaaaggaagctgctgctgcacttgccgctgttgaatctcagcagcaaaggataactcttcagcgcctggttggcatggtaatgttgcctgcctctagcatataattcatctatcaccattgagttgtttcatttgattcttatcctttgtcacttatcctgttgaaggtagaagcagaaaagttatttcatttgaggttagctgctatacttgatgatgttgaagctgaggtagaattttcactctgcttatcatgtaaactgtcaaaatctcttgcatttctgaattttgcataattcttatttctagatgtcctctgaaaagcaaaagagagaatctgcaccgcctactattcattcccataagcgtgctgagaaggcccagtacttccttgctgaggttaacatgagtaactgacattaccaagcaattataccatattttacatgtcatgtgcattgaaccttcttgttgctgcaggcggtgcataacttcaatggtaccacagaaaaggagttgagtttaattgttggtgattatgtcgttgttcgtcaggtcagtgtcctaataatcatttcatctgcgaagtagtgagataatcagtttaatcactgcccccattgcccgcagaaagaatcttaagtgattttcaatagtctctagactagatgaccaattagtgccttacttcctctggcaatggaaccaattagtctctggaggcttgtcctgatcatgtagtagctagtgattgtccttctttcaggaataaattagcttgtcaatcaacgagggaataaccagatgatgtacaaagttgggtagggttgaatcgattggtccaacaaacaatggtgctgaattgtctagtgcattaagacctcaatccaaatttaccatctaattgccttttcatttgtatctgctctagattgctccgaatggttgggccgaaggagaatgcaagggggtggcaggatggttcccggctgcctacgtggagaggcgtgaaaatatcccgccaaacaaagtcttcccgcaagcataaaccgccaaatgctagttgaaaatctagatttgcgctgctaaaatctgtaatttggtttgggactgccatgatttttggtccttttggagttgtttaggccgtatgactggtatgttctttgttctaccttgtacatgttttagtaacttgtgatcagtatacatgttttcctggcagcagattagacagtagactaaaagctttggccattcatgatgatgcctttcgaatgtaaagttatttatgtaccaaattctttcgctaatgatgtgcttattgattgatgattcccttccgtaacgtatttgtgtgctttctctaatgatgtttattgattgatgattctgttccataacgtctttgtgtgctttcctgttgaatgcataagtagcgtcattgtctgctcagaattcaaaatgcttatttggcccacaagattagttgtcgaatttgacgtatggtcacaatgatgaagaataaaacaccgcgttgtttaatgggataattcacaagtttaactctttttttcctcctgtgaaaccttattgtttgcacaatcttcacaattcctccaattcctgcagcgtgactgttcctgtacaggaattccgacatcacaaatcatccattatgtttctcaacgaatctcgcccgcactcgtccatagatcgatcgaaagagattgctgcgccagaaatggatgcctctagcgtggaaaatgcacatcgacgcaaatctgcagtctccatcagcatcatgggatttgacagatttgacccatcgtagaacaacaaatctggatagaacttttgtctagatttgttgtattaggataaatcacgtcctaggttgcaacattttgaaacggaggtaatacatgtacagcacaactcacagtagagtatactagtaagtaatacattcatgattcaccattgcatgaaagctgttaggtttgtcccagaaaagtatgcttttgtaatttgctgaacacacctgaaaaaaaaatcatctccgtccagtagctctctgcatgtcataggcaccccagggagcgtgcgttgagccaggcccaaactgggagccggaatcagcagtgtttgcctggggatgtggcttcaaaagtagcaagaaatgaggatgaaagaatatgcaaataggtattgcggaaacaaagaataagagacatacttgatttatgttgtatccagcattataaggatttgcggcatatgcggccttaggattcccatagcctccgacgtacactgcaggatgggagcaccatgtcatgatgaagttatattccagatgtgcaacacggaaagagatttaaactacatggtcaaccttacaaattatgccctttggttgacatgatctgatttcaaaacattaagtatccctacataacacagatggtcccgaaccactaaaaagagtactagagaaaaataagcatccagagtttgttaagtaccttgattgcctccagacacagcagctcgtgacctcttctcggcctcagctcgaagcttctccacttcagaagccactgatatcaatttcttctgcatctcttgtccctgctcatagctctcggcatatcctttcttctcaacctcaatgccagatctgcaggtcaaataatacaaccatataaggttgaaaaacataaggttattcttggaatttcactctctctactactccaggggtaactggaattcattttggacaaaaaaaaagtaagagctcattccatttcaaattttaattataatagatcgtaacttgaccagacaaaccaaaagagttcatagaaccaagagaatggcaaaacaaaacagcgatggattgttttctcacaagtgcaaaggagatagctaagatgattcagtgggaaatagataacaccaacaattttgcatatacagattatatttttgcaaaaagactaaaaatacacatcgctctctttcagaacactgaaagtgcatatgaaattaacaaggctctacctcaaatgttgtgtttcatgccttatctcctggatctcagcttttaacgcagccacctgctgcaggtccactgctgatcgagccaagtcctgggtgaacccctggacctgacccatgagttcctgccttgctgcacccaacttctgaatgtcgaggcgaacctgtgcaagctctgccctcatttcctctactgctcgcagctctgcctccatcttcattgacctctcatagacctattaaaattatttctgatgttacaatccaaaaaggcacaagtcaattttacttggcatgggcagaactaacctactagctcactaagtcagatagctttgggtcaaagagacataagcttgacatgaccacatttgaaaatattaccaaacaatgcagtttctcttcaactgaaaatttcaatgaacctttctcactcagatatgcagctttgaacctatactcaacacaaaatatgcatttaagtatgatgtatttaaaggcagtggattaagatgatatgtggaaataattggggaaaatagaaggaaataagatattaagaacagatcagttaagattttttttggggggaaagaattacatatgccattgtacgaccagaagtttcaaacatcatatcaagcagtgtgaaaatacttacacagctccaataaacagagttttcgcatagcatgtgtttggtttgagggcgaggtgagatgggttgggtccatccctgtcatttattttctgtttggtttgagggatgggaatgaaccctatttttttgtttggtttgagggataaaaagggatggaatggtcctatcacctgtttggatggagggatggagggatggagttgggatagttggatagagatacctcctcacattgagttagtgaggttacctctcacaccgagctttttttttttctaacaaaaatgccctcttttgtgatgtcaatccaccgtcacatattttcacaactatatatcatgttgactatactggtagagctgctagagctattaatttgcatatacgtagatgtctttctctttggtgatgtctatccactatcagaaatcgaaaatcacgaatcaagcatcacagccaagctagctctgctcctcagctccagaattcagctcgtagcagttgacgagagaggatgcgaggacaagcagcagcaacgagcaagaggatgcgagaagggaggatgaaggagccgcagccgtcactgactcttgtgcacgtggccgccggcagctcgcccgcacgcatgatggagggaggaaggagccatggccgttgctgacttgcgtgcacgcggcagccaccatggaggagggaggaggaaggagtggcggccgtcgctgacggcgcgcacgctaccatcgccactctcgctcctgttgcatcgctctcgctgggtgggtaaaaacagggaaaaaatagactctggctgggaaggataaggtcactgtatggatggaggtatgtgcgggtcacgtgatgtgcgcgggtgaagtggataggcgcggtccggccatttctggcggaccgtctcatcccaaatattgatggaatattcctttttggtttcatcccattccacctagtccttcaaccaaacacctacaaaaaatgggttggccccttcccaacccaccaatatccttcatgctaaacacatgcatagagaaaattctggattatagggagaacgctctgtgccgtttaaattaactcattaattatgatatgcaaatttcagtgtatcactaagaaaatctagaacttagccatgacaggttggatatttggcaaatattaaaatgaactttttcccttgtggacaaatgttgtgcaaacttggcattcgaaggggaaagttattgtgcttggcatcgaaaaggcataaacatgcgccttgtctactctagcttgctgccatctcccctctattcttagtttctcactcgtcattatctccctccctgccgcatttccattgcttaccaatcttgcaagagggagaagaataagatgacttcaaatgaagtgagcagttcacggttcaccttgtatgtgaataaaatccatacccaggattcatgaatgtggatattcacacatcttatggagttacgggcattgcacttctaagtgctgacctccagctccgtgcattatcagcatagggggagacggatggaaacaacactaaggtggatgaagactaccaaaacaagaatatgatggattgtagtggttctgcttgcaagactaccaaaacaagaatacgatggattgtagtggctctgcttgcaagcccagcccttaaccctaccgtacctacactgccctctttccaattttcttctcactgaatccctcacctttgcaaacaaaggcacaatgcaaggcaaatacagtataccactggctccgactatcatgcagtatttcccaacgcaaaatttagagggttccaaaatagacaacataagttcttatgctaacataatcgcttcaaacagacccgcattatcatgcacctaatatttcacaaagcaaaatttggagggttccaaaatagacgacattggttattatgcttgcataatcacttcaaacagacccaccgcaataaaattttagcgcaattgagtcaggaagtcaaagttggaactaaatttgcaagaggaatttatagttttgccgaactaaacagaccaaatatatgcaagggataagcatcaggattctgtgctatagatcgatttttctcataaggatttagtgggaaaaaaaacagagacaaaatcagcgcatcagaaaagcatcgcacctcgcgaagacggagttcgccttcctcctgggcagcggcaaggccgcgagcggtgcggccgagctcgtgccgcacggcggagacctcctgcacgagcgccacgtgcgtcgcggccagccgctggttctggccaagcagcacgtgcgcctcctcgatctccgcgccgagccgctcctccagcgccgccacgacgtgcggggccggggggggcccggcgccgccgccgtggcccgcgaacacgtggtggcgcggcggctcgccgaattcgtcgaggtggtggtggtggtgcggcggcggcaggtggtgcggctcgcggaagtcgtctaggcggtggtgcggggggagcagcggcggctcccggaagtcgtccaggtgatgaggcggcggcaggcggtggtggtggaccaagggaggaggcgggtggtggcccctgcccacgcccccgccgccgccgcgagggaaggatgggggcggcgggttacggtggcggccggccatgggagtcgccggaaccctaggtcagacctcgggcgaccgacgggaggagattttgcgcgaataacctcgagtttccgaagaatgggagcaggtgttccctcgccttgacttgctttccatgcgcgatagcattttggaacaaacgaaatatcaattctacattaatttctaaggaattttaagatgagtatttgaactaatcttagtttagctcaataatatcatatactccctctattcttttttcatcaacgtattaaaaaatgaattatgtgctattgattgtcaccaaatataccctattcgattgaaatgtagtggttcgttatgtttttcacataggattactgcgcttgtatgttaagatggctatatattggttgacatgcaacggctttaaatgacttgtacataacaattacttctcaacaaaaattggcatatcaactggtagacggggccaacagcacgacgtatacgttgttaacaaaaagtcatgcaaagagtgttggtaccagtgcatagatgaaacaagtttgctcgtcgaagttatagttatctttctcatttactacaaattgcttgcaatgttgaaagtcaaaataaggaggacataagaaagcaataactttgcttatcctatcttaccgtgagatatgtagatgaatgcatgttatacattatagaaaatggtaggtgcatatatctaaataatatgaaaataatgtggagataatgatatgacattgcttacatattgagttctaaaaatacaataaaattgtaaatgatatgtcatgtttgaatgatatttaaaatactctagataataattgctagtgggtgatgatatggcacagatgcatgtgatctaaaacattttagataataattgctagttggtgatgctgtggtacacttgcatattgagctttagtagttagtgggcattaactttatagtaagactagatgaaaccccgtgcgttgttgcgggagtttttgtatgatgttagaagaaataatagctacacttgtataattttcagttttaatcaactattgaaaaaagctacaaataattaagatggtggggtttataacaatttatatcatataggatttgatcgttgaaaagtaaaataaaggtggtttgatattgctgcggaaatacatgagatactttcagttgtagtattctaagactaatctttgtgtatggataactgatggaaatgcctagtaaattgaaattgcatttgctcaaaaggaatcgggtgggtctactgcatatatatgcatttagattaaaccaatatgtgaccaattttcatttccatatcgaaccaataacctctcaaatggcgttggttctgttcagttacatgtatgtgattattaaaaaatctagaagaattaatagagatttagaaggagaataaatggcactaaccatggcccatggcctctgatcataaacacactgctcaacatctcacccatacatgcttgcgttacatgcattctaaattaacgcatgcataaacacactgctcaacatctcgtccggggaccttcttatccaacggttcatatgcgatctcatccaccgatcgaacggctaagaattagcgatgacgtggaatactgaggtttcagctttgggtcttaactttatagaaaaaatagatatgggtgatgatctgacacacttacatattgagctttatgagttaacagataccaactttatactaaggtaggatatgacgatcaaaatgagcacttttcaccaaaacatgaaagcccaatattttttttgtggatgcctcgccaactatggctgtgttcggcatcctttttcccaatcggaacggtacacacgaaaaacggagcgtttcattagcgcgtgattagttaagtattagctattttttttcaaaaatagattaatttgatgttttaaataactatcgtatagaaactttttgcaaaaacacaccgtttagcagtttgaaaagtgtgcgcgtggaaaacaagggagagtggttggggaaaaggggtgccgaacacagcctatatttatctcaaattttctatgtatactcatttatcttgtcaaattcacttgttgctttaggcaccctcatcatttttccttctatatatgacttgtttcagattgccgtatttgaaaattttcattgatcatttatcttgtttgttggttgttttattaaacatagtattgtcataatcattgtcagataaccaatcatcgggctaattatcaagaaacttaaagcaccctaccccacttcaatgaccaagatattcaagggcttaacatttgagcgggacatgtcattttactacctttgtcaaaagctcgcatatgccctgttatatcattgaggaagagaagtagactcaatggatctaaagtaccaacacaagcatgatcccatgaggcacgggatatatagagattaatgtcatagatataatggataaagaaatggtggctctacccttagttcgcattcaaagattaccaaatatggttaattagatatataacattacaaattttttaattttgaaatttaccactactattcatttatttagaactatgctattggtatttgtctgaaattgtaatggtgccattgacatacatattttacatatatgtgacggaaataccctcatcttcaacctctctcctctcagtctcagactctcagttgcctcggtatagcaggagcagcaggagctctttctcactcactctctaattaatccttttgtgggttaattagatatatgctgccggtggagcttggcgtggtgcctctcaccagcatcgggggctagtctcgtcggcgtcgccaaggcgcggcagacaacgggcaggtaggaggaggcgatggtggcgttgcagtagacggcggcagtggtcgtccaccaccacgtcgccacggccatggccccgccagtggcgcgaggacgaatggaagacggcaggacgctggcgacacgaggatgagcagacgaagccggcgatacgaggtggacgagcggacgccagctcaagattcggcggagctcggagcggacgaggctccggccagctctcggtggattcggcgccccctctctcgctttatctggatctgggcgaagccacttgcggcggagctcgggccaggatgcaccactgctccggctagacggcgtcggtggatctgtgacagggaggctcgggcgtagctgcgcacgaccggtggcggagctccatcgtggccggcctcgtcaacttcaaaagttcttccccggcgccgtctcccggcggcgggcagccgcgcaatacctctccgccgccggattcctggtcatcgtctcaccgcgcggaggggtcgtatggtcgtgtcgccggggactacgtcactgcgaggcagcactccgccggaggtggggaagaaggcttcggctggtgttacacagaaacgagagatggaggaggaagacgggggcaattatgtccaatacggctaaaatatgtagactagtggcaggtttcaacttacatgcaaattgtaatggcgcggatccaaatacacaaattataatggcatatctcaaaacacatcaaatttataatggcatgtatccaattaacctaaaaaatatcaatcttctatacaaacctatgaggatgtagttagtcatgaaatgttttactagtaccgtgctagaataagaatggattaagatatgcaatataaggtattttaggacccataaaccttgtgtacttggccttgatgttagccaattatgttgaacaaccataatcttctcatttgtgttatccccacccatctaaagttgtttgattagtaaatcaaggaacaattatgtcaaacaaacatcaattcactatcctataaagtagaaagtaaatattatatattttttgagtatttaataaataccgttctttccatcctaaaatgtaacaatttttagttatgaatgcaggcaagagtttctgggacagagagacacatagagcaatgtgttctatattacatgtagtttgtgcagcgttctttccatgactttagagagatttgtagcacacgtgaaacgagaaaactcattaacatgtgattattaagtattaactattataaaaaatttaaaaatagatttatttgatttttttaaacaactcatataaacttttattataaaatatgcaccatttaacagtttgaataacgtgttaacgaaaaatgagtaagttgaaatttggagttgaagaaaataactgggcctaagactataatacaatccttactcaacattcaatatttgttccaaaaaggacaaaaatatccgaaatggttttagtatttatctcatcttcatgcttcaaaggttactttttatacgttaaattaataaaaggaaggaaagccaagagtaaattctttatttttcatggaagttgacttagtcccttattttctctcggaaactctctctccctttattgtgacatcacccttcatttttaactattcttctttatttgcccaaagaaccataaaagtattttttttgcccttggtagttcacaagaggtgctctctcatggcaaatattttgttatcacttacaaaattcataattatgatgcttgatgaagagtgtaattgaactggtaatgatgcaccaactaattattatgatctcaagaatttcttaacacctttttcattattaccctttttattcccatatggtatgagggtaccacacattccaaataaattcataatctgcccttttttttaaaaaaaattctcattaatgaaactaaaactgtatgttcataattttattcatcaatatgtgttgtttggatgacacatgttaattaaagaaaataatactattacgatttttttaaaaatttacatatgatgcaacgaataaaagatatacttatgataccatatcccaattttatttttttccgtttaaagaaaataatttattagattctactattcatgcaggggtaagatgggcattttttgaaaaatttaaatgaagaaccactcaagggcaaataaaaaaagttgagaaaaaagagacaataaaaggggagccaattttatgagggccaaatatactattataaaaattaaagatgtttttgccggtattttggtacgtcatccgtgtatgagtcggtttttaagttcgtttgcttttgaaatacatatccatatttgagtcagtttttaaaatcgttcacttttggtaatacagaaggaatcatataagaaatatgtttaaaaaaactcgtatgttaacttgagacgatcggattcctaactgcagctcatgattttctaaaaatatatatatatccaagcagactcccacactgaattttatcttaactaaaccatataataagattaaaatagactttacccgttgcaacacatggacattttttctaagtagagaatacattcaataatttagagggcaaataagtaattatctcggaatccaagattatgtttaaccgttaccaccatttactttgcactagagtacaaaattctctaaccgacctagtaaaaacacagcttgtaataacatcaaacctacagggtcccaagtggaaaactcccgttgggatttttacatcccaatccctcccgctaccaacaaatcccaaatcccccacgccctcacctcacctctccagattcggaggggccaaaatcaaaatccacccgccgacctcttcccctcccccctctctttccctctcgccgccgccgccgccgattcccagtcgaaccggcgccgcccggtgctcggaggccgccctccgctccgcccgccggcgaccatggaggtgagtaatctgtttcgagcgcgttggggttttggggtagtcagcgagcttttggtctcacgccgagatggcgcttcctctctctttgttccagggggacatggacgcgacgatgacaaccctggggccggaggacgacacgggcgcgcaggggctgatcctgccgagcagggatagggtcatgtaccggccgccgccggggaagtccgccctaggtatggtggtgcttggttttacttctgcttctgtatttgacgagacttcaggaaattttgattttaagtggatttctagagttgctagggagttcgatttccgcgagcgagattagtgtgtaaaacttgatgagcagatcccaatttgaatttgactcagaaatcgtcgaggcctgcaaaatctagagctcgggtgagctgattctgagatgtggtttttgcaggtttggacctcctcgcgcacaggaaacgggaagcagaaggcggcaatgccttcaagccgccgcctcagaaggtagtggcagctgctacttcaatcgatgaagatgagaagccgggacctgcggagagtgatgagaagagcctgagcagtggccatcgtggcagtgtttctcgccgctatcgaggagccaactctgatgagagaacctctttcaaaggtcctatatatatacactcttgtatgttacaaatgcaaatgattgtccattgtaactaaagcgttatcgccattttcagaacctaccatcactgatgaggatggaaggggtccttcacccagtcaccgagatggatcttatcgacaagatgttagtgattacttgtgtcccatattactttgggaacttcataaagaatctggctgttttattttctcttcaccttactaaccaagtctgtttctgttcatgtcgttttacagacccacaaatctagaagttctcaaggttcccattctcgtagcactcctcgtagatatgatgactatgaggataggggatcccgtgataaacatggagaacgggaaagatctgcatccattggctatagtagcagtggaaggcggggacaccatgatgatagagaatcgcataataggcgtgatgaacgtgagagatctacatccgttgactacatgaacaagcgaagtcggcatgagcatagctcaagaagctcaagaacacctggtatcatgtttgttatcttattcttttcatgcttaggctaattggcttgtcacttgctgataaaattgtggctgtgattgcaaattgttagcaagatctgattgggacagtggccgatgggaatgggaagatacacctcgtcgggagtaccgtgatgatcgctcaaattcccatagacaacatccttcaccatctcctatgcttgcagctgcatcccctgatgcacgcttagtgtctccttggctaggtgggaatacgccacgttatgcaggtaacaaaagctcagctattcaatgttgtttgcacttttcttctttaatttaaatcaaataaatcatacttctattgttgttttgaatatccagcatccccatgggataacgtatctccatcacctgcaccaattcgcgcttctggttcatcaaaagggtcttcttatccacgttctggtggaagatcccaccagcttactttttcgtctacatctgcatcaaatgtaagtcaggattctgttttcacaaaacatgcctttatgtaggaaaaatcaaaacatgcctttatacaggaaaaatcaggtgttttttttttttgcattcatctcatatgttgcaagttcggtatgattattttaagacatccatacacccaggaggtgaagtagagtagacgaagattgtagtcctatgggctatatacattgtagagagttggaagccccattcatacattcctaaacactatcacatctattgagaaattaatcctccttttagcacgacagtcttttaatgttgaatctcctggaatgccgatttttagaagtggtaactctgctggtaatttaattcaaccatttagaccagtgctcgaaacaatgataaatgtaatgaagcatgtattttgttcacttttttctctctatctgtgtttttagaataattgtcattggatgttcgatatttatttctatgaactgaacgtgtgtatagcattacttaaactataactgaagtaatgttacgaaattaccatgtgactgatctaagttgctttaatttttctgcctctttctgtctgaagagtattacagttaggctactatgtaattcatttaattatttcatgtactttcaatcaaacaatagacttgattgagtctatttggtatttactgacagaagtctaactaactttaagtttcatgttgtttgtggatcactttatagtatattgcaagttctcattttgtttcttcactggtcattctgacaataacctctaccctgttatctcaggacagggaatctgatagaagcccctcagatgccgatggcaactatgagatatctgaagaaatgatgcaggagatggattataatgctgatcgtgcgtggtacttttctttcctcataaaatttccctggtttttgtattcaaaaggatgatgtaggtgtctgatagaaaaaaaatatatttgcaaaccaagtgatcaacaaagcctttcaattgctgctgttgcatttattggctccatttataatagctaaaaatggtaatggcatctgaagtaagttggcacaatgatgtttttcatatatctgtaacaaaattctgattttatgccatagttctatccagacatggtagtgtagagatatgaaagtacaatgatttttgacattctcttatcattatacaacaacaaattgattacacattcttctaacctttacaaatatactccaggtatgattgtgaagaacacaacaccatgtttgatggtgataattctatgtatcttgaagatgatagttcctacaaaaagagggaagcacaattaccaaagcggctggtaagttccttgcttgtttacatctcccgtgcttccatgcacttcgtgttagccttcataagttcttatttgttctgagtaattgagtagaacttattgcagctacagcctctatgaaaccatgaatatatctgattaattagtaaatgataaggtcgtgctattgtggcgctggactgaatgtatggatctgatacttctatcttctagcaagactccgcctttgtaaaaatgtcttgcattttgtgatttactgtaaacatccgataatttgtactcagacatgtaaaagtgcaccggtaagaagtaaagtaaggcttgagaataccaccaaattagatgtatgttttttccttgttcaagttccttatgtatattatgaaaattgcatcatcattaggaaattgtattcatttaacttttttcaagactgccaaacccatgtgcagcaagacctgcaaaaaattggatggtcaagaattatccacttagtttttcagtaaatatagttattttgtaataatttttcatatctttaacttgtagagaatgtcttgtattctgatttcttactatttttattgggtgcagactcgtaaagatggcagtctgatgacccttgctcagagcaagaagttatcacagatgactgctgataatgctcaatgggaggatagacagttgttgagatctggagctgtcagaggaacagaggtgcagacagaatttgatgatgaggacgaaaggaaagtaatacttcttgttcatggtacgttcttcgaatatcgcagcctcttatcgatgttatagttgtcactaaacaagctacgaaaatgtttggaaagcatctatctatttctcatgtaatggtgtatatgcaattttacttatgaaaataatagacactatttatgttggtaaggtaagctcgcagttgtactaactgatgaggtccttgcatctatttatcttattatgcatttactattacgtgcatttgctagtagatgtggctgcttcatgtgatccttcttgtagatactctcggaacttctatgtcgcagaaagaatgaaacaagcagatattgaattaatagcggttatgagctgtgaacatatgtaggagaggtgttatgtaccattttcagggcacatatttccacctttcctgtctatgtcagtctgaaacttctaacctgcattaggagttatctatgttctctgttttctctgttgtacatgctacattgtatcgaattttgaagagaatagaacattacctagcgtgctgcatacttgtttcacaaagtttttttactactacttgtttacaatatattgatgctgttgaacttaaaaatgctgacggtataattttttgcagacacaaaacccccattcctggatgggcgagttgtattcacaaaacaagcagaacctgtaatgccactgaaggacccaacctccgatatggcaatagttgcacgcaaaggttctgctttggtcagggaaattcgtgaaaaacagagcatgaataagtcacgccaacgcttttgggagctcgctggatctaagcttggaaatattttgggtgttgagaaaacggctgaacaggtagattatttgccataatatatatagtcctaatagtgtttagctggtacgctttacttattttttttttgaaaaatcaggttgatgcagatactgctactgttggtgaccaaggtgagattgattttaaagaggaagcaaaattttcacagcacatgaaggtaaaagcagaagctgttagcgactttgcaaaatcaaaatctctttctcaacagaggcaatatcttccgatatttactgtacgggatgacttgctacaggtttgtaactaaagtttataaactcattttcagtattttatttgcagttttcattttgttttcctatgctagtttacagcatttgttatgtttgaggtatgttgcttttctatagtgtaaattattcaaaaacaaatcggtagaatattttgaatatggttttgatgattgtagtacacctatgcagctatcctcaaggagaaaggtcaagataataattcttgcccttcagaaaattgtaattaatttgaaaatcaagtttcctttggaagatgttgatttttagtttctttcaaaaggatgcagtggtacaagttcttgattaccttgttttgatttcattgagcaggttgtgcgtgaaaatcaagtagttgtggtggttggtgaaactggctctgggaagactacccagctgactcagtatctgcatgaggatggatataccaccaccggcattgttggctgtactcaacctagacgtgtggctgccatgagtgttgctaaaagagttagtgaagaaatggagactgagttgggacataaagttggatatgcaattcgatttgaggacatgactagtcccaacactataataaaggtatattgcttcttgtgttttgatactccttggttgatgacttgtcttttcacttggtagtaggaagtttcctaaaactagaatatgcttaggttagtagcctagtttgggtgcagcattagctattaggttgttagcattatgaattttacatcaaatgaacacaacacacttcatgccagaacaatgttatgccatttaggaaattaaaaaaattgattgatgctttgttgtagtaatggagatctaacatggtttctgcttctgtttgggattttttttgggcagtatatgacagatggagtgctgcttcgggaaaccttgaaagatgctgaccttgacaaatatcggtatgctgatagctctcttaccgttgatagaactaaatacagtatcaaaatactgcttcccaaatgctaaagcacctttccttactttttttagtgttattgtcatggatgaagcacatgagagatcactcaatactgatgttttgtttggcatactgaagaaggttgttgcacgtcgacgagattttaagctaattgtcacatctgcaaccctaaatgcggacaaattctcaaaattttttggagggtaagataacttgctctgtttctttttcctagtaagatttgaatccattttctattttgctaatcttgtaacatttctttatccgcagagtgcctgtcttccatattcctggcaggacatttcctgtaaatatcatgttcagcaaaacaccatgtgaagactatgtggaagcggcagtgaagcaggctatgacaatccacataaccagtggccctggggatatacttatatttatgacagggcaagaggaaattgaggctacctgctatgcgcttgctgagcgcctggagcagctgatatcatcatccaccaagactgtacccaagctctccatcttgcccatctactcgcagttgcctgctgacctgcaggccaaaatctttcagaaggcagaagagggcactcgcaaatgcattgttgctaccaacattgctgagacctcgctcactgtggatggtattttttatgtcattgatactgggtatggaaagatgaaggtgtacaatccacggatgggtatggatgctcttcaggtttttccagttagtcgagcagctgcagatcagcgtgcaggacgtgcaggaagaactggtcctggcacatgctacagactgttcacagaatcagcttaccagaatgagatgctacctaacccagtgcctgagatccaaaggaccaatctggggaatgtggttctgctactgaaatctctgaaagtcgaaaacttgcttgactttgacttcatggacccacccccgcaggagaacatcctcaactccatgtaccagctctgggtgttgggtgccttgaacaatgttggtgctcttacagtaataggttggaagatggttgaattcccgttggacccaactctagcaaagatgcttctcatgggagaacagctggagtgccttgatgaagtactgaccattgtgtcaatgctctcggtgccctcagtcttctttcgtcccaaagatcgagcagaggagagtgatgcagcaagggagaaattttttgttccagaatctgatcatttaactcttctgaatgtctacctgcaatggaagtcgaaccaatatcgtggagactggtgtaatgaccacttcctccatgtcaagggtctccgaaaggctcgagaagtaaggtcacagctattggacatactgaaaaccctgaagatcccactgacatcatgccatatggaatgggatgtggtgagaaaagccatctgctctgcatacttccataatgccgcgaggttgaagggtgtcggggagtatgtgaactgccggaacgggatgccatgccacctccaccccagcagtgcactctacggccttggttacacccctgactatgttgtctaccatgagcttgtcctgacgaccaaagagtacatgcagtgcgtcaccgctgttgacccgcagtggctggcagagttgggccctatgttcttctctgttaaggaaaccgacacctcgctcctcgaccataagaagaggcagaaggaggacaagaccgcgatggaggaggagatggagaagctgaggcaagaacaagccgaggccgcacggcttgagaaggagagggagcgagagaagagagctaagcagcagcagcaagtttctatgccgggcttgaagaaaggctcgacatacttgaggcccaaaaggatgggtctatagatgagaaaacttgatgaaagtattcaatgtactgtgattttgttatatcgagggctcttgtacaaatacagctacgctgactcctgagctattgtagtatgtaccattctgcatgtataacacatggatgaatgtaacgattacgccacatttggcaagtctgcaatgctgtaatgatccttgtcttctgtgttgttgaaacgaagactgttatccttgtttatggttcttttgcgttgttaaaatgaagtatcatgctaatatttgcttacagggatatccacctttcattctgaactttacaggagtaacgtactattgtcaaaacagcgtattccacgggagaaattcaacgcacattatagacctgcttgttttatattggcatggtattcaatggtcttgaaattataatggcacgcagctttaaataggtgaatactaataatatattttaaaaccataaaagttataataccattaaatctaattaaaaattatatcaatagaaaatagacggaaaaaataaagtaatactatctccgtccaaaaaaaattataattctaggttgttagtgttaaggtttgagaagaaaaaccataatgcctcttattaaatagtgtataggtcagaatggaagggaagtaatgaatggaatcattagtactctattggataattatttggggataaatttaaatcctaaaaatacaattattatgggatagatgtatagtaattttttttattaaaagagacagatgaaaaatacgaatattagaattccaaaattgaaatgacattagtactctattggataattatttggggacatttaaatcatagaaatacaattattatgcgatagatgtagtggaattttgttaaaagagactgagatgaaaaatacgaatattagaattccaaaactgaaataaaattgaaaagcaaaatttataaatgtggctgctgggattcgagcccaggtctccacggccacaacgtggaattctcaccactaaactacagccactttgttgagaaacgagcatcatcagcaacacatatctactcagccactttgttgagaaaagaacatcatcagcaacccatatctactccaattgatttgctgatccaattgagccactaaactacggccactttgttgagaaaagaacatcaacacatatctactctaattgatttgctgatcatcagcaacacatatctactctaattgatttgctgatccaattgagccgtgcttgaagggatctgcccgctgagggtttcaactggaacagcatcacaaggtcacaacatcaacacacggtaacgagtagactgctgagagcaagaggcgactaccagcaatagcaaacatctacactcatcagtaactataatattattatatactaacagtctaacatcacattacatacaactttttttttattttcctttttttacagaattgcatacgtggaacacctacaacatacagggtttcacagaaccgacaaaatcggggcgaagtccacgcaaccgataactccacttcagtgttcagctgacatttttgttttctggttagacaacacaaactagatgaaccaacgcttcattttactcggcttatgttatgatgttgtcttgaggcagaataaataacacagcactcgcgcacaattttataagccatgcgagcatgttgcttcagagtctgatggggggaaagaaaaaaaggaagaaacaatggatattttagagccgtgctattgacagaagctgatctctccttcctccacgtcgatctccgtagatggtgatacactgtcctccatttcatgttcgacctcttcctcaagatccttcttcatgaaaaggccaagcctctctagcggactccctaagccaggtggtagatcgatcccgtcgacaaaatcaacaataagtttgccagggggattcagctcccactttttgcttaagttttccaggtccttaaggaagtcactgttgtcaatatcaacagtcttcttcatctgcgtaggagaagagattgagtaatcaccgtgcaacattaagcatacaaactagttggtcagaaaatggcagcatgtaataccatgtgtagtgccaggcgtgctgctcgtctttcctgctccctcttcatcctcatttcttcgtctagctttaattgtgcagcagcttcagccgccttcacctgggcctcaattcttgctttctctgcattatgggtaaattgaaaagaaagccatgcaactgaaatcatgcgtgccaatacaaaataaaagtataacctaagaataatacatacaatatatagttaccactatagttatgagcattcgttcccattttaaaggaaacccattcccccatcagagaaaacatgccaccttttacacttcaaagtaaatttagactttccaacaaaataaagttgtttttagactttccaacaatgtgataatgtggaatatcatggacatgcttttcataacaaaattactacagttttgatatattgaaacaagattacgtttggccaaaatagatatagatccgatgtgaccaggagtattcacagcgtgaaagtatatgaattgactcaaaaagttactatgaagcagtgtattgaattagccaacctgtggtctatgtggggacaactggtaaaaagattactcttttttcttattctatatatccaaatcttaagtttatttgcttcaaggaacaaaaaaatggtcggaagcctgatcgacttgttaaaaaacgactcttgatgatgccttgctataaaatttctacctactaacaaacttgtctatgtgggacactgtactgttcaaacaattctctagcatgtaccggggttatgttccccaaagtctctcgacggactgttttgatcccaaagtttctcgaagcctgagatgtcaatcaagtttcaccgtaatgtgttctaaaagttctttcacaaagagcagccatcccatattaagtccagatgagaactctatgcgaatataaaatatcaaaatgcttgatgaacttaaagaaaaaatgtattgccaatcaaacagctccatgccatctgctatcaaaggctaagcaaattcttaccttcttgctgccttttttccagcctctccttttctaactgcaatttcgcagggtctattttcttcccctaggagattaaaaaagcacatcagcaagagctacacagacgtagactagaacttgtcctatgcgaaggaatagcctaattgaaatctacaaatttcagtacacatttcagaaataatacatgatccagaagtgctttctgctgcgccttgacaattgtaccagcaaaacgactcttgagcattgctgcacgaagagccttgcttggtgataaaggttcttcaggcaaatattcctcttctgaaaattcacatcataagatgcaatatattagcaaaggaacatatggaaagaatagatgataaagttactaccctctgttctcaaatggttgtcatttaggacatcggcagtctccaatgcacatgttttatcattactttctcaagttatatatttactagcaaaatgaccgtgcattgcaacgggtgtagggctgtacacaattgtaattgggaatagatagcattaagcgccagaagaatgacactatagcattgaagaaatccaatgataaaaaagaaaatccaaatggaactcatgttttggtacgatcacagaggaaatcctacttgtagatgtgctattctcaaggtatgagtattcagatcaaactatgtattcttgggatctttatccattctttttcatcgtcctacgaaaagaagggtgtggatcagaaacatttacgtaatgtaactaaaccagacttgagaactactcacataaacaatgaatcaatccagaaatttgttccacttcttctcgatgcttatctgatggagaaaaattaagggatcatgttcagcttagctaagtgaatcacgctctgtgctttgcctctgcttgtggcagctctgcttctcgcagcataggaagagggagatggacgaaaggaaaggatggatcaggaggggagcaccatgggcacacggaagaggggtgcatgtggccaaggtgaggcagggtcatgcgtgggacgttggacaacggatgtgagtgggtctcggatgcagacaacggaccacagtgtgcacaggactcagatgaaaaacaaacaatgatgagacgaccgaaaaatcacgtgcaggaaatcgacagaattgcgccatggccgaaaactcaaggatgacaaatggaatcagtttgtatttttatgatagtatgggaacaatatttaaaatataaccatatgacagtttttcctcacaaatctactaatatgatttttaaatcctggtattttttcatttattaatgatttaagatttttgaggtttgactgtgtttgcaatgaatctaggacatcatccttttgagaacagagatactagtatgcaaattaacatgcacaaatagatggataaatagatagcatgtccaaccttgtctggaagaagcaagaggtgaagtagaagcatcatcgcaaggccgcaattcatttcctaagataataattgagtgctttagtaaaataaaacagtatgggataaaattacgtggaaatcataaacataccagttgattcagatctgtcctcacttgattgtatccttggtgtcttagcattgtcctaaaaataaaagacaagacaagagggggatcacacaattgtttagctaatgataccaagactcagataagaatactcaagtataaacaaaggagctcgtgcccaaaaccttggtgcaagggagagattggttaattgtgccgtctcttctgccaactgcttgcaaaggcgtgtctgaattgaaaagcattggtaatggctgtcaaatacaatcaacaatggaaagattgtatgcatagagtttattctattcacacctttggaagaggtcagctcagagcctcgcacagaaaatttaatttttacctgcaaagagagcagtactttgatcaaagtcccaagaagaaaaatcactgaatgagggtacatgactgtgatcatactttggaggataatgcagttgccagtgtcttgctcacagctgaatttgtgcctgcagtcacccccttaggtagcacaggttttggggtaacagcaggctgagcctttaataccttcagtgatggctgctcttgtaccaaatttctgtctttccatttcctttccaataatttccattccgaatcaaatattttgttcaattgatcagctattccgtggacatcatttcctggaggattatacttcatcgcattcgagaatgttagcctcacatctgctgcaaactcataagggttggaatattgcttgcttgtgagtttccttttaacagtacccaagtccatcggattgcgaataacatcaaagtaatcaggaattccatataccactggatcaactggtgtattaaaaatccatccacttttgtgatccatgagcttcttcagaatacttccacactgccttgacttgctagtattcatcggatcaaccttattcttagaggttggctggtgaccacatgtatagactgacgtgaccccatcttttttggagagtttgcttccctcaacctcagagtctgtaccagagtcttctgattcactgcttatataaactgctcttctcttcttacaagcttgtgtggtcatagtgtttggtttgaataaatactttttggtcttgacaaagaaaaataattttagcttcttttcagggccagaagattcagatagaggcaagctgtttaacatgccagaataaaatagtaaacacaaacaggaacagaacatagaaataatgagaattgcttatgtacaattaattaacaggaggtgttcaattgtacataattattcgagagtattattcaaacaaaattgcatagaatctggcaaaaacattaaacttctcatacatgcaaccagatatgacttgcttattaattttttttcacgtgtcaatattcaccacacatccgctcctgcctaacagacatcggacaccgatacctctcaccatatctcgcaggcccacagcgctgggtaagtgtcaatgttggctgtgccaaggccattcgatgataacaatgcatgggccaagacgttataggaagcagttgatctgcctgcatcatcagcgcagaggcaagggatgcagcgaaactgggcaaaccaacagcgtgctggcggttctggtcttggtgggggacaacaccagatcaactcaactcttttttaagacacgtcatggaactgcctaaaatcaaaaacccaagtacagaggcctctagtggtcgccggtggcgaggtacgccatcatggttgacagatttggtggtggaattgttgtacgtgagcaggagggaagtagatatagaagattggaacgagatatgttcggtggggaaggagtaactacactatacttcgctcctttgttctttttttttttactttattcgagtaattagggtattgtaataaggaataataatatattgacatgtggttagaggagtgcatggcaggcgggcagcaagggatcctttgtgaatgaaactcatggtgtgaactcaatattgggcataaatgtaattcttgatcagttgaggaatcctgtttttagctttgttaagtctagcaaaggctaccgaaaaatactatcttcaactcacaaaaaggtttgctgatggttcacctacaggcgcaggcagacaaccaaggattgccggctggcagatcaaccagtgcttttaattgaaacaacacagctcgaaactaagggtaggtttatatcttattatcagttcgcatcacatatccagcacaaattggcccagcaatgccatagctcaaagaaactaagcacaacatttggctttgtagcctagcatgcatcaactgtcacacagaagtgccttatgtccttcaagctgggcaagctttcctgggcagttataggcaagctttcccacagaagtaagatttttattgtcgttagcaaactgctgtccttgctaagctaggataagatttctcttgcctaggatccaaacataccctaaaagatgtatgcttgaacttagttctagtaccacaaactagcacatcatgggcagatatagatacagcaagataagaggtgtcatgtggcatgcatgaaccgatgacaaagaactaagcacctattatttttctcgtgcaatgaaaatattgcatgctaattctaaaattcatttttttcagaaaaagaaaaaataggaacaggaacaggaacaggaacaatcaagtaaagctatgagagaaagcaatctctttttttcttgctcagcaccactccctccaccccaatatatagggtgtacctgtattttactcaaatcccacaatataagacggcatctcctcgacagccgtttattcgcatgcaagcatttaagttttgctcgtttccattcatatgcatgcaagcattcaagacatcacctcctcggcttccgtttacaagcatgcattattgctgattagtttgcttagggcacccacaatggttatctataggctctctataagagatccatgtcagcatattttcctacttagaagagattaaatgaagagagagagcaaagctatctactaacctggagatagtctatagagaaaaacgaggcaatgtattagagagctatagatacccatgtagacatactattgagatggtttactattattctagtctattgctgagatgtacatgttttatagatagcaccttactttaccattgcgggtgctcttagagcaagtttaatagtatagccaactactagctccaaatcatctatagtcaatttaatagccaattcgtacaatagttacatactacactattaatatatggtcctacttgtcatacacactgcgtcttggagtccgtgctacagctggctacaaatctgtagctcgctgctcttctctctcctcttttatctccttaaaatatgtttatagctggcttatagcctgctattgtacctgctcttagttaaaaggcctctctctcccagcaatacgtgggcgtggcctgctgggatacacactgtgaagatcaaggtccacggatgaagcaaaacttcacgtatcggggcgaacggaacagttgaaaatccttggtctgtgcgtctagagcaggtacgccctatataatgggatggagggagtatatgcttacggtgtaaacttgatttattctatggtaggtaggtaactaccaagataccttcatttccatttttatggtgatacatgtgtaataatatggaggctttacaaaaaacatggaggcacttaaatgtggacagtaacagaagcaattaatggctataactcacaacaaaaagatcagtttccacttttggtttctatttttgatgcaccaacaaccgttagctagggtgagcatccatacatacagaattaatctcgattaacctagcagctagagagcagagcagagagacacacatcagcataacactagcaaatatcgtgagttcgcgaccaaaccctagaagccccaatttatccccccctaaccctacaagtcccgattcccctttggaagtctgtgggcgaggagggattcgaacccccgacaccgtggtctcgtagccacgtgctctaatcctctgagctacaggcccgccggaaatctccaccggatctctacccgtggaagaggaagctcgataagcaatccccataaactcacctacgcagtaccaatcgcaataatcccaaccccaatcgacgaaaccgtttcatgataaggcgacctgttcgctcgaaaccctagaaattgaatcagacccccccccccccaaccccactccacgaaaccaccaccacaccgaaattgcctagcggaacgaggacaaggaaacgagtagcgaaccaacctgatggcagcctcagcgccaccccgggatacggcggccgggctgtacggacccccaccctccccgcgcaaaatccctctcgcttcggggttaggaggcagatcgagacggaggagagacctcaggacctcaagccctacctccgccgcgcgccgccgccgccgccgcagccgcgcttcccccttctcttcgccggcgagagaggcggtggtggtggtggggaaggggaaaaaaaaaagaggagtgcgtggttgtggtggctagggttttaacgcgacggggtcggaactcggaaaaagaaaaaaggaagcccttgacccggtccggctcgaaccgtctggttggctggctccgcggggtgctcgggacgctgacgcgcggggcccacatggggggttgcgggggagaaggtgtggggcccacctggccaaagggagggtggggggcgcactcgataagcttttctctctctctttctttctttcttccttcccctcccgaagattttgctcgctttctccaacctctcctccgctccgaagcggaggtcggcggcggtggcggcggcggcggcgcgtttccccggcgagtaaggtgaccggctgctcctcccgcacttcttacgcctcgttccgtcgctacagtagcggaggagggcctgcaatctcagatcaggggtacctgtaacccgtttcggttcttggtgggtgggttggtggtggtggttcttgatccatccatccagcggttttggtgcatctgtgcgagttccatggtctaggttttttttttcttttagcatttcgtagtacgtggcccgtggtagatggcttgggggagtgcaatgaaatgctgtgggaaattagcgtgcgtttagcacatagcatctgttcttagtactgttttttttctggatatgttgtggccttgagggtatagattgttgttaatttcgatcactgaatgtgtggcagcgattaatagagtgccatgggataaactttcatggaagtagagtggttcctttttttttctcttttcattgtgctggagcatcatgatggggctaagatcggatgtttttctggttgtggttatgcttgaatgtgcgggtcttctcttggtttttcaa

SEQ ID NO: 19143 - DNA, 1677 bp, Oryza sativa
ttttttacacactgttttattaagtattatccacacaagttacaactgccctttttctttttttccttttttgtttaacaatggaccaagcatcatagaacaattaccttattgtccctcttatgttttccaggagaaatggaccttgcatctcaaggtgtggtaacacaacaacaaaaaccaagtggacggagaccggttggaagctcacaaatctggacggtatgtagctgcttctccctttgttttcacttggccatcgtgaacaaaattacatgcagacactcaattttccacagcgatatggtgttttgcttcccagccagcagacacggaagctaaaagaatgggttctaactgacgaacagcaacaactagttaatgctagtggtcttggacatcttgccctcaccacaggatttactattgatcgttctttgcttacagccttttgtgagagatggaacaatgaaacaaatactgcacatttcatgggatttgaaatggccccatcactccgtgatgtttcatatattcttggaattccagtgactggtcatgtggtgactgctgagccaattggtgatgaagctgtgaggcggatgtgtttgcatttcttaggagagagccctggaaatgaagagcaactgtgtggcttaatcagattgacatggttgtacaggaaatttcatcaattgccagaaaatccaactatcaacgagattgcttacagcacccgggcataccttctttaccttgttggctccaccttatttcctgacacgatgaggggatttgtatcaccaagatatttacctcttctggctgattttagaaagatacgtgaatatgcctggggatctgcagcccttgctcatttgtacagaggactatctgttgctgtaacaccgaatgctactacccagtttctcggcagtgcaactttgctcatggtactgttcttgtttgaataaatttgaatgattgtcgatgatatttggtatctttgttaatgagatttattttgttctctcaaggcttggatttatgaatatcttccattaactcaaccccaacaaaagaatcagaacaccttgctgccccgggcctgtcgatggaactttggaggagcaacgcgtggacagagaaagaaagtcatggaatggagaaaagttttcgatgagcttcaattttctgatgcaagtgcaagtctacctattttatagatttataacaaagattttaactgctgttgtgttattttatattaattaattatattttcaggtcaactggaatccttacaaggacatgaatcctgcaattattccagaatattgcattgcagcagataacatctgctattctcggacatggctaatcagctttaacataaaagaggtgtatgtacctgatcggttttttaggcagtttgggagggaacaaggtcgcctccatggggtgcccatgtgggcaagaagaacttggagcaagtggaaggactggagggttgagtatgctcgtgaaatcgaggagttccatcaattggttggctgtcgtttcactcctgcagaaaccaatatcaactccctcccaattgagtctataactaaacaagatgctgcaggatgtagtcggagcacatctcagaacttctcttcaatggtaagctacaaa

SEQ ID NO: 19144 - DNA, 1149 bp, Oryza sativa
  unsure (1)..(1149): unsure at all n locations
tctggaaaagaattgacatacatacctagcaatgcagcgaaacatatgatagctctttggacagacccgacgaaagagaaatctttcattctgaggtacaacaggaactggaacccacttgatgcagacaaaaataatcattgaatgaatggctggcattgtggcgaggaattgaccaaagattccaggaactcccctcgcaagttcgttataaagtaatccaattccagggactctgactgtacccagattacaacctagctccatcaacaaatccattgaaagtttttgcttaacctcagtttcgtacttcaacttggttccgtagttccatatgtacattatcaaatacagtacagcagcaaataccaaaagaacccaactcccatctgctacactgcccaatactgaagaaaagaaaattaactccagccccagggagagggtgagaaaacacagaactacaatgatgttgatctgccatatcaaaagcattatgatggtcaccaagactgtagtcatcatcatgaccccaagttcagctatgcctgcaatagttaccaggcattagaaagattatgcggtagcaactgtggcactggtttcagtagaaaacaggttacttagcagccagctctccatgttaaaaatcatttgttgacaatcttaagacagtgttgttaatataaaaggaaaaatcatacaaataacaattcagtgcttaatgatatagggcatcactttctagttagaaaattaaaaaaaatgatgaatttgctgtatattttatttttgtatggagcaattcacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagatnnnnnnnnnnnnnnnnnnnnnnnnnnnnnnnnnnn

SEQ ID NO: 19145 - DNA, 886 bp, Oryza sativa
tgatatagggcatccctttctagttagaaaattaaaaaaattgatgaatttgctgtatattttattttttgtatgaagcaatccacgtaccatatgcatttccaatctcattgatgctcccaaacattgtaacaaatgcaaggcaagaaaccagcaaaaaccagttcatcattgggatatatatttgacccatgaagcttctagaagtgtgaataatcttgaggcggggaaaacagccgagagctgtggcctgctttattgttgagaatatagcagttgtcattgtgcgactagcaattatggctgctagaattgctatgaataccactggccaaaatgcctgatctgcgacacggaatgaaactatttagaatttaggggataatagattccatttcattttgtgtgaaaacaatccatagcaatcagaaaatcagatttaaaagaggtacatagatgaaccagtttatcttactcgggatagataaaaagaagacctgctgattttctgttagattttccataagaaatgcagcttgccctaggtaacccagtagcaggcatggaagaacaagaaacacaaaggtaagctgcaacacattagacatagtaagtacaaggatatgaagtgcaacattgactcttaaaacaacagaaaggactacctgaacagatttgacagagaaatagcataaatcagcaaacattgcctcagatcctgtaagaagacaaacttgttaacatctttactgttcaagtcaaaagaacagcactgctcttttacataagctataaaataaaaggacagcagcttcaataggtttagttatgacctactacgaaataaaagggcaaagacagggtatatcaagtctatatagctcga

SEQ ID NO: 19146 - DNA, 669 bp, Oryza sativa
atgcacgaacagagagcctggacgtttcaggtatctgtaccctcccaagctacttactcaaaaccttctctcacctagacatctctgaaagcaacccctgcctgacgctgccagtttgtttgttggttggttgattggtttcttcctgcaggctgacacttacggcctctgcgtcatcgcgcacatgatgctacatgggacgcagatgagcatccagaagacgcccaggcccgatggaagctacatgtaccagcccacatcgccgttcaaaaggtgctttgatgccattgcctatacacctctttgataatttcctctatcccaaaatatagctactatgagatatttttcagtactatgaatctgaacaggtttagaaaatatctcatcctatgctagttagttatattttaagataaaggtagtagtaattaccatgattcgcagtagcgtaaataaatcagagattagattagatggcatatgtaacaggagctggttgctgccattttgccccttgacaggtactggaacgtggagctgtggaaaaacctcttcttcacgctggtcaacgcgacctccaacggcagcgacgcggccgtgctccggagcctccggatgtccttcaggagtacctgtgcagcaacccgcagctcgtcggcaagctga

SEQ ID NO: 19147 - DNA, 698 bp, Oryza sativa
  unsure (1)..(698): unsure at all n locations
nnnnnnnnnnnnnnnnnnnnnnnnnnnnnnnnnnnnnnacaattagatgtatgttttttccttgttcaagttccttatgtatattatgaaaattgcatcatcattaggaaattgtattcatttaacttttttcaagactgccaaacccatgtgcagcaagacctgcaaaaaattggatggtcaagaattatccacttagtttttcagtaaatatagttattttgtaataatttttcatatctttaacttgtagagaatgtcttgtattctgatttcttactatttttattgggtgcagactcgtaaagatggcagtctgatgacccttgctcagagcaagaagttatcacagatgactgctgataatgctcaatgggaggatagacagttgttgagatctggagctgtcagaggaacagaggtgcagacagaatttgatgatgaggacgaaaggaaagtaatacttcttgttcatggtacgttcttcgaatatcgcagcctcttatcgatgttatagttgtcactaaacaagctacgaaaatgtttggaaagcatctatctatttctcatgtaatggtgtatatgcaattttacttatgaaaataatagacactatttatgttggtaaggtaagctcgcagttgtactaactgatgaggtccctgcatctatttatcttattatgcatttactattac

SEQ ID NO: 19148 - DNA, 638 bp, Oryza sativa
ctctatgcatttaatagggaatgacagggatgtcttttttatcaggcggagaatggtgctgggccccacctgggggcgctgaaccatcttgcttccggttgaaggcacggaggcggtctgatccaggataggtggatccccctcccatggaggagtaggtatggacggtgcatgtggtatccccttgaactataaaaggaggaccgtcaccaccgaaaaaggggatgactctcagataacttgagctcgaaaggaagaacagttgggtttcccttaaagctcaaaacctcttgtaaaagttaaccacaattctacacacaggagtagggtgttacgctcgatagcggcccgaacctgtataatctcctgtctttcacagaggctaggtagtgatctagcagctagactgcaagcggaagtacgctcttgatcatcgtgccatcttccccggccgaactaataaaggggggtctcacgaccgcccgctagagaggatctctcctcgacaatggccaaaacatatttttgcaggcggccataacctccgcctgcatccaaacgccggcggaaatcaatgatttttgcaggcagctaaatctacccgcatgcgaaaatattttcagcgtaaaaaaaattgg

SEQ ID NO: 19149 - DNA, 404 bp, Oryza sativa
ggtggggtcgaaccagaggtggaactgctgctctttgccgccggtgccattggcgaagacgttggtgtgcagcgtgtacggctgcccggtgacgttgccgaggaactccaggtccacctcatcgtggatatcccactccccttccgacatgaactgcatggaatccaccgtacgtgagctcgaacacgagccaagaaaaaaaaaagatccgatcacacaaagaatgtgtcagtgcgagtgctggcttacgtagcaggtggtgaccgtgccggcggagttgttggcgacgagcttgatctgcaggtcgacgcgcgcgaacaggtacgtgttcttggacctccacccggagccgaaggtgtggtcgagcgacagcgccatcacctgcccgtccggcgagacgctcc

SEQ ID NO: 19150 - DNA, 18812 bp, Oryza sativa
  unsure (1)..(18812): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccggcagggttttttctggcctactgcagtgtccgacgccgacaaaattgtgcgcacatgtgaaggttgccaatttttcgccagacaaattcatctaccagctcaagcgttgcaaacaatcccgctgtcttggccgtttgcggtttgggggctcgacatggttggcccgtttaaaaaggcagtcggcggttacacgcatctctttgtggccattgataaattttccaagtggattgaagctaaaccggttgtcacaatcacagcagataatgctcgcgatttcttcatcaacattgtgcacagattcggagtacccaatcggatcatcactgataatggcacacaattcaccggcggagttttcaaagacttttgtgaagactttggaatcaagatttgctatgcctcagtagcacacccaatgagcaatggacaggtggagagggccaacggcatgatacttcaggggattaaagctcgagtttttgaccggcttaaaccctatgccggcaaatgggtgtcacagttaccatcagtactttggtctttgcgtactacgcccagtcgggccacaggccagtcaccttttttccttgtctacggggcagaagcaatgttgccgagtgaagtcgagttcgaatctttgcgcttccgtaatttccgagaagaacgctatgaagaagaccgagtggacgacttgcaccgactggaagaggtccgcgaagcagctttgattcagtcagctcggtacttacaagggttgcgacgttatcataatcgcaatgttcgatctcgtgcctttctagtcggcgacctggttttacggaaaattcaaaccacacgagatcggcacaagttatctcctctatgggaagggccatttattatctctgaagttacccggccaggttcatatcgacttaagcgcgaagacggcactctcgtcgacaattcttggaacattgaacatcttcgtcgtttctacgcttaactttatcattgtatttccctattttgactgtcaaacatcaagttttctccttgaagttgtcagtcgggggctatcatcataataatggagtgtgattttttatcaattcagtttgcttacttggtttatcattgccttgtttggtttttctacttagtttgcgaggactgaaagtttttaatagcttctttgggttttaggctcaacaaagcttagcaaaaacttttaagaaatcaaaaacttcgcaagaatcatcaagcacagcataaatacaccagtatcgtacaaattgagcctccatgtattacattcaaactcagtcagaatcagtcctttcatcatcagagtcttcattactcggttggaggtcgttgttgcgaaattgctctacaacatcgctcgcaattttgtcagccgcattttgcgcactgctgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatatacttccggagcaacactcagcttgtcaaatatttcggttgcgtcgaatgcactcggaccaccattattgaggaacatggcttggataattggtgcagcggcattggcgacgttatcccttgctccttcaagcctcttgatcttaccaaccaagacgtcaaattgggcttgcgattttattttgcgatctacaaaacacatttatgatgaggatttattgcattataaagagagaagctcagattgtctgctagcggtaccttcaacttcctttaaggctgagtccctttgcgcagccagttctgtcttgtctctctccagggcttcaatttgcttcgccatctgttccatcctggcggcttgcgctgtttgaaattcagatggttgaggatgcaattatgacagcataaatcaatggaacagatctggatgattaccttttgatgaaccactcagctcgaagttggagtcctggagctgtgcaattctttcccttaattccttctccgttttcttggcatactccttggcctcgtgtagctgttccctaacggattcaagagttcccaaatgtggaaccagcttttctaaggttgtagtcttggcctcattacgaagatggattctctgcacggtggttcatggattagtttgctaacaagaaaacaaagttattaaaggcagtcacccggaggacttacatttacaatacgagtggcttctccgagcgctttcttcagctggcacacttcttcatcttctttttgacggtttatgactataccggcggcttgtgagttctcgtcccaccatttgatcaagataggaggacgagagtcgtcggttgcctttatgcgagggatttcctctccgtcatcacctgatggtcctgatgcgtttccaagacattagacggatatactgaggttatttaaatcgccgttgtttgagaagacaactaacctgaagatgtacttagctgagcgtgaggtgatctttgttctttacctgaagacccagctatcgagtcgttaccagcctctggtccttgcgaagtcgtcgtctgcgcttctacttcggggatctcttgatcagggcctgcgtccgactggtttccagtcgggggctcttgagttgttgccgtttcagttgttgccgactggtttccagtcggcggcaggtcactcggattggtcctatcgcccgaagtatgggcgccagtcggctggccttcagcagtcggctggttttcagcagtcggctcggggtccttggatatattttgctctgtcatggcaggatcggggtcttttccagatggatctatatcagatggtttcctgcagagtgttgtttcaatattcagcattattttcatcggaaaacattccgaagcggaatcataccgagaggtctgatacctggaagatgttctgatctttggcattgcacggccagccagttttttcctgggcatggtacgctttgggggtttattaggcgagcccttatccccagatttatcatcgtcgccttcatcgtcatcaagtaccagcttcctcttgcgaggacctgtttgaccagtcaatttggaggtctgaggttgcggatctggtctgatcgttggccctccacctccctgagcggtgtgttggcgaggagaccggcgctgagtgactggtggatctgacttcatcaatgcatattcctgaccaagatgcctccatagttagtcaactcagcatgaagataaaattatgttctgatcacggtttgagggtttccgatgcatacctgtggaggcggattgaatgcattatatggcacaactggcagttggtgagagtagttgactacaattgcatttgagaagattttatacatcctctccttcatgattttgaaatccagggaatctggttcttcacggttgggatcatgtttgccgtcgaactcgaatgctgtgcgggatctttccttgattggcgccagtcggcattttatgaagtgccgagtgatttgctctccctgtaagccttgttctttaagatttaacatacgatccaacaactccaaggcttgtactgcttcatctccgattggaagagagttccaagtatcttggtacactggaggaagacaagagtacccgggaagagcaggctcgggattctgaacatagaaccagttcgcatgccatcctttgttcgaagtcttgaagggcatcgagaaatatttttggctcagagttcctcttagttggaatcctgcccccccgactacacaaggtttgttcttgtttggttggggcttgaggaagaagatccggcggaatagggcaaagtgaggtttgatccccaaaaaggcttcacaagcatggacgaaattggcgatatgcactatggaattcgggtttaggtgatgcaagctgattccatagaaattcaagatcccacggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacgtcggatgacgcccattggccttcgaagctttctctctcttccgccattggtttcgctcaaatgtgctgatttgattcgagggatggcttgggagaggtgagggattgaggcggtggatcacgggaaggattttgatgcacttttcgaaggtggatttggccggagttgtgaaccctagttcgccggcgcaactttgcactgtagcagggagtggggaaaatggcgagagttccggcggggaagacgaagcgtcgcttggatatcggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcgagcttttttaggctacaaaagctgtttgggattaactaggaatgacttgtttttattatagtcatttccttggcgtcttatatgcctgtttttatggtaaatagtcatggcctaggctattcgacttatttattaccataatctttataatacttgatgggtaatctttggagtttttatattcggatgcctgtcgagtgtgttcattcgtgaaccttttagagtgtaaaccactcagatttcttttattgtggctaaaaagcagtcggctagcatgcctatttaggcgccgcgtacgcttttgtcatataatgcacgattgtgttattattttgtctttcaactatatgtttagtttgttaactaatcacatagttgggggctacacctaattaggtgcatctattcgatgcaccatattctttatcttttcgccctttacagtcttcgtcttcgctactcggcaggccttggcatgaataatttgaagcactcggattactatctttgagaaggctatgatggtcgactgcaaaggactcgggggctactgtggagattatgggtatcccatatctacacggcgatggtatttggattgggtaccggatacttaatgtagatagaatatcttatctgtatttcgggtttgtttcttaacttgtgtatcaaggaaacaccctgagatttagtcggttacgactgtattttacttgtatcttcatattccgttaagaatatagattatcttttgtaatccggactccttcccatatataaggggggtcctggcgcctctaggggcatatgttgattttctccaaatcatacaatcaataatacactcggcggattcatccccggacaggagtagggtattacttcttttataagaaggcctgaacctgtataaatcctttgtctccaaacccatacacttttctagcttgatagccacccccttttattattgccgaaatctagtttcgacactttgatatggagattagaaagcaactgatttgtaacaatagtctggaactaatgaagtgtgtagagagaagaggacaagaggatggtgcaaaagggacaaaatgaattgagtaagcctttgcccaattccaaaggtgagcgtgaataaccctagtacaaaagcgattttcgtatgcggtcaaaagcgattttcgtgtgtagatcttccaaccgtctgtaaggaagtgtccgtaaaaatcacgcggaaatcagatttttcacgtgcgggatggttatgtcgaccgcacgcaaaaataaaaaacccaaaaagaaaactaaccctaaagctgccgctgccgccctccttgcggtcgccgtctccgtcgtcgtagccggattcgccgcctccccaccgtccgagccggccggccgcccaccgccaccgccagatccgagcgaggggctgccgcctccgccggatccgagcgggggcggttgtccgccgctgcgcgcacgccgccgagccacgtggtgccgcctgctgcgcccgccgccgagccgcgcgcgggagtgagagagaggtgagagaggatagagaggtgaaagagtgagatagaatagaaagaataagtatgaggatgggtggataaggataaaattttgaagtgtcgaggagggaaagaggaggaagaatagacttgtaggcaggtctttaagagatccgtacgtgaaaataagctttcgcgtgcggtcctcttaagggtcagcacgtgaaaatgaaatgccgatttttacgtgcggacgtgaaaatggtatgtctatgatctaaatagctcattgtccagaaaaatcatttctttactggtggcagtacgcagctccaagcctccaacgtccaaatgcataggtaatcgatcgatctccttcccttaaaaaaaaataattgatcgatctcccaagtccaagcatggtcggcgtgagcttagcgctggtatacgtgaaacactgaactcctacatcgtaagctagaatgactaacacgtcggctgggttactctgcttcatctctaccacacatacgtggcatgcgaccatgctccatttttgtgtgcaacacgttttatttggctcgacgtacttctggtgtcggacggaccacgcgcgcggccgaattatctacaacggtgtcgcagggtcgtagccctgggaacggccgtccaccctctgttaccttttcagccgcacccgttccctcagctagacgcgcggcacttcgctgggacacgttcctcaccatctttttactgaggcaccgagccgggagacacattgcgagggtgagtgtcccttggccaccactcctacacctagagttcctcttccaccccttgcctcgtcgtcgtcctcacgactcgtgagagggcggcggcgctaggaccggcggtggaggtgacgccgggggttgcggcgtgccagaactgggagagagaggcggtgaagaggaggttcgtcggcgacggcgacgatgagctctgtccgcgacggctggaggaagagaggggagcgggaggagggcaactgggtgctgccctcgccggcgagccgccccgttgctgcccgaggccagatctagcaagcccagactggatccggccaccccgccgccactcctctcgcgtggtcgctgcttgccgccactgctcgatgtcgggggaaagggaggcaccgctgccactccgctgcactgctcgatgccaccgccgtcattcgtcgcgccgctcaacgccgcgcgccgtccgccgccgcgacctgcgaccaccctgtgcgccactcgctgtgtggagggagagagagaggcaacgacgagtggaaggagagttgcggagtcggtggcgggcgcgacggaggcggcgacaggtagagggagaggggcggagtcgccagagagggagaggggcagagttggcagagagagagaggggcgagcggcgatctggatgacgtggctggggtggatgattttctcgagggcatcggtgggctggtgggaggggtatggaagtaatttgtcatctatggtctttttggctgtgacacctgtcttggaccctagattttaaagagtctatccaaagacactctccattggaagataattatcgtagagagtgctctcaggtagtgagggtatttaaaaatggcttatattatagatgcccttaatattcccaacaaacatacaaacgttactacgtacgtacactgctttcatactctcaacggtcacacgtcacgacctgagaaaggatcgatctggcagtaaaagtacgaaaccgacggatgaaattgtcaacgcgaaggctagcactgtcaatgcacagtcgcacacaacaacaacatatcgacactgggtgtgtttaggctgtcaatgcacagtcgcacacaacaacaacatatcgacactgggtgtgtttaggctgtgtttagttcacaccaaaattaaaagtttagttgaaattggaataatgtgatggaaaagtttaaagtttgtgtgtgtaggaaagttttgatgtgatggaaaagttggaagtttgaagaactattttggaactaaacacggcattagttccacgctaaaattgaaagtttgaagaaaaaaattgaaagtttagggctgtgtttagtttctgaaattgaggagaagtttggggaaagttggtagtttggaaaaaaagttgagagcttatgtgagtaggaaagttttggatgtgatgtgatttaatggaaagttgggagtttgggggaagtttagtgtgaacttatgtatgtagaaaagttttgatgtgatggaaaagttaaaagtttgaagaaaaaagttagtaactagacacggtgactgttcgaagccacataaacatagtagtactagtacgtactctctctgtctcaaaatataagtattttttagacttcgacacagtcttcgaaatgttagtttgaccaacaatatctttaaaaataaaatattttaaataaaaatgattatatagtatgatatttttttaatgataaatctagtaacatcaattttacattattgatctcttttacttttttaaagttaaaaatatttgactttatactatgctaaaaatgtttatattttaaaacagagggagtaccaaacttattgaggaaaaaaatgtttcccaaattaaagcctcggtatatatcgattctgcccccgtctttacatacacgcatgcttgttacgacaacaaattggcaacagcctattttgacgctaaaacagcctcactggcaactagcaaccatggccgttaataggagcaggccggaatgactccggtaataggttataggtaggcaggtggagtagtggtgttttgtactccctgggtaaaaaaaaaaaaataaatgatgtgatatattctagtacaataaatctgaacaaatatatttagattcgttgtaatataatatatcatatctagtatagattggttttttatatgatggagtacacgggttgtcactaaaggaataaaaacagcggccgtggggctgtcgcacagtcgcaggagagactgtactagtgctcgcgagcagattgagcggggagggaggccgcagaggtgggcaccgtgtaggcggcggcggcggagtaacggctgggcttatgtcagaaaagcccagcccagccaggaagcaaatttgcaaaaggaataagtctattttgtcttcctcatctgttgctcttggttgaacttgaattctatctcaaaaccacaaaaccgggtataacacctccactaattttaaaaaccggtccaaattgactccttaagtggtttcgaaagcggttttggtgacatagcaagttgacttggtctaagtgtgttgacgtggcagcccattatcgaaagagttaaatatagaagtgggtagccccatatttcagcgacacgcatgtctgatgtttctcctcccttctctttatttcccctgcattttctgactccaatggcgatggtgagctcttccatcaatttgcccctatcccatgtctccaaaaacgacaattcgctggagtgaagcttgcccagcggaaagcaatacacggaaggaggaggacttgccccatactacgcttccatccgggagctcatgaccaatctgataagaacaccaaaaaaaagtcatgaacatcacatgaatatggcaaattaggatagttgctgagaagtgagaagcttaatgcatgttctgttagtgttcttactccctattcggccagaagaagagtggtcgagccaaaagacaccgccggggcgaagcatcaggtagacgccgtaatggtggggctctgcgccgccgcctgcttcggtttgtacccgtcgaaaaactgcgtggtgtagtcgttaccgtcgaaatcgctgaggacgaacgacgacttggacaggtatgacttgcacgggaaggaaatataatggttagtgaggtggtcggagttaatggaggctcggcgccggcagcgaggtgggaagtggtggtagagttacatgagacacagatggagggcatgagctgctggaactactggatgcgggtgttgaggggcccgttgttcccgatcttgtcgccgatgccgagggactagaaaatccatggtggtgacgccgatgatcgccatggtcgcgcctcgccagaagtcgaagccgcccctgggcagaagcggcagcctaaacttctccgcaaggtcgtcctcggcgccgagagaagagaggagagagagaggcgaggaagaagaagagatgagatagaggtcgctgacacgtaggtcccatttgctgactcagcgagtcaagtcaactgtggtcaacctatcacatcagcaaaaattgcttcccaaaccgctaaaggaggtgatttgcactggtttttaatgatggaggaggtgttgtatctggttttatggttgagggaggcgattcaaccatgggcaagagatgaggaaggcaaaatggacttattcctttgcgaaacacaactaagacccaagagtaaatctagaaaggaataagtctactttgactccctcaattacagcacccatcttatttgtatcctcaattgaaataccatatatcttgacctcttactatgaaaagtggtgaagattgacttcctgagtgattttgagggtgcttttttcgctgactcaacatgtgagacccacttcagcgtcgacttctgtcttttctttcctccctctccctgtccctacaaaatcacacggcgactttaggcgaagcggtggcggcgtggcctcgaggtggagcgcggccaaatactaagggcctgtttggcacagctccagctccagctccacccctcctggagctggagctcagccaaacagtttcagctccaccaaaactgggagtggagttgggtggagctctctcacaaaatgtactagagttgtggagctgggtttaggcagctccacaactccactccagactcaactcctggagttatatataggagttggagctgtaccaaacaggccctaagcggtgtagcttaggagatcaaaatcatcacccacttcaccaggtcggcgacaccggcaccaaattgaacggagagcagagggagccataacccaggcctgcgtcgtcgaccgtgccgtgcaacagccctgcgacgatgacaacaaggcccgcgccgacctccgcaagcagtgccactgccaccgtctccatgcagtacgtgctgcatgtaagggtcaccactcgcgtgcaatctgaagaaaccaaatgccaaagacaagcagctcggtcgcttcaacatctcaaaagctaacgcatagacaaaacgaaggaagcaagaggatgggacaaagtcgaacatatctgcccgtggtgagccgccttggtggcattgaaggccctcctcacgaactcgtcgatatagtgttggaatataaagtgaattgttcatcttttcctatcagattaagctcttgggttgaattggttagcgcatgcaacttaatatggtatcagagctagaaaactcgagttcgaatcctggttggtacgcaattaaacaaaaattacagctcacttctattccacactaaggcttaagggaggctcgtgtaagggagagtgttagaatataaagtgaattgtccgtctttccccatcagcttgagctttttatttgaactatttagtgcatgcaactcgatacatcgcgcatttgatcgcataggatatcatcggcgccgacgccatcgcctacccgctggagaggaaggggtgatgatggaaagaagaggatgacatatgggcccacacgccaactcactcggttagactaggtcaatgatccacgtcagtgaaaaaccaccaccaaaaccactaagggagctattttacaggttttaaaagttggataacctatttggtattttggttcaaggaaataaatcagattgcatctgtattgagggacttaatgtggacttattccattcggaaatcatgtaaagaggtcatcattaggggaagcccatatgtaaaagttatgctgggctgttactcagacacgtaacccaagaattcagacttgcaatttcaataatttattcatgtcaaaattgcttttcggtgaaaaatgcttttatggatagagatattctccaaaatacaaattgatcccattgtcatataataaaaaaatgaaaaaaatataagtactttaaaattagagtgaaaatacactattgataactgatactccctccatcccaaaatataagaatatagtaccggataggacattttctagtactatgaatctggacagtctgtttgtctggattcatagtactataaaatatcacatctagttttagattcttatattgtgggacagagggagtaccaaaacttgcaacttggtgtaatttattcaattcgttttgcaaattacttaaacgagtcacctgtttaatttgtcgtctttttattacttctctagaaacactgaagtttgctatgcccatcagaactttcagacttgcaatctcaataatttcaggtaacaattgctaccgtcataaatatgttactctctccattttatatttttctaaatttagcaacatttaaaatataaaattagtttcattaaacttagcattgaatatattttaacaacatgtttgttttgtgttggaaaagctactatatttttctataagtttgattaaatttaagtaagtttaactagagaaaaaaataaaaacaacttataatatgaaatagagaaagaatatattttattaagaaaaaaccacacaatattcatgtatccaatctaatcttcttctctcttttttttgaaaaaaaatataattgatgaatgtaatctcgaaaatttgacctgatgtatgcctaaagatatttttacgatcactggtacatatatacccaaatttatttatctttttgttcgaatttcgtgtcgatgtgtttcgcctttatacatgcattaatttgaaagggactacagtaaatcattttcagaaaaaaaataacgattgcccaataattgtgtttctactgaaaaaaaaatagtacggccttctcttattcattatacatgactctactgaaaaaaaaattaaaaagcgcagttcatcccaaaattgctatctgtatatcctccgttcatatttctctggatcctgatgaaagagagttctgaatatccggttcttagaaaattctaaaaaaaagggcatataatcagctccaactgatcaaccacgccatggtgtttcaattgcttctggatgacacatctttccataattccatcgatcatattcgcgcgtgttcttactcctctgcttttcgcttcgccttgctagaactagaagggaacgctagctatctagaacaactagaactagatcggtcaaaaaaaaaaaaagagataaacccaaccaagagagatcgactagaaggtctaataacccgtttactttagaacgaagcagtgcgagcaccgatcagcaagaaaaacccccatgagccattgtttactcagttgacactggctagctggcgtcccccagctgaactagaagccgcagtgctacggaatgtgaagcaacttcctcttgccggctgccgctgcagtgcgcttcttgatccgcaaggcgctcggtctaggtcttcgtctacgtctagaaagaaaactacttgcgtgacatgaaacacatccccggaatatactattactccattgacaaaataagaacgggtaatataattaaaagattgtggtgtagtcttcagagaaggaaaagaaaattaaagattgtgatgtgtttcccgtatttctactggtaggagtacgacccatggaaggttctgtctagtatggcgaggtgggaccctcgccgttttgtcaaagctcgcctactactttatccactcagttgagccagctgctcctatagaatatttcagtttgtcggatttgccggagttttgttggctaaacaggtcaattcaaaaaattctagcgtcagtcctggcgcaacaacgatccatgctcctcgtctttggctgtttggcacggactggtangtagaatggtagatggatgcaacttgcacaaatcaaatgggaggcaaaacaccaagtgcatcaattctaatcaattactccatattttaatgtatgacgtcattgattttttaatcaatgttttaatattcctcttatttaaaatttttatgtaaatattaaaaaatatatgtcatgtttaaaaaacatttgataataaatcaagtcatgataaaataaatgatagtaacataaatcttttaaataagatgaatggtaaaatattcataaaaagtcaatggcgtcatatgttaaaatacaaagggagtatatatcaaccagtagctagtttggccgcacgcggtaggttagtttctccccccataaaacattactaccacttctagttcactaattgctgtatctaatcacgtgggcaggggaatttgtctcgattttagtctcattttttaaaaccaaattcgttttcttagtttcaactactagtaacatgtctatccttgctaggtctccactgaccaattgggtgtactcgcccatccgcaaaaacacacaaccaccaacgcttctggattgctgccctttttttcttcctgagacgatcgtgacattattgcctggtcgggtctagaattccaacttcctagttattactagtcgggtagtcaaatgcattgcatctgagacgaactggcgcaagacattccatgcacgctcgcacgcgtgacaggtttatgatacggcctaactgcttaccggagcatcagtcacctgataaacggaatcggcgagaaaagcatggaattatccaccacctccgccgccgcgacagaccggcgccggaggggtgagtggtgggtgcgagtggggtggtgtaaccgtgcaagcgactatccggcggcgatatgatggcctaatccccctactaaacccatgtggactgatggcgatcgattgatctgtgacaagagatacatgccgaatccattaatcaggtttgtgtgatcggtttggactggtgcctcagaatcgcttggtttggttggacaaacagaagcgacaacggggtactttttgtgcaatttggtgctgcgcttcctttctgaattgatgctatagtgggtgacgaatttctattgtacagtattgtttgaacaagttatgcgtgtaaaacggtttggagaggaaggggaggtcacatgtctcgattatctatattactctagaagattaaattggtagtgaaaattaatgagtagcggatctgttaattactactcaataattaacatggggatcacgaagttggtgaatgttgtgctaccacctattcctaccatgagttgacattttttttaattgcacacaagatataagagcaaaaggaccaccaccacacaagcacgtcacactcacacatctgctaacacatgctcaaaagacgaaaaacaacggcatatccttgatcacactaaattcttataaaaaaacgtactcacttgtgtataatgtttatgaacatcaagatttaaactttaatagatggagtcaatgtacccataatcccatcttccggtgcttcccctatgagttgacatttaggatccactaaataatgcaccatccatttccaaagctgtggaggatgggtggaatcatattcaacctgctccttaaacacatgggtatttagttagtaggattgtaggaacataagaaaacaataatcagcattgtgttagagttattgattggctatagatgaagttaaagaaatttatgcttatattaaatttgttgttccaaacttgtaatagtgtttcggagagtcccttgttgatatggacaaattgtagagagaatagttgactctgtttttatatgttccctcatatattcaatgttattgctaaaagaaactttccacccacatattgaccacatttgttttaactagagaagggatttacattttatatatataactagttgactatgcttttatatatgcccttgtatattcaatgttattgttaataaaaatctttccacccacatattataaaaatagatcgtgagccaattattcaatatatagctcacaaaaataagctaggttgtccaatctatatagaataagtgataatttttaagatttttatttaagtacatcttttaaaaattgaaaatagtttcattcttaattaaacctcaatgccatgtcactcaaaaactgctttgaatttggtcaaacattgaaattgaatggcgtaatgcttaggggcctagggctgaatactgtccggtctttcaagtttatggatgaatttaacttaggactttcattgaagtttagagatgtcaaatattgttttttttccttttcattactagaattgtagtcctgggacaaagttttttacacatttctgatatctacaaaccattttgttttcataacagcattgagattttgtatgttgtctccccgcaaaaaaaaaaaaaaaagaagagattttgtatgttgtcgtctcagcggagtgtcaatcctcttacacacaccattaagagtaacacccagagtatcatctaaaaccacaactccaagaagaaaagaacaacagacataccacaacgaacagaacataccatagttgtgaacacctcctacaaggagcgttcttttcccggccttttaaaaaataaaaagggacaccacaacagaacagaagtccttgacattctttgttattccaaccttctggttatcaattttttttctttgaaatgaacagcacaagatagttcgagtttcacgtattaatacagcaggagaaaaatataaatatgtaattctagaagaccatagacagggaaaaaaagagaaaagaacaaccacaccgcgcgtctataacacccgctacgagagcgaaactggagatcttcgagacgacacctccaagagacgacacctccaagaagagaatgacaacacaagatttttacctgaagaaagtaattgggagcaacaagaaaatgcaacaacaccccaagagaaaagcagcatcggcaggcgtcgtcgcccaaattttcgtccttcccaagaactaaagtcctgcacactccgcagccaccaccatcgaaaaccttcaacgcatggctaccgcatgggcgccacgacgccagccgatcgttaagggggagctcgactctcgacacgctccagctccatccgcgcagttgggttggatggggagagggtgagagagaagaaaggatcccctctcccccacactagcctgcccgacgcggccatcttttgtcagcaaaggcgacgtcgcaagaggacaaaagcctagattggggcccatgaaggaccgcggctcccccttaacagaacaagcgccgactccgccatgatcctgttgtccgcgtcacctcgggccactagaccgtttcgctggcgccttgccaccctccgtcacagtgctcccgccatccaaaacgtcgcggcactagaacattcaccgaagcacgatgctcttacccctgatccggtggaggggatagggtcttgtccggggagaggccgaacacccaacacgcgccaaattaccatgtccagcgccagcatatatttgataatcctggtatccatgatagtttatagttaaaaaaacaataaaaaattactcaaaaatatttttttaatttatctgaacttggtgggattactaggcatttatcattatctcaccccagtaagccagagtgctgtgcggaaccagcgttaaagaaaagcacgctgattacacacctgatctagccatatcttgatccataacattcattcatattttttttcctttggtctatgtaaaacacagagcgagagagagagagagtgtgtgtggattatatcaatgtaagacatattaaccacttagattatgaaataaggactgttaaacaaagggattatactgactagtttagagtgtgaaacatatgtgtgtgtgtgtgtggtactactatctttgagttaattaattttaaggatctgctctgattggaggattgggacaatagtcaatatttaagatatggtagcatgttaccaaattaatcaagctggtgcatagtcaatgaataagatttaacatgaaagcgatactaatagctgggag

SEQ ID NO: 19151 - DNA, 11559 bp, Oryza sativa
aatctacgtttaataatcttaaatagcaagattctgaaggactatttaatagcccggaggatccaaacaaggctataacagtaacaccaatccgaatgacacggcgagagagctagggaaccttccatcacgtgaatttggatgctagactgctagagtgtgagaggcagaatttgccttacagttcaatattagtgctgatgcaaatccctctcgctgcatattaaactgttttatttacaaaataaggaccacacctatgcatggaacatgaagtatacagacagatctagaatgcgaggcccacatgtagggcccctttgaatcgcaggactgagaaaatgtaagaataggaaaaacgtaggattttgataggaatgtaagtgtaaaacagaggattgcaaaacacaggaatgaccatttaattgaaccacagaaaaaacacaggaattggatgaaagagatagcctcaaaagaaagttagtaagaggtcgaagctcttgctaaattttttccaaaatctctataggattgtccattccataggaattttaaaggattggataggattcaatcctttgtttcaaaggacttcataggaaattttcctatagaattaaaatcctttaaaatttctatgtttttcctccaaatcaaaggagaccgtagtagtatcgcgtagtagaggatttgctggatcgggggagtaggacaagattcaatattttaattggattgcaatgcgttaccaaattaattaatcagtggtcagtgtacaaatttaacaacatgaaagtgatactactgttttgcaccgagatacatatacaatcataacacgatgatagccatgagacgtacctgacataatagctaccgatcgagtgacataggctgtgtgtttagatccaaagtttggattcaaactttagtaattttccatcataacaacctatcatatacacacaatttttcagtcacatcatctccaatttcaaccaaaatacaaactttgcgctgaactaaacgcagccatatacgggaagctacctggcaactcgcataacgccaacacgtaaatttgaatcctacagcattctctccatctcaaaataattttatttttatctacttcacacataacaatacaaaactaaaaaaataaaatattcttattttatcaaactccgatgcaattctttctcactttatctattttcaatgtatttatcctatatatttataaactccgatacaatgattactcaccaataaaattattcagggacaaacaaaagagataaaaataaatttattctggacggagggagcagtagattaataagcagaattgattgttacgacaggagctatatatatacattttgctctttcattatctataaaagaacacacgattgacaaaacatcgacgcgaccgtcacggcaagccacaggcgaagcggcacgatgtagaggtgcccaagcaaaacgcgctcccttctctcagaagctttctacagatttacgcggcttaaccctcaaataaagcgagatcagaggcgtgatttcctcatttaatagccttccaatgaaactgaaccatttctaatcaagagacttttccaagttttgtctctactgtacaagtgtacagtgatgtacagatgtgatagatagcttagctggggctttaacgcggtgagactttgatatatactcctttcatcctaaaatgacgaaattagactcatcttaggcagttgtctggtctcattctagattatactctctacattttatattataagactttgtagtattatccacatttatatagattttaatgaatctatacacatatatgtctagattcattaatatatgtataaatgtgagcaatgctagaaagtattataatatgaaacggagggagtaatattttaggacggaggaatcatctagcaattgaacggagctctcgtcgactcgttcctctttcaatcgattacatcgaattgagttttacgaaatgggtgtacaggattcagtgctaccactcatgcagacgacaacaagggggtgagacaccctcactacgcccaattaggcgtgaaccaaatgaacgaacaacgctacttcagccccacatctgtaaatgtcgtcgtcaccatcaacttcatcacacaattgccgaaaatgattctgatgaagcatgctagaagaggtcggcttaggcagctagtattaggggtagacaaaaagcctcaaaactcgggacttggataggcttgtagtcagcttggatcggatgaattggcttggagccatagttttaattagttagccttttagctgtaagcttaacgagctacctcgcgagctgctcgtttagctcgtcagtacaagatatcaccatacttttatatacttaatactttctccgtttcatattactccctccgtttcacaatgtaagtcattctagcatttcccatattcatattgatgctaataaatctagacatatatatatatatatatatatatatctatctagattcattaatatcaatataaatgtggaaaatggtagaatgacttacattgtgaaacggaggaagtataagactttctagcattgtccacattcatatatatatatattaatgaatctagacatatatgtatacctatatttattaacatctatatgaatatgggctagagcttagtctagtaattacattaaaactatttatatttagtgaattctttattatttgatgtttattattatggtaatatgtaataaaatgataaatttgaaattatcaatatataataagaaagataaatagctcggtaacaagtctaacgagccagcttttgagccgagcaagatagccttttagctcgttaacgttaaaataacgagcttgaacaagtcaagctggcttgttaatccaccccttaagcaagatttagggtctgtttagggagcttctagctgctgcaccttcttctagaatctccaggtcccccaaacagtccagattgccactcaaattttgagagtccaaaagctgaaaaacccagctttctagattctcagaagttagctaccaaccagcggattctcagaatcttccccaacctaggccttagaggcatcgaggatgattgcattttggagttgttccagaatttcgagacgcgggtcgaatggaatatgaacttgaaatgatcatgaccatagctactcgcagaattcttttgccccgattcggagaatggccacgcgtccctcgccacgtccgatttcctgctggccacgaaaccaaataatccccccccccccccccccacgagatgcgtattccgaaaccgtacagacgccggcctgccgccctgtgtgatcctacgaaccgaccgaattaactccccagcagcttccagcttgcttgacaagcaaccacgtcgatcgaccgtccgtcgtcacgtctcgttgtaggcaaccgccaagcctcttccagaaatatcgtactagtagcaaaacatgtgtaaaaccgaaaaaaaaaaacaaataacccccgttcacacggaaacgggaaccttgccaacggcacaccgcgtgcctcacgagtgacgtgttccgtcgccacctcgaagcccaaacagcgcagcgcaggcagggcatcgagataaaagcagcgaagtgatgaaggcgaccttcgagaaggtcgcgtcccccctcgatcgatcgcctatataaacgccacgcaccgttggctgactagttattagttggtgatcgcttggggcagcttccttccttccctcccaaaatccacctcacaaccacacgagacgagagccaaccgcgacgcatcgtcacatcacagaggaggcggtggccatggaagagagacctcgcgatcgcaccgtcgaggaggccgcggcgttctccggcgatgagtccgatggggaattcgagttcccgttcgtgagcagggagacggacgccgggggcgtggccgacgagctcttcgcggacggccgcatcagggcgttctacccggtgtttggccgcgtgctcgacgacgtggcggtgacgcctgcggcggcggcggcggaggagcggaggccgccgctcgggaggctgttcctcgaggaggggcggacctcgtccgtcgggtcgacgtcgtcgtcgtcgtcgtccacggacatcgccgagctggacggcgtgtcgcccgacagctactgcgtctgggtgcccgggtcgtcgccggcgtcctcgccgtcgcgccccccgcggaagagcgggtcgacggggtccatcgcgcggtggcgccgcatcagcgagctcgtcgtcggccgcagccacagcgacggcaaggagaagttccgcttcctctccgcgccgtcgtccccggccagggatcaccccaaaccgaagcccacgacgaagggcggcgccgccgccgccaccaagctccacaccgagctcgacaccatcgccgccggccaccggctgtcctactcccccaaccacaaggcgcacggcggcgcgacgcggcggacgttcctgccgtaccgccaggatctcatgggcatcttcgccaacgtgaacgggctcagccggactcaccaccgccccttctgatcgccggacacaagccgtcaccgtcagggcgaatgaccacttcaactcaaaaaagtgagaaagagagatttcgagtttgaattctccgggatttgaagtttcgaacctttgacttgaagcctactgcaatttgaagtttgtgtgattagcgtaatctatagctttgctattgcacgggggattaatgaagtcaaaattggaggcgtgaagtcagaacaggcgaaatgtgggggattcgctgaggaatacagctctgcaagtcggtttattgcgaacgacatgtgaagttgtgaacgtggtagggaatcacacacggggaagttgtgagagaaaaaaaagaagagcttccatgtgattatttgtacttgtacatatgtgtatgtgtattattggatatgtagattgacaggagtcgtttttttcccccttgtttgcacaatctaactactggagtagttgtgttgctttttctgcatactttgtttgccctatatttctttctctgttgggtttccgacaatgattgggcgtgcgattagaataacttgtgaattttcgcctaatgaaatggtatgaagagctacatgcgactatacgagtaattgattgcatggaaggtgaaccgcattcatgccaccaattgtttcaatcatctcgtgatcatctagaacattgacctttttccctttggaattgacagaactaaaaaaatcaggcgatattttgtttgctaagagcaatttcaatagtatagccaactgctgactaaggcctgtttggtacagttccaactcttaaaattaacttcaggagttgagtatggagtggagttgttgagctgcctaaacctagctccacaactctagtatattttgtgagagaggtccacccaactctactcccagttttggtggagctgaaactgtttgcctgagctccagctctaggaggggtggagctggagctggagctgtgccaaacaggcccgtaacaaatcatctgtagctaatctaatagcccattcattcaatagttacgtataaaaatatactacaccattaataccaggtcctacctctcatacacacataacgtcttggagtccgtgttgcagtcggctacaaatctgtagcctgctttcttctccctcttctcttttcttctcgatacgtggttatagcttgcttatagtttgctattgtatttgctctaagattcaacaggcatgtacttttattttatttttttttctatttttgctcttttcaaagaacccacttaaagtaactgtcattcaattatataccgacatctttggctcaattttcaggtctgctttagttcccaactttttctttaaacttttaacttttttatcacatcaaaacttttctacacatataaacttccaacttttttcttcaaactttcaattttagtcaaacttctaattttgacatgaaactaaacacagccagttgttttccccgagtgtaattgctctctctccagatgtaaatatgcttcaacatttccttatcttctctttcaagtagataataaattatttttattcttaattctcttatacattgtatattagaaaaataatatattttttcgaaaagaagaaaatacaatgtaaattttgaaacttaccatgtaactgcagagtaagttttgaacgttatatagtataattctaatataagtggatcttcaagagtggctatttttctatcagaatgcacaaattacatagccatatttatgtttcactacaacagtatctataatctctacattaaactgttcaatcgaacaatagatcccatttgttagactctctttatttattcttcctctctctccatctagatctttcccctcgccaaccactccaccctgcctcactagtgagacgtacgctggatcgaaggccgacggccgcgatgctgatagcatcattgcaagatatgcagcagatcatggtccccatcggttgatctagtcttattataagccataaggctttttagcgattacaaaatgatacgtgagtaaaacttttgtatatatgtttttagtgattgaaaagccaaagttgaaaaaaactatgttgaaaaaaaatcaaattcaaattcaagttttaaaattaaaattttggttttggcttataagccataaggcaaacgatgaggccccatgttgacggcggtgcttggcagatgggtgaacggccggatataaaaagcgttggcgaggaaccgaagctgcctcaggtcgtggcacccaccttttggcaaagccggaatagatagcaagctagggggagtggtttggctatcaaaatagcatgttgcttggagacatgtttctctatagactatatgtttgccaaattttgacatggagagtcaaacaacaactctcctggagttacttaaaaactagcaaatgctagcttgaaaaaaagttacttaaacatgtcaccgataacccatacctccattagcttttcagaaatgaccagaggagcctcttttgttcaaccctcaagtataatccacctctaggaaaaagcaacaaagagtacggcagtttgtgatgcttacagatcacaaactatgagtcctatctattcctaacagttccattaatctaggcgcatgattaatttgaaaagttgggttctaagcatgtgaatgttgtacccaaaatatttcacatttcgtggcatgtgaattaaccacttgattgtgcaccctcatttccaactctccattactacggggagacgggacaccctgacctccccggaaaagcggagcccctcgtcctatcagacggagcctggacatagcccggactctaatccgtcgcctgttgcttgctcccgacttctgctgcaaaacgagcgctgctgcatcgcggcatgcgtcgatgcatatctgagcgcctggtcaggcaggttccacggctgctacggcatcatccagatgatgcaaacagcctctcaatccagggaggaaaacacagagcgtcccgatgttacagcctgaagaaagaaaaacagagaagtggatactcttgcagttttcccaaatcggacgcaacctgcactcaatcacgagttgtttgatcagtgtagtgctagtaacgctcagctgtagagtccgaactgatcaatgccatctccacgacgacatgatcagtgagaattgatgggtgtcaaacgtatttgtcagttcagttttcaggtcaggtgtgcgtctgtctacgttcagtgatcagggtgttcaggcaggtattttccatcacctgtgtccgaatggtggtacatcactacatcagcagcagccaaattaattccgaaagccattatgcacgggtttgatgtaaatctctcgcaatcacatgctctgataattactctccatcgtcatgtgtaatttcagggtttgcctaacacccaagcacctaacagttaggcgcatatacactgaccctgcagctagcttgtttaacccgaggagatgacacacgttagccgtaatcctcgcctcatcccaagctcacgaaatcaactgctgcaagaaagcaccatctcattacctctgaaactgctcctgacctgagctgctcgaacagagagcagtgactagctggtatgaaatgtcaatgagtatccgttgccgtttcagcgtcattctttttcttcaattcatttatcccgaaattaagcatgcctgtttgcttacggatatacatgtatgcggacatgtggattcagtggatatatgcacgtacgtcatcttggaccggtcagtttattgacacgccgataatgcatgccttagctcactagctagattatggttggtgtgatccaggttaggttggttattggtaagtactagtagtacgtactagcttacgctaggtttgtggctaatatagatcagagcttcatgaaaaggcagaaaaggacatgtgctaacacatatatttctcacaagatattgcaagaaagaacatgtcaaagtgaacagctggaagctagtaactgccggattacaacatcagcagcgggtttcttgcgatctacgcgctcgagatcttgatcgatctcgcggataaattcaacggcagattaactacagagaatcgtgtgatccatgcgttcgcacactgcgcatagtgattatcccacgggagaggaggaaagcatcgtcatctcgtgcgattattacatggagccgcacgtaaatgaacacgaaaaagaatgttattctaatccatagacaattttgttctggtgcagtgcgttttgcgtaagtacgtgcgtgatatcagagatgagaaatgttcagcatccggagagtgttcagacatgtttttttttattttcctttttagcatgactgttctttgtttggtggtgattaattgttaatgtcctatgtaggtcagtatgcactacaaatatatctatctatctattatattattaaaacagctttgaaagaaggcaccacgttcgctgtgaaagctagaaaaaattaccacattaatcgtagaaaaagaaaagtaaattaaccattggattgtgataattggattgtgataagtctagattttaatggctaagatttattggaggtatgttggatcagaatcgtacagagaaataccgctaataatatatgaggagttagagtaggctgatgagttaggaatggatacggacgtcattaaacagtacggacttaaagcacggattagagtagaacttgaagatggatacatccaattcaaaacagtatgcgcatgtaggcgaaggcaaagaccaagacaactcatgcgttcctcagccaaaaatcgaatataccatgcatgaaaaagaaaaaaatgactaacaatgtggaaaaaaaatcattcaatgaagaagatcatttgcagatacactgtaactaattaaaatgtacagcggtataaatagatcatggatatatataaaatattgttatatttattaataaaaatatacgatgacgtagaaaggttgtcaggatcgggatactaggtagtatcgttttgctcaaagtaatatcgtatcgtaggatcgggatactatgagattttttaaaaaaattaattactatttatattaattatatatagacattctatataaaaaaatatagtaatgatatatgtcattcaaatagagacatttattaagagaaaccacgttggttttgatatatttaactgatttttatataaatttgagcatatttatttatattataaaaataacgaaattcagaaaaatgagaagagttcaagtaggaatacaatttaaaaataactgaaatttgaagtttaaaataagaaatattgaaagaagagtccatacaagaatccaatacgagattaattaaaattcagaataaaaaaataaaaaatcaaaattagaaaaaaggataataaaagaagagttcaagtaggaatacaatttaaaattaactgaaattcggaattaaatataagcaatattgaaccaaatagtagattaattaaaatttggaataaaaataacataacatccgaaattgggcaaattaaaaagagagttaaactaggaatacaattgtaaaataactgaagttgaatataaaaaataaaaacatcaaaaaaatataatacaaaaaatgaaataaatttagaaattagaaaaagaaaaaaaagatttcaactagaatacaatttataaataactataaaataattaagactattgaaagaaaatactatctaaaacacatgacgagattaattaagtaagaggcctatagaggagcagagtggtggcggttgatgaaatatcgaaaaacaattaataaaacaccaagtagaatcctaatgatgattaaaaggaaagacgacgggcatgtcgtgaagcaatcggtcaatacggttggagaggacttctagaaaataaaaaaataaaccccaatgataatcatatttaatttttaaaatctcaattacaataaaaaagagaggctgtgggcgggtcgtataggaataaaatggcagagccaccgatggttggtgggtcttctagaaagtaaaaaaatgaattccaatgttagttatgttcgatttctaaaattccaatgacaataaagagtatgcggcgaacgggtcgtagaggagtacagtggctgcgtttgacgagatttctaaaaattataaaaaacatgaaactcaacgagacaataaactcaaaaactataaggtccaatttttaaatgttcgtgcttctaaaaagtaaaaaaaaataaaccacaatgttaatcatgtttgattttaaaatctcaataacaatagagaaggacggcagcgggcgagccatagaggagtatagagacaaagtcgttggcgttttggcgaaacttctagaaagtagaaaaatgaacataaacgataattatgtttgatttttaaaaatatagagaagatgcagtggacagtcatagagaagtataatgacagcgtttgataggacttctataaattataaataagaagcccaacgtgataataaactctaaaaacttactatccaatttttaaaggtttcaaggagaatgaatagaaacagtacggtagattgggtaagctaataaagaataatatgacagaaataaagggtagcagctggtgtgacttttaaaaactataaaattaattagaaacacaacgatgataaggtttggtcttttaaatcttaagacaccgagataactatttaataaattttaagtaaaaatatattaaaaatatatatttttatatgggtgctagccgcgcaattacgcggg

SEQ ID NO: 19152 - DNA, 5721 bp, Oryza sativa
agcgggtttcttgcgatctacgcgctcgagatcttgatcgatctcgcggataaattcaacgccgcattcactgaggaggccgacggggcgatcgccgcgctgcaggacacgggcggagacgggctcgccaccaagcagctcctcgagaggtaccacgcctcgccgcttgcccacactatcctcgcgcaatggtacttcgcgcacgcggatcagcaaaagccgacgaatcacctcaggagagcggcatggatggccccgcgctgcctgcacatcgcctttgcgctcgccttggtgctcatcgagatgggctccttcgacgaggcagacatggtgtgtgcccacagcctcctcgtgccggatctcaccgacccggtgcacaacttcatctccccgaaagagcaggttgatgccattatcacctccaaagctccagagtatagattgggacgcggggcaatctgggcattttgaaaaaatactcgccactttcagccgggaaatgataaaataatgagctcggtgtcctacggcaaattttacaaaatttgtagtgtcctagagcagttccatgttttctcggtgtccctcagctaattacgcgttttttggttgtcctgtagcaaattttgcctattataaaacgtcggcaacagcctgaccgttcgaaaaaaaaatctcatgttcaacttctaacacactcgcaattttttcttaaaaattatttggaggatgtctctcccctctaaatcaccttggaaaggttaattgttctttcttaaatcaagttcggtggaatattccgaccacagaaatacgacattttgtgccaaatcttgatccaattttggtcaaattgcattgttttgaatttgaattctcgaaaccaatctaaatttcattcggtattaacattcttcctgcctctagcttaaaattttgcagttaaaaccatgcggtgcatacccaattacagatgataaatatattgatccgatccagcaaaaaatatcccgatgtaccagtacctcactatactaaatcgttttctatagttggatctaactccaaatcgtttcctatcgttgaatctaactaggcagaatggccattgttaaatcctagtaatcgaaaataatcttggtaccaagaggtactgagctattttttattggatagaaacaaatcttaaatgtcaatgtttaatgtttcttaacaatatctgggctgcaaatgagtcgaaatgacgactgaactagaacctttcgacccatatccccgccaaaatgtaatagagccggacagccggtagggattgggcctggataggcgccaaaacgaggcatgaattgggcctgattcgtacacacattggtaacagaataaggcccaggtgttgataagccacacatcctcatctggtactccatcgtagtaggctgtagacttgtagtgtaccaaaccaagaaaacaagaaaaaaaatgttgtgttttaaaagagtgattttacaatgcttgaagaggtaccgggattataatttgggacctcacgatatcttcggcactataagttccgaaatttgcattaaaattttggtaaatctaagtacttattaaggactataaaattacttttcaaaaagataaagtactttagcaaattctcatcactcccagcgtattcaacggattcggctatatccatttggccctgctgcagttcagaataagggttgaatttattcaaatatcataatatataagtagagactatttttagggcatatacaatagtctttattagtgatctctctctattgttatgcaaataaatttgatgacataaaagaaagagaaatgaatatggttgttatgcatgacaactgctcagagttgactcttagcatttattagagcaaattttgttgcatggtgatgaaaaaaaggaaagaagagtaagaaaaagtatttttatatattaatgattatagaccatattgtctctaactgttgtaggatgctagtctctagataatataaatctcatatctaactgtatctttgtacatgcacttaggtcgccaaaattgggttacatgaatgagacggccgagttacggtgatgccatcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgaaattttaagatcagctcaggtcttccaagaacccatgttcttggaaatcacatgttcaagctttaaaatgcattgataaaaggcggatatcatggtagcggccattttaaaatgcattgataaaaggtggaaagaaaaaaaaaacatctccaagtgtaccttggattgtgagaacgataaatattctaacaaaaaatttgaatgctagaacgacaagtaaactgaaacaaagggagtattagtgaagattcaaaccagtagtaagtaactaatttgaatgttcataatgatgatattgtaacataaccaatgatagaatataaggtttaaggttaagttttcataacacactataccatttatatttcatttccggagtccaaacattaccgaatcggaataaaatggtccttacaaaacggggacaacctatacggtcaaaaatctcaatatggttttcattcatgttttaggttgtgttcttttggcagttgagaacattttcctagcatgcaaaacgaagcaatggacaaacgtatgattaattaagtattagctaaaaaacttaaaaaaatatatcaatataattttcttaaacaactatcttatataattattttttaaaaaaacacatcgtttaactgttcagaaaacatgcgcacgaataatgaatatagaacttgggaagagggagtatagaacacacctctgctaccgtacgtaaaagtggcgtagtggtagaggcactactacagaaagtgtttttcagtacaagggggttattagtttacatgcgggcggcttaaaccttataaatttctgtacgagggggtcatactatggtggccaaaatctatctattaacttataaaagtaatagaaaaaggaggctccaagttcgctcttatgacttaaaaattctcacattaattagagaaaaataaaaaaaagagtccatattaaaatacattttataaataattaaaatttagaactaaaaaaataagaaatatggaagagaagactagagtccatgtagatatacaatttagaactaattaaaatttagaattaaaaataagagattaaaactagagtttagagtctatatacaaatataatttgtaaatatataaaattcaaaattaaaaataaataatattgtaagaagagtctagagttcatgtatataaaaaaaataaaatggctaaaatttgaaacaaaaaagaaaatattaaaagatgggtttagagtccttaaagaaatatattttacaaatgaaataaaaaaaaagagtccatattaaaatacattttataaataattaaaatttagaaaaaaaaaagaaatatggaagagaatactagagtcgatgtagatatacaatttagaactaattaaaatttagaattaaaaataagagattaaaactagagtttagagtctatatacaaatataatttgtaaatatctaaaattcgaaattaaaaataaataatattgtaagaagagtctagagttcatatatataaaaaattaaaatagctaaaattcgaaaaaaaaagaaaatattaaaagatgggtttagagtccttaaagaaatatattttacaaatgattgaaattcgaaatgaaaaataaggaatattgaaagaaaagactagagtctaggtatgcaatttagaactaattaaaattctgagataataaaataaaaataaaagtagagtttagaatccataaaaaatacaattttttaaatactaaaactcaaaatttaaaagtaattaatattggaaaaagagtttagagtccatacagtaatataatttaggaatagctgaaattcaaaatttaaaaagtaaaaatattgaaaaaggggtttagagtccatatgtcagtgttacggtccaccttaggatttaggaacataaactgacacatcacaggtggccatcttaagctaatgggccagccgcccagctcgtttctatctgcaacataaggcagaaaaccaaggccttgacatttcttttaggacacacgggctggaacggccccggcccaattaattaaatcctgctattgaaaaagggttctgtaattagagttcctactactatacatacttccgcaaggtaatctagcacccaaatcaaactacagccaacgtgtatcatcagtagattccaccccaagatcgtgtgcccgctccgatcggcagaacctaatcacgaccaatccgtcgccaacacagccacaaacccacaattacgcggcggtgcattctcgttgc

SEQ ID NO: 19153 - DNA, 13531 bp, Oryza sativa
tgcatatacatacacgatacgtgcatgcacgcgcctcgtgctgcattaggcccgacacatgcacgggtcgtacgtagcttgcattcctgccgctctctctagctctacgtacacacaacatgtcatttggttttatccatacctgcaaactgtgcaagaatggctacatgcatgcatgcatgcactgcagtgttatatctaagactaatagtctaatactgtgtgtctaattgtccatacctcgaaacatagttgtttatgcgtcaatcccacgtaccatcatcacacacaccccgcaactcggcaaattgtccaactaagcactgttccgtgaccaccgactctcttagttttttaagcaatcattgaacagtgtacagcaaaagaaaatgtatgttcaatttttaatcaacactgacaacatataggagtatatattgcatattgcccttcttatgcttttttcccaatttgttttctgtcaatcaacgtgcacgtcaacaaactctaaatagaatattcgggaggagaaaaggttcccaaacagttggccaattatattgttcattagagataagaaagcgctttggatataaaagatacccccaaaagtcttgagtggaatgaacaaagctccaagtacattaagaaatcaaacatctaggcggcttttccctcaaacgataaggtaaagttctagcagggacagatagtgttcgttttctactttgtttctttttcgcttgaggagaagcgtccatgatttagctttagtaatggactgtcgagtcactatcaacttcggtattttaacaattatatattttccattttattttgaaaaatgatacggagtattggctttagtttctcaagccatataaagatcatagtatctagtatatacagaaatgctagaaaggtcaagtttgctgtttttctaggcaattttttatttctccaaacattaaaaagggaatttcacttgtaatggttgaactcaaaaaattttttatattaattgtatttcgcacgaggtgatctgacttgatggggaaccagtacaagcccttgttttttgtgcagtcaaggacaggctgagcttgacgttgaccctcaccaaaaattgagtggtacaaaaccattcaagaccattaactgatgttagatgcacagatgagatgtcaacaagaaaatccacctgttatcaaaaccggtttgaaatgtttccttaatatttagggaaattgagctttcattaatcaataccggcgagggtacatccaacatgaaaatatattttttttatttaaagagtcatattgggaattaatttctatcaattaagctctaccaaaatttgcctaacagtactgaaattcctggttcatgtatacaagacaagccccaacattaaaactagcttgcaatactgatttgtcaacctatacagtcatacagacgcatacccgaaagaaacacctactctgtaggaatatgcctgtggttgcagttaacggattagggaccaaaaccttcccatcttgtggcgaaaagctaattgtaccttgcatgatgtactactagtaggggacctctatgccatttgtgtttagtcaagtaatatgggcgcaaagataaggaagattccgcgaaagagtagttggccgattggctcttccagcttgcaaagcgacctctcgccttgccgaaaacttactgttccttttcagatcagcctaagtgcctaactctcccgttaactgggatggctgcatactgatgcatgcagagtagttagcagttgtttttgtctaagtactgcagatagatggataaacagaaaaactaactgctgagtagtgacaagatcagttccggattaacgcgccagattgcgcaaatccagcatagattgtgtagcttgctcccgtactactggtactgatatagtagttattcaggcatatgggatactatgaaatggttcttggtctcgtttggagctattgtttcttggatcacggagccagtagctgctccatgtactttggtcacctgatgcaccaggcaaaacggctcttaagatgtgaggatgcagtagaaaactgctcaacctggcaggcatcctgctgacgcttccgaggcccaaacagcgcaaacaacttgtagcacttggatcaccccagaatcccagataaatcttgctgctgggttcatgcatggtgaaatctgcatctgatttagataatcttgtatttgtcttgcaaacaaatccactttcaagatttgtctgatgcgtgacataagtatagtagtaagaggttgtcaatgtctgcaaagtaagagaggaggagagctgatgatcgaatcagaattttgtgaggtcgtgaagttgcttcagctttaacttcaactatcaacaatcagatactccacaaaagaagtgcctaacgaggcaaccctactgctaagtactagcacacacaaacactagatcaacctgaacctttttccttagcgcgcacatgatttaatcaaaacaactgccattcttccacaataagaaagccgtgcacgcacacatgctagttagctagtagtttcatttctgggatcaatagtatagccgtcacgagtcaaattcaaaaagaaaaataaaggacgatccacacgaccgtttatatgtgtatacacactagcaaggagttgttgatcatctggatgcatcgacttaaggaaaaaggcatatgaccatttcgtgtgactaatcatactcccttaaaattaatcgatctccatttttgtaatcataatcctgcatcatgcaaccccatttcttacttgctctgccaaaggaaggaaattaaacaaaacccgcaaaattatgtttggctgaacagcataccaaaacagggggagggctcttgccattccgatcggccatttattttggccacaaaaccagcccctccatccatccatcgctgctatatttttacctctttgctagctgctccaactcaccgcgttccacgtggcgcatgcatgtttgctagtgatccgggaggccgcgacgaccgccagcgaacggaagggaaaaaaaaaagtcaaaaactagagccgatcgtttgatccattcgatatagggaagatgagtggatgcctctgcctcccccgctataaaaaggccccaaacgggacgccatcgccaccaccaccagcagcagcggccgaagcggaagcagcagcagcagcagcggcgacgaagccgtccatagattcttcttcctccccgtcactcctcaccaacaaccatcccccaccctccaaggtccgtccccctgtctcctcctcctcccgcaccatccgtcaatacagttactgctctcatcatcatccatccatcctcttctcctctctctctccttttcttgattcatccgtcgatcgattcgcgcgggcgtggcttccttttttgttgggcaaagagaaaaaaaagggagatcctttgcatccgctttagatcgccttttgtgcatgcctcgcgtgggcgcagggaacccacaacgacggcgatatcctcctctctcgcatattttcatgatgcatatgggtgtataaaaattttcacgcgtttttgtgtgcgtgtgttcttggtttgggattgggatggcatgagagctgatcggtgtgattaattatttttgcttgcagatggacgccgccgtcgaccgcctcaaggatgggttcgccaagttcaagaccgagttctatgagtaagccccccttgcctatagatggttaatttgagaagaatttgggtagccgcgcgcgcggcgtgagatgaaactgacatgatcaccttgctgtttgtctttttgtctcctccgcagcaagaagccggagctcttcgagccgctcaaggccggccaggcacccaaggtacgctgctccgtccatttcctgctcaaaatttgttcttctttgtctactagtgagccaacccagccagctggagttttacggttactcctccatggccgctacaccgtccatccctcagctcgcaaacctcgtcagcaaaagaaaagccccaaccttttacccccgatctctgcggttgatttggggattcgtgaacacaccttggcccacagattcctaccggtctagatactactgctactcccaggtagaaagtacacgcatgcttgcaacctgcaagcaaggcaaccaggcaaagcatatagccttgtgtttgcccatccggtgtacactgtttacggtgcccacagcatatatggccatcaaggtcaaactggacaaaagttagcagcaactggcctgtccaagttgcctggccaaagttatataagaggatgaacagcttgtcgccggcctgttaggccggggctggctgatcagttatatacgaggatatgataagtacaaccaagattataaaaagagagagggagattagattagattagaatgctccatttggcaggcgtacgcagcgcaatcttaattagtagctcgggtattggtaggccaggcaaagaagctgctgtagtagtggaaatccttcctcataatgcacgcacccaccaccgaagaagacgaggctcgcacctagtaacatgcaggatttcttcaccgtcccccatgtgcttgcccatgttgtgtttccgccgagatgtcgccttcctcgtatagggtttagcatccatcatcactactgttttccttttgatttcttcgttgcgtccagcttaattttagaatagtaagagcaagtttaatagtacagccaactactaactccaattcatatatagctaatctagaaactcattcatacaatagttacatactacactactaatacctgatcccacctgtcatacacacactgtgtcttggagtccgtgctagagctggctacaaatttatagcccactgcttttctctctttttatttagcttcttaaaatatgtttacagctagcttatagcatgctattgtacatgctctaataagctaattaggtcgtcgatcgaggctagggtctcctggcagcgcctcggtctaaattggcgtacgtcgtcctaacatttgggtacaaaaatttggaccggccggcaacctcgctgtacgtgttgatgaatttcaaagttcatttggacacggccattctcatggggatactgcaatgatgcccaaattaatttgggcgatatcatcgtctttgctgaccccacacaagctagaacgtaccgtgaaccacaagttctcttttgtttatagcaacggagaagaaagaaacagtggataaagccttgcagcttgatatactccatactatagctgtagctaagcaaaagtatttcctgtacgacatggcccggaggacatcacataattgtgggcccagcaatcacgcatttgtttgcacgtccaactcaacagcctttaacgaaagtttaggcgcatatccaaccttttgcttacactacattttggcatctgcctcgctatacagtaacttggattggccagccacacgcattgatgagcaggtgcaaaagtccagcagtttgcattacaacatgcgtacatatatactttattaatatcaaatctcctctcccggaaaatgatggcccccatccaaaaacattaatctacgccgcaactgactgcctgctgctgctgctgccgtaagcccgtaatcgatcggccccggcaatttgctaaagggtggggcctgatcgccatgagcatgctttggatgcgtcagctcgcgtcttaatctaatgctcggttatttggccgtttttgtctccgtcggcgttgtcgccagtgggatcgttagttcattaggattagtactaatcagcgcaacagttatatgccccccatgggccatgaactcatactcgtccgtgtcgtgggttatccttgcgtatccgttctgttttctgggtggaaaaagtggtcagggaaaacagagcagacaggtcaaaaagctggcagctttgggggcaagagaacgggaaaaaaatgtcagattcctgtgggggttgtgggcactcggatacgcctatcagcatctgctgcctccttatcgataagagcagtagtggtagtactagtagaacagatgctaatcgcctaatcctaatatgcttattgatctcctgatatggctgtgtaatcgcaaaattactactccactactagttagtgtggagtaatgaactgagctgattgttgggacaaatgcagtacatggtgttctcgtgcgccgactctcgcgtgtgcccgtcggtgaccatgggcctggagcccggcgaggccttcaccgtccgcaacatcgccaacatggtcccagcttactgcaaggtaaccaacttcatcgtacgcgttttcgtcgccggccggtcgattggtaagctagctattccggtcggtcgccgcggtttgcattgattttgacccccctcgtgtgtgtgcgtcaactgcagatcaagcacgctggcgtcgggtcggccatcgagtacgccgtctgcgccctcaaggtcaactctctctctctctctctcacagatagtgctctattatgtcaactatatagtacccgttgctctaattgtgccggcaacttcacacaccggatcagagaaaaatattttcgtacaggctgagaaaaatgggtcgtgtctgacgccagatggtgtgtgaattattttattgatcaagaagaatcttcccttccccacataatccatccagcttaggtttatgtagggtgtgtaacattcatggtgaaggtggtacttgcgttacatatgaatcttgtcaaatcaagcagggagcataattagcgcctttgtttagtatatttggacggtgttagtaggaaagcaccgtactttggtgaaatctattttatgctcatacagcacatgtatgcgtaaagtgtgcgtgcacgatttgattgtggggtattgacctggatcgaataatctgcaggtcgaactcatcgtggtgattggccacagccgctgcggtggaatcaaggccctcctctcactcaaggatggagcaccagactccttgtaagttgctgaacaaaagaaaacttagtgatagtactatagtattggcaacttgggcataactgtatgcagacaaacaaagggttgaagaaataaaaatgttagcgtgtcttgatcatcgtttgtttctgactcgggtttgcactttgattggttcagccacttcgtcgaggactgggtcaggaccggtttccccgccaagaagaaggttcagaccgagcacgcctcgctgcctttcgatgaccaatgcgccatcttggagaaggtaacgcacgtactagtagcatgacaaccactatgcataaatcaaaatgttaaatgaaattggaacatcagaattaattacattcataggaaggacaatcgaactgtctgaaacttgcgttgtctattcaattcagcactgactgaatttctgcgtccctgatcaaaacaattgatctgatgatctgcaggaggccgtgaaccaatccctggagaacctcaagacctacccgttcgtcaaggaggggatcgccaacggcaccctcaagctcgtcggcggccactacgacttcgtctccggcaacttggacttatgggagccctaaatccgaccgtccgtccgttcagttcgtcagtttacgccaacgcttttgcataagtactacctgaggatatcgtccccgatcatcgatgtgaacgcgtggagtactactacgtacgtaccggatggttcgatatatgtgaatgctgtattaagtaataacaagaaatatatctcctctactttttcctgacgcggagttgtactgcctatgatgcataatttgatcgcagtgtgatcaaaagacatcagctataatgtcttaataatattattatgaagagtttacctttttactaccttttactctggtatttctcgctggcgccagcattttcttttggtgtgcaagattgtcaaaaagctagatatcgcgcaattttttttctcataaaaaaataataccaaccatcatccacatgtacaaataaggttgtgttctttcatgggtgatctggtgattgtgagtgagttttgtttcgtttttcgcgcacacgcttccggaactacaaaacggtgcgttttttgcgaaaaaaaactataggaaagttgctttaaaaaatcatattaatccatttttaaagtttaaaatacttaatagtcaattaatcatgtgctaatggctcacctcgttttacgtatctttccaatctcctctatctcctctcctcaaacacagcctaagaagtgatgataagtagatgctataagaagtgatgataaatgcatataaagaagagaataactaaaatggtgcttctatacatcacccctaacatgagttgcattatattccaaaagcaaattagcatccatccctgggtcatgctttaatagctatcaaaattgtatcaatgcttaattcagaacataattaaggttcattgctgttgcaggctaatactaactgattatttgactatatagttctggttgtaatcggaatatatatacacggtttatagctcaatatcatctttttactaatcaaagaatatttcgatcaaaacaatttgccacctttcaacatttaatatataaattaggcttctgcccaactatgctgaatcgtgaaacaatattaatctacaattattaacgtgctttagttgtcgcatgtcaccagtcatctaaaatggtctatatatatatagcatatactcccttcattccaaattgatctacatatagttttttttaaggttattcctaaataatctatatatttgtgttcattcattaagtctattcgttatttgtgcactgaagtaaatagacattgatgcatgtatccatgcacacaaatttattacctacatacaatatcttgatttgctattgactaggaaatagtggggatggcgcatgcattgagtttgttgctagagcctagagtaaatatagtatgagagagttattagcttttcttgatcttagtataactataaaatatgtatatcaatttggaatggtgggagtactatcaaattctccacgttggattgttggtaggagctaagtgggtcttttacaagtgcctagttgaaacacattgaattgcacgatggtactacctccgttcctaacagtttttaaatgttctaagataaacaaaaagtttactgcttatatatatttaaaatgcaacatacaccttactcccttcggttctataataattgacgttttggacaaggttgaggtcaaacttttataactttgaccattaataacttcaaaagtatttagtttaaagaaactagaacaacatatatagatttgtctttcaaaacactataataaaagttaacatgcatttatttattgtgtatattataatagaaaaataaggtcaaaggtatattttgtagaccgtgtcattgtctaagacgtcaattaaaataaaactggagggagtatgagttatgacacggtatctccttaggtatataatttttcttttagaaatataaagtgattaaagtttaaatataaatagtagccgataacaagaatatgtatgtgggaacagagagagagagcaacatagcttcaaaccattgtgctatgctggctaaatttagggaattggagatttagctgcaaattcagatggagtgccatgtatacctttttcttcctagactgtgggctaccacctcaaaggtctcatgcatttacttcaaaatacttaaaattaaataattaaattgaatctgaaaaggcatcacctacaagtgccaattagaacaagaacatcgagtattttttttctaataaaaggataatataatagtaatttgcttatgagtttcataattatagagacccctttctaaacactactaagtactaccgtcgtctcaaaataagttcatttttggtttctgtgtccaacatttgatatctgtcttaattaaaaaaattagaaaacaaattaatcacaaataaagtacttttatgttttatcatctaataacaataaaaacattaatcataaatttttttaataaaataaagagtaaaacgttgtatccaaaaactgaaaaatgaatttttttatgagacaaagatagtaaggcttcaaaccaaagtatcctaaaactagtacaatttgataataaaaagagtgacaaaatttagctttagtatatgggttgaaagccttaacaaaatgtgccaaaatttaatattactatattctgttagggttaatagtggcaacaaaccttttatgcctcttttgccgtaacaatttactgaagaaaaaaaaggggagaaatttgataggctcagcaaaacccctgtccgattcccgttccgcacccgtcggaatccacagtagcactcgtcgccatgtccggctgccgccgccgccgccccagccaaccctatcccggcccctcgttactcttcttcggccgccgccggccgtagctatgcgcctctgccgcactaaccctcaaccccacttcccttcggaaactgatctcctcctactccccggccgccgcggcgccgtccacctccagactccccgcatggcatgccggagttacatttgggggggaataccaaataggcgaagccccaacctctttgggagccagtctggctgggaatgtgttctcgattgatgtcgacgacggccgccaccgactccctgaccgcctccaccccgcagccacggcggcggcggcggcagcgccacatatacgcacgacgaaataaggtactcgattttccttcttgcgtaatcctgcagattgatcctgaaatttatccgcaacctatttaaatcctctgaaacctatacggttttcgttataaatgccgtaaattaagtcaagttaacgtatctgttgcaattgcaaacgaagaggtagagtccaagtgattttctgatttcacccacgggcctatctgtttcatggctactaggttcagagtttgcctcctcattagtgcgcgcttcttcttcgtttgtcgccgatcgtttttgttcgtatagcgactcgcggtcgcggggacgcatcgaggatgggtgcctgctgctgctgcttcccggtctacaaacccgcgagggagaacccgatgcggtcgaccagagagtcactcatccagcacaagccgaggcctaccacgccgtaccatccaccaccacccccgtttatcacctacactgacaaggtcgatttccctttctcattgtcggtatgatcctcctgttgttgtcgctgatgggccgcccttatgtcgtgttggctgcttgattcttgcagggcatgaacgctgtcgagcgcttcaagactgggttcgagaatttcaggaatactatatacgagtatttttctgatgccctgagagttcgtcggtgtgtttaatacgattttgtgctaaatcgaatctatttgtttttgtcggttttcagcaagaggccggagctgtttgagcggctcaagactggccagtcaccaaaggtatagtgctgccatcagattaatagttttatacatagattatgaaacctataatttgttctttccagcacacatagaatgcgccggcataatttgctgtctctactaagaattatgccatttggagggtgcatacctcacattacgctcttttggtttgtttgtggactgaagtcaaactcgactaaggaattctgatgggaacagctcattaccattgtgaccattgagcaatatatattgataaaaaaaatagttgacaaaattttcatcttcagtacaaagtactagtggaatttcttcaaaattctacattagaggaactaacatgaacaaaagcacagagcggcttactatagatgaccaatgacatggttcctgcatatgttaactttttttttttttgaaggacagacccgtctaaataaatgaatatttttgttttcttattctattagcttgcttaggttctaagttttttcctttatgacttgcgtgagaagggctagagatgtgatttctagtgctgtagagtgtcatgtggggaatgcactacgtccgcaggcgcaaggatcagcgacaacagcaaaacggcaaacagtagatatgcaggatttgttttcgtttgtttcagagtctgttaaagtttgttagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaacttggtatcagattcctctggttccgatccaatggcctctactcagaatcaactcgatgaaatcgcgaagaacctcacctccatggcggcgcaaatctccgatctcgccaggaagatgagcaccttggagcccctcgtgccgctcgcggcaaaactcgacaagctgcctgatcgcgtcacgcaggtgcaggcgtccggcttcgagtactcggagcaagtccgcgctctcaacctcgccgtcgagcgcgtcgagcttcccagcgcgcggccacgacgaacccttctggtttggtctcacgtcagccacgcgacaacacaccgccacaagatgacgctgacgcacgctcgcgacgcgaccaacacggcgacgacaccgcgatcgacaacagcttccttcctcgcgccaaactcgagttcccgacgtacgacggcaagggcgacccgctgccatggctgaaccgctgcgagaccttccgcggacagaaaacgccggagacacgcaaggtgtggtatgcctcattgcatctaatcggggacgcccagttgtggtattacaggattgagctcaattctggcgaaccgtcgtggcggaggttcgtccagttggtgcacactcgtttcgggccacccatgacggacagcccgctaggcgagctcacggccctgcgtcgcactggcacggtggagaactacgtcaacagtttcctcgccttggcgtgccgcgacgtcgagctatccgagtcccagcaggttcagctcttcacggctggcctcgtcaacccgctcaagactgatgtcgccctctgccgcccgcgatcgctggacgacgccattatgctggcacgcgcgtacgagcagcgcgccacccttggcccgactgatccatccgcgccgcgcacgggacgagtgccgcggccttcactgccggcgtcgtcggccgcatcc

SEQ ID NO: 19154 - DNA, 23370 bp, Oryza sativa
  unsure (1)..(23370): unsure at all n locations
ccctctacagcgccgccccggcctcagcgtagccgtggccaatggagatcgcgtgccgtcaccgggcaggtgcccgccacagcgcgtctccatcggctcgcacgagttcgacatcgacttctatgcactcccgcttggcggctacgacattgtgctaggtgcacagtggctcggcaccctcggaccgacgctatgggatttttctcgacaatccctcgccttcggacccgcccacgaccgcgtcacgtggacaagtatcgacgccgcaccggcgcccgcccttgctgccgccatcgacggtcagccgggcgacctcatgaccgatctgctcgacgtcttgaaagacctcttcaccgagccgcacggactaccgccagaacgccatctctgccaccgcatacgactggaggcaggggtatcggctgttgcggtgcgcccgtatcggtacgcgcacatccagaaagatgagctcgagcgacagtgcgacgatatgctccgccacggcgtcatccggcccagctcgtcggcattctcgtccccggctttgctgatcaagaagtgcgacggctcctggcgcttctgcgtcgactaccgcgccctcaacgacaagaccatcaaggataagttcccgatcccggtcgccgaggaactcttcgacgagctgcgcggcgccaaattcttcaccaagttggatatgcgttccggctaccaccaagtgctgatgcatccggacgacgtgcacaagacggcgttccgcacccaccaaggcctctttgagttcttggtgatgcccttcggactcacgaacgcgccggcgacattccaagccttgatgaacgacgtgctgcttccgttcctccgccggttcgtgctcgtcttctttgatgatattctaatatacagctcgtcttggtcggagcacctccgccatgtacgcacggtgttgcaaacgctgcaagatcattgcctccacctcaagcgctccaagtgtgagttcggcctcacctccgtcgcatacctggggcatgtcatctccggggacggtgtggcgatggaccgtagcaaggtccaggctgtgctggactggccggtgcccaagacggtgcgcgctgttcggggcttcttgggcctcgccggctactaccgccgcttcatccgcgacttcggcgctatcgccgcgccactgacggcgctcctccgtaaagaggggttccgttggtccgacgaggcggcagcggcgttccgcaagctgcaacacgctttgacggcggcgccagtccttcaacttccggatttcaaccgcgacttcatcgtcgaatgcgacgcgtcgggtacgggccttggcgccgtgctccaccagggcggcggtccagtcgcgttcttcagcatgcccatcgccccccgtcacgccaagctggccgcctacgagcgcgaattgatcggcctcgtcaaggcggtccgtcactggcgaccgtacctctggggccgccgcttcatcattcgcacggaccattatagcttgcggttcctgctcgaccaacgcctctcgaccattccacagcatcattgggcgagcaagctgctgggattcgattttgccgtcgagtacaagcctggaacggccaatgtcgtcgccgacgccctatctcgccgcgacgaacacttggctgaagcgtttgttctatcggcgccgcacttctcgctgctcgacgacgttcgccgcgaggttgcctctactccatccctggcaagcctccgcgacgacatcattcgcggcgctaaacccccgccgtgggcattcaaagatggactgatcgtactcaaggatcgggtgtttatcccggagtcgtcaccactgctacccgcggtcctggagttggcgcacggccacggccacgaaggaacccagaagaccatgttcaggctccgcgccgatttccatgtgccacgcgatcgcgtgctcgtgcaagatttcgtgcgcgcctgcctcacatgccaacggaacaagacagaacatcttcagcccgccggtcttctccagtccctcccggtgccgtccgcggtgtgggctgacatcgctatggacttcgttgagggccttcctcgcgtccatggcaagacggtgatcctcacggtggtggacaggttctccaagttcgctcatttcatcccgctgtcacatccatacacggcaaccacggtggcggcagcattcttcggcgacatcgtccgtttacacggtgtgccgtcctccatcgtcagcgatcgggatcccgtcttcaccagcaagttttggacggagttgtttcgcctcgccggggttcagctgaatctgacttcagcgtttcatccacagtctgacggccagtccgaggtcaccaacaaaatcattgcaatgtatttgcgctgtctcacaggagatcgtcctcgtcaatggttgaggtggcttccgtgggcggagtattgctacaacacgtcatatcaggcttcgctgcggacgacgcctttccatgtagtctatggccgctcaccgccgagtctgcgttcttatgagccggggagtacatgcttgccagccgttcagcgctcgatgcaagatcgggatcagtttttggtagccatccgtgatcggctggagcaggcacagcaggtgtacaagcaggcctatgacaagaagcatcgggagttgaattttgatgtgggcgattgggtttggctgcgccttctgcatcggccgatggcgtcgctcgacacgaggggccgtggcaagctggggcctaagttctatggtccctaccagatcgtcgcttgcatcgggtcggtcgcttatcgtcttcgccttccgccaggagctcgtctgcacgacgttttccatgtgggactgcttaaaccgtttcggggtgagccgccaagcactctgcctccgttgccgccgacgcagcatggtcaagtctgtttggaaccacagtcagtctcccgcagtcgtttggctcgaggagtccgtcaagtcttggttcagtggaagaacaagccggcggcagacgcatcgtggttgtcgctggatgaattccgtgcattatatccggatttccagctcgaggacgagctgcttctcgagggagggagagatgtcatgtggggaatgcactacgtccgcaggcgcaaggatcagcgacaacagcaaaacggcaaacagtagatatgcagatttgttttcgtttgtttcagagtctgttaaagtttgtagtttgatctttatctctaagagtttgttagatggcattgtaatctttacttaaagggccagtatggcgcatggaataaacaagcaatcagaaaaccaatctatcgctcctttcctgccttgctagtgcggcgccggtcacggcacctccgcgccggcgaggtccaggaccacgcccggttacttcgttcaaatactcccttcgccgtaaccctccttccaatctcctagcccgtgacaagagtaggtctccacaaaaaaaaaaggcccaaaatcggcaccacattttttgagaaatgtttcctcataagtcataactgagtgatttgccgatccatgatttatttggtatgattgtctccgttttgatttggcctggattaattgttctttcttgcagtacatggttttctcgtgtgctgactcacgtgtgtgcccaacactgaccttcggtctacaacctggtgaggccttcactgtccgtaatattgccagcatggttccagcctatgacaaggttcatgtttatgtacattatatcttgtctttcttcatgtactagtcagtaactttggcctgtgtattccaggtgtaaattactaagccccgtgttttcatgttgattgcagagagggcagtgcagcattgggtcagccattgagtatgctgtggttgtcctcaaggtcacatcttccttgcgaataattaatgtccttctaatctaagtcgcatgtttttttggtttaggaatagaacggcctcatgatattttgcagttaacttgtattagttatagaaaaggagagcagtggatatcgtagtatcacctgcaataaaggcacatccccattatgtcgaagtcataaacctaactggtgcacttgtaatgtgataagtggataaattattacccaatttcgtgatgacatcatacacaagacctttgtttggaaaaggagattaattcctgtttcacttacccttctctaatttgttctagaaattatcccatagaagtaaagaagaatcttgcgtcccttcaagggcatgtgtaggctctctctttcatttggaaagcatcctgtcaaatgcaaatgggtttaccattaggttttgtcggggcaatgtatacacaaatcaagtacccctggtatgatttagggagtgaacttctgttttgcatttcgaaactgtatgttctttgaaagttttagaaagaatgtgcatacacatagcagtgctagatatttgtgcgacaaccatcatacagtccacttacttccatattatgaataatagagtctgtaacattcatcatgtgttaaatgattctagcatggacgagttagctttcagattatagctgtaattcggagttctgtagagcactatagctgaactccgttagctgtatttattctcatttaaagtgcccaaatggatatggaagaattccactctagaataaatttggtgaactcacacattcgccccttcaacagttaacaaggatcttattattctccatgaaaggcacatgttgacagacatccatttggcaggttgaatgtatcattgtgattggtcacagctgctgtggtggaatcaaggaactcctctctctgaaggaagatagacctaacaccttgtaagtgaacatatccatactcggttcaagttttttatatgctgaaagcagtcaaaggattcagataagaccatacttacatgtccaggaagaatctgtcccacccaaacaaggccaagaaggaagaaacattttaaaatttaaaataaaattactgttgtataaatacgcttctttcacctatccctttttgcaatctcatttttgtttgattacctagccacttcgttgatgactgggtcaagattggtctggctgcgaagaagaaggtcgagagagaaaacatgttactgccttttgacgaccaatgcaccgtgctggaaaaggtattattgcttggaacaacattatattatttctagtagaattgaattgtgagtcttggactaagggttcactgctttgacccacggacattgagcaaagcgggctaaaattccctcacgccgatatttgcttatctgaataatgttaggtttgcaagttaactcccatggaactgagctttactgtgtggatgtaacttttttaagataatggaaatggtttacattttcgggtcttccgtgttcgtcgatagcgacacatccaataagtgtttgggtgagctacagagtgacaatagattttaagttgaatattagcatgctaaatattaataaagtgaattgcatattgggctatttattttttatcatgattttagattggaccacccttaatccaatgctttcgcattaaaccagattttcttaccaaaagattgcagttaggaccagtggctcacttgtcaatattgcctctctctcatctctctggtctccattgatggctcgtggtcaaggttgaggtcaagctaatgccggtgtacgggagcagaacctcgagcgcaaggttgatgtcaatgaagcttgagtggaaggggaccttaagctcgacctacatccacaccgtgtcacgcaagcttgaccttcgtcatcgtcacgcttggcatgggctcaatcacgacctccatccacacagtccctgggcttgagatcctcttcgcctgtcaccccgactttcgccccgccgtctcctggctcgcgatcctctccaccattgtcttcctctcctctctagctcaccctcgatctcctcgcacgccatccctagactcgattcctctccgccagcattggccccaagcttgacattgacttctgcttgtgcaatccttaggctcgtacttctgcgcgcctgccttggagtcatgaggactcgccagagtgatagaagaggaggtcgatatgctctctcaagctcccatcacgatgcttcgttttttagtccctatttaacctcactgacaggtgggtccaggggcagagccatgattttaggtcgatggtgtcattcgtcggctctaattgacgatcatggtttaagtgaaacagaaatacatatgaaaaatacaaaaaattcctcgcaatagtggttgctcaacctatgtttcaccaaatcactcaagaaaacttatgatgcacgaactttatttagacattgtgcatagtcttgttgaattagccgttgtgtatggtcaaataactataaattatagtttgctagcagttattttgttgatgctgtcaagttgtccatgtccacataagctaaattgtctaatgaaagtgcaaaattattcacacgttggtgtcacaaatcaaaatttactagtgtcattcattgaaaaattagaaggataccttaactaatagatgggtcattgttgtccggtgacaccactgcttgtatgccagctccacccctgggtgggtcgttagtccaaagtgtaaccttttggcaacaaagtatggtgtaaaatggaaacgttaagggaagaatggttcaatgtaaatctaaggtaaaataatataacccaatatgcaatttactatatattaataataatacacaccttattcgtcttaataaaaaactaaaaattgactatgaacgatcaagatcgaaccgacaattttttttataaatatctaattatgtgttatgattagatttctaatgataaaagaatactttattaatatcctatcgggagatatctattactaaactgtattgagggttgaaacatagtcatcacatttgcctctaaagtctaaagaactagaaattactgagtatattaagagaggttgaaatggagtcatcacattcaccgtgcgtctaaagatctagaaattattaccaagttataaattgaagaaaatgatatatatatatatatatatatatatatatatatatatgtatgtatatatatatatgtatgtatatatatatatgtatgtatgtatgtatgtatatgtatgtatgtatgtatgtatgtatgcatcatttgatcatggtggggtctaaattatggttcttaagattcataaatagagttgtctgccaaaaatatagagattatatttatgaaaatagaagcaacaaaattgtatacaaaatagtataagttatttatggaagcatattatgtaggatcaggagagcgtcgatgagatgaggctaaatgatcgcatatgtttcctgaaacaattagccattttaattgttacaagttacaacaaacaatacctttgagacacatatatgatatatagccactctagccttacaaactagaaatgtgcttttaagagagtgcaattgagttttcaaaaaaaaaaagagagagagagagagagagagtgcaattgggcccacaactaagacatgccatactcacaccatcatatacgtgtgtatcctctacagacgcctgaagtatcaaatgccctcatgacgtgggcatctgcatatataccctacaaatgccccaatgtgtactcctaattagaaaagaaagaatgttttttttttacgacaagaacaacgtatatctcatacgcgtcccacttatttgcacaaatatatgtaattaaaagtttgcatgaggatcggagaagcatgtgagtagattgtcgacggcctggtcaatcagagcatgcggcggaagagattgtccatggagatgagcgcgctggcggccagcgcaaggaacccaaggaacgatagccaaactgcgttgttgatttttgtgttgagtggctccttgccgaacgcggccgtcgacgaggctgacattaggaggtacgccaacacctgcagccaaatgaaaccaattagccgcgcgcgcgtgtgcgctgaaaaacttctgcttctccaacacgtatgttgtgtttagttcgtgtgccaaattttttttaaagtatacggacacacatttaaaatattaaacgtagactaataataaaataaattacagagcgaaagggcctgtagcctagtggttacagagcgaattttctaggatttaacggcgttgtggtttcagtggtaggcgacgtacccgtcgatagagaggcgtctgtggtgacttcgtcaatctcttcagaatttgtcggcccagtcttcgaagatgctcataggggtagggtttgcgtgcgtgtgttcataggggtgagtgcgcgtgcgttgtgagtgtctgcgttgtactgtgtaattctcaaaaaagcccagtcttcgaagatgctcataggggtagggtttgcgtgcgtgtgttcataggggttatgctcataggggtagggtttgcgtgcgtgtgttcatgggggtgagtgcgcgtgcgttgtgagtgtctgcgttgtactgtgtaattctcaaaaaaaaaattacagattccatgtgtaaactgcgagacgaatctattaagtctaattaatccgtcattagcaaatgtttaatatagcaccacattgtcaaatcatggcgtaattaagctcaaaagattcgtctcgcgatttacatgcaaactgtgtaattgatttttttttcatctacatttaatacttcatgcatgtatcaaaacatttgatgtgatggaaaagttgaaagtttgtagaaaaaagtttgaatataaatatggccgtagctttgcaatggcgcattttgagcagaagaattgatgggttgatagatgtttcaaaagaaaaatgaagaaccgatgtattgtgtgtattgggcttgcctgatccaggaagaggctgacgcagtaggttatcgggttcagagaagcagcaaacctcggcgaaatgaggcgcccgatttcgaccactgcttgcgcggtcgagtagacgcagactatcagattcacaccgagggcatacctgtcatagtacattggcggagaagagagaatatttttaactaaaaaggataatagatgaaatgagaagggtgaatagtaaagtgatctatgtggataaaataaaacctgaagaaccaaattaaacctttggtgaaacttaaaggattagattagttattcacctaaattaaaaaggagaagctgatcactttgtagtgaagctaggaactggctagttcctttggggatcacaccgctagatccaccgttattcgactcctaaccaatctacttctctctctactgtggtcaagggcagcggtgccttgccttccatggtcatcctctaaagctgcccctccattgaccacccttacacatcaacctctaaccctgataaatctattccgttgtgtttgctggatttcggaccatcactgttgttgcaccatcgccggaacaagttgtcgatgagttcttctacttgctcttctgcttcttcatctattctatctagaggttgaagaagactctctgctccctggaccttagtcattaatgaatgtgatggccaggaaaacatttgggtggctgtgtttagatctagggataaaaagttttagcgtgtcacatcagatatatggacacacatttgaagtactaaacgtagactaataaaaaagggacaattgcttatttgaccctgttttgaagtctaactaccaatttgaccctattttttttagtttgcttatttgaccctgcttttcaaaaacgaaccttccgtctgaccctgttttcttaacaccgttaagatttgatttaaaaaaaagaacgaaatataattaaaatttataatgcccaaaatacccttgagaaaaccatacccatctctaaccctatccacatgtctctccatgtctctctctcctgccagcgagttgcagcggcggcgtcggcagcgtcgcgcgcagtggggagggaggcggaggtccggcgcgcagcgcgggaagaaaggggacccgggcctggcggtggaggtggtggcgcggcgtctgcatcggcgcgcaaggagggaggcggaggccggcatcgacgaagggagggaggggagccgggcctggcgacggagacgcgccggcggcatctgcatcggtgcataggaaggnaggtgnaggccggcgccggcgaaggaagggaggaagccggggcctggcggcggtgcggcggcgtctgtatcagcacgcaaagagggaggcggaggctggcgccggcgaaaggagggaggggagccgggcctggcggcggcggcgtctgcatcggcgtgcggggagggaggcggagaccggtgccggcgaaaggagggaggggagccgggcctggcggcggcggctctcggtggcatcggcgtctgcgaaggtggtgcggtgacggtggcgtcggcatctgcgcgcgcagcggggagggaggcggaggttggcgcgcgaagaagggagggaggggcggcggcgatggcagccggcgccggagggaagaagcgacgcggaggaatgaaggaggcggcgtcagaagaagaagagagaagagaggagaggagaagagagaactgacaggtgggtcccacatgtaatagggtcaaatgagtaagggcaaaagggaccttttgtgcttcagttaacaccgttagtagcccttaacagaatagggtcataccgtatctttaattctgaaaataagggtcaaataagcaaaattgaaaaaagggggtcaaattggtaggtagttttcaaaagagggtcaaatgcgcaattgccccaataaaaaaactaattacacaatccgttagtaaaccgcgagatgaatttattaagccaaattaatccgtcattagcaaatatttactatagcaccacattgtcaaatcatagagcaattagtcttaaaagattcgtctcgcaaattagtcgtaatctgtgtaattagttattttttagcctatatttaatacttcatgcaggtgttcaaacgtttgatttgacacggcgtaaaattttagggtgggatctaaacaccccctaacttttattgtagaatatttacaaaacctactaacaatgcttggtcaaggaaactcctgacctaccgactctcatttccaagttctaccggtcgtaaccaacatagatgaaaattaaaacagtaaaaaatataaataaaaaatggaaaagattttgctatttccaaattttaccttattattgaggaaattatcctttttataatatagcaattactgtattttaaatacccaataccatgattgaggtctctatttaatccaaattttagagtaccatcaatttctcaatgaaattccaaacttgggtgcaaggctaaaagagagacaatttgtaaaaatatgattttacaaattaatgtttttgacgttattactagtttccgatcaattataacatgttttcgttcgtacagttccatttttcaattttcccgatatttcggatacaattttaattttaatttttatcatgttttatcccatttccgagaaaaaaaatatgattatggcaatggttgatttttgaccgtttccatcccaggctataatatagaggaagtacttaattttgagataaatctacatacaactatacaagggagtattgctagcatctagacttgttgcatgttaagaatgcatgatgtttagacgcaacaggcaagtgatcatgcaataacctgtagtactgttcgtagaggtcgtagcggtcgctgtcccacccggacgtccggacactagccatgagcacgaacgccggcaggctcagcaccgccgccggcacccgcagcgccgccgacagcgttctcctgtcccccgccgccatgtctcgcggcacgtccgggacgacgtcggcctcggcgggcggcgccggcggctcttgatcgaccacctgatccggctccgggacgtgcttcgtggcgggcggcggcgcctcgtcggggttcttctcgaactgctcggcctgcttgaggtaggtgtccatgtgcggcgtggtgtagagccggacgccgtcggcttggcccctggtggcgacgcgctggcggtcgtgggaggcgagcgaggaggcggcgtagggcggccctcccttgttgtagaggtactgcctctccatgagcccccgcagctgccgcagctcctccaggagcatggccaccgtcgggttcgccgcctggttgaaattctcctccagtgccttccgcgcctcctccagcttgttccgcgcgtcctccatcttgttggcctcggccatgtccctggctgccctgatcatgtcggcgtgctgccgccgggccagctcgttctccaccggctgtggcttcctcgccgcgcctggtgcagcactcggtctgcgttttatggtgatgagatcggggttggaggtcacctgctgggcctggaaggtgaatctgtactgtgccaagcagacattggcgtcgtacggaggggaggcggtcttgtcagcaagcgcgaggtagacgatgaccctgcgcgcctctgcgctgtaaagggtgccgaagctgactgtgacggaggagccgtcgctggcggtggtctgcgggtaggtccccgcgtccacccagaccaccctcttgatggtgacctcgccatggaaccgcgtgacggtgagctcgaggtcctgggcgatgatggtgaggaggccgccaaggagctgggagaagggccccgtgaggttggcgctgtcggcgacgtagttgaacgtcccgccaaggctcttgcgcgcgatcgcttccagcaggttggagtcgtggctcgcgccgaagctgaaggtgtagacggggacgttcttgagatggacgtccctggcgtcgccgccgtggttctggtagccgtcggacatgagcatgacgctgacggcgcggccggcggccagactgcggccgtcgacaacgctcatgccggtctcgaggccgcccttcatgttggtgtcgccgtaggccttgaggccgtcgacgagggccttgagctcggcctgcgcggccgccgtgacgaagcgcagcgggcagaggcgggtggcgttggtgcaaaaggtgacgatgcagaggcggtcgaggtcgctgagcttgcggatgacgaactgcagggcggtcttcaccttgtcgatcctgtccccgtccatgctgccgctgacgtcgatgacggcgacgaggtccaggcccgccctgtcggtggacgaggaggagcccctgagctcgagcagcagctcctggtcatggggtgccatggacgcgacgtcgttgtggtacttgttgagacgcacttgcttcaccagttggcccgtgatccccaccgtcggcctcgccggctcggtggcggtgctcgtcggagcagtctgctcgtcgtcgttgtacgccatctcttcgcgatcactagctagcttcttggttgttggcaaaagcagctagctctgcgcgatctctatatatacagcactccacggcactcatcacgagcgtgtaacttttacagcggatttgccaaaaaaacttccacaagtttttttcccccctaaaactttcggatttatgaccatcggatcatcttgagatttatacatgaaggaaaaatattgctggaaagaaatttttatacatgttacgcataagatttcagtactacctaacctaaccaaagcgcagttgaatacaagttttatgtaagttataccgtaattgcaacgtagttataatcaaggttgacaatttcaaatttggactttatgccaagggttactgaaattttggaaatttcggaacgaaattatttgaaattttgattgattttgaatgaatttgaataaaatttgaccaaattcacaaaaatttgcaaaaagccaaaaatttcggatgagatttgagcatgccggcggggggcgagattaccgaaatttcgggcgagatttcggaaatttcaaactaaaatttcaaaccctggttatagtgcagctacatgtaattacacttcaattatactatagttacatctgaaatttttttactagaaaaacttacggcagttttttagatgctctccaccgataatacaataaattttggctttgtttcaagaaaaatcccaaccatgagcacaaaccatattctccataaattaaagagcacaaaatgtcacaagtgtgttaataagcgatgacatgcccatcaagtgaattattcgttatattaggtgagagtattttcatccttgtagacaattatatctcctatatagtcatataactttttgaaaacgtgttcttccataataaatatgcaagtttgaatttgacatacacaactaaaaataaaaacaacaattttcttgtgaataatgcactattcgcattcaaatatgttttttctcctcgtaaatgtcaaatttaaagttgtatatttgtaaagatattgtcacgccccgaactagccccgactggaactagcccgtgacgctccaaattaacctgttaatcgataccagtcccaggaaacagtgctggtatcacaggaagacagaatatcacaactgcaatacaaaaggggaaacggaagccaggacttggaccaatcatcacaggcgcgacttgggaactaggccgaaaccctaaaactcatcgtagccggcttgctcctggaagaactccacatcaacaggatccgcttcatcttcttcagcaactgggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttctcaaacgacacggatgagacagtgcgtctcgtccggtcggagtatgtgcaatgtatcagctctttagaattgaaacaagattggcacccggccaacagctttttaaacggccacccgggccaacaacttttcaaacggccacccgggcctagctgatcccgtcagctgctgatttttcagacgtcgaacccattttcacgacagcaatttcacaatcagtagtcaaacaaaactacgctaggaatcacctcacatccgcccatgaccgtgggcacgactgttcgaacagtttgttaacctctgcagagggggtacactttacccacacgacattactaacccggatcacccagcccgaggggatcagccacgtcgggagacctccaagctttcatgacaaggcatttcgaaagccgatacaggtttaccatatgccgacgagaggggtcccagaccaacaacagggtaggtcccagaccatactgtgccagcaagcccaggggtcctccccgacaccaccccggtgaatccacatgtctctcggcatcaaggctcccctgataagctagttactcagccaggggtgtcccattccacccatgtggtcgtacttatcttatgtttggatgaaattccaaggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttggtattcagattttaagtttgaaggcgtccgtcgatactcgcacggggtgcacgaatatcgagacgcaactagatggttacaaggggaccagatatagcaattaacaatggaaggatcaaatgcaacaaattgggtaagtccgccaatctgccttgcagacgggacagcagattaagtgcgatcctatcaatgcataatattttttttcaagcaacataattaaatttcaaatataggttcaagatgttcaaaggtggcttgccttgctcgagatctggagcttgatcctcgaaatcctcgcactgcgggtcttcgggctctgaaactacacgcgaaacgggacaactcaacaaacggcgaaaaaaataaagccctattaatgacctctaagcgtgccattagatagatctcgagatttggggaattttggaagttgaacggagtcaaacggatttacggttgggaagatattgaatttctaagattattggatttttgatctaaaggaaaaaggattaaattaaatcctttttgagaaaaataaaaaggaagagggaggagaagtagacttctctcgggcggctagggcgcggcccaagggaaatggagcggaccggccgatcttaacgggccggccggcccaagacggcccaagcgcgcgcgcgggagggaggagagagagtccggtggaccgggctcaccacgcgcggtcccgggtgggacccgcttggcagcggctcggctcaccgtgcggagggaatttgcggcgtacgcgcgcgggcggagctgggacgcggtgcacgcgcgcggttcgcggaggaacggatgcggcgggcccacgcgcagcctcacggctcaccgcggaccatgcgcacggggaaaaaacggagggagcggctggccgggtcggctgatccggtcgcggccgaggtggcgccgacgtggcgcctacgtggcagccacgcgggccggcgggaggtagacgacgacgccggccggaacggacggcggacgacagcggcgagcggcggagcgaaccacggtgatacgggcaacagcgagcacaccgggcggttgcacgtgacaaggggaggcgagccaacggcttggattcgccggaggttgctcgacggcggcggattgcggcggcggcaaccgatggcgggagaagagggaaacggcgacgaggtcacgagaggtcgattcccggcggtgagagcatctacacggcgatgacgacggcgctgacgacggcggtggccaggcggtcggccaccacggcacgcgcgcgcgggaggcaacgggcggcgtccacgcgggcgcgcacacgctggctcgcggggccgagcgggtgcacggctgcaggcgcgacagagcgagggaaaaggaagggggcgctcggcgcggcggctcacgcgcacgcgcgctcggcgcgcggcggggcgaaaaaagaagggcgagggcgcccgggagagagggggccggggaaagatgggccgagcggaattcggcccatcgaacccagggaggcaaactagacttttgcggaggaatttaatttggagggatttggattcggaattgaactcgacgatagatcggggattgagatcttgagatggcacggacactagacaacaagcaaagaaacaaatttcgcaattagggtttttaagagataattttcccgctaggcgccacgacggaacgggcgctacagatatattttatatttatctatcttgttgtttttttaaaaaaaaaatctttttagttacattttggatgacatgtacaaatcactagggaagacaatagttcacctcagttatattactttcctgtcccgaaatataaaatctaggagttgatcagacataacctattacaataaggatatcttgatatattgtacaaggttatgtccaatatatcttttcttaagtcactactcctttcgtcccaatatactgcaatctaggatatgatgggattatattcatatatccatattcgtagtcctcctatcctaggttgctacatattggaacgaagactgtatattttaggacaagaagagtatgtgagaagagtgggtgccttgaatgagaattaaatgaagctaggatgcacttaattagtacttcctatgtattgtacggttatttgttaaggaagaaaagaattgatctagagtagacttgacatgcaacaagatctgtcgctcatgatcaccatgcagagcaaaattttaggaactatctatatatgtcgtcgtatttttataaaaaatagtcggcatatatttatattgtaaattcttaaaattatatatgtaagtgaatataagtagatgtaagtacaatctaacgaacatatattgtaagtcagattcttttccagctcgatattacccaggggaacttgctcttctggaattcgaagacatttctttaactgggatacgtggaacacgttgtgcacatctgcgagaccttcaggtagctcaagctgataagccacttcgccacgtctggcggttatgaggtaggggccgatgtagcggggtgctaacttgccggacatcccaaaccttctcataccatggaggggtgatactcgcaggtatacatgatctcctttttcgaactcaaggtcacgtctccgattgtcagcgtaattcttttggcggttctgcgctgtcttcaaacgttctcggatcagcttaacttgttcttctgctgacttgagtatgtcaggaccgaatactagcgcttcgcccacctcattccagcacaagggagtgcggcactttcttccgaacattgcctcattcggcgacatctgaatgctggcctgatagctgttgttgtatgagaactcggcatacggcaaacaacgatcccaagtgccttcgaaatccagggcacacgcacgtagcatgtcttctaggatttggtttaccctttcggtctgaccatcggtctgcggatggtaggctgtactaaaatttagatcagttccgagagcttcatgcaactgcttccagaaccttgaggtgaactgagtgcctcggtctgacacgatcttcttgggacagccaaatctacatacgacatgggtcatgtagagttctgctagtttctttccatcataggtggttttcactagcacgaaatgagctgannnnnnnnnnnnnnnnnnnnnnnnnnaaatggagtcgtacccgctaggggttcttggcaaaccggtgatgaaatccattccgatctcttcccatttccactcgggaatcggtaggggttgcagcagaccagctggcctctgatgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcttttaggatgagatctcttaactccttcttggccggtacatagatgcgtggaccgcaccaaactgtgccttgatcgtctatggaaaaattggtgtctttcttctcctgtattctttttattaactcttttatcccttcgtcgtctttctgtgcctcccggatttgcgactctagggtaggctgtactgtcaagctggcagggacacctgactgtaccatggtcagccttaacttctccaattctctgcacaggtgatcttggtcgggccgtatttgagctacgttgcaataggccttgcgacttagcgcatcagcgaccacgttggctttaccaggatgatagtggattccaaggtcgtaatccttgattagttccaaccatcttctctgtctcatatttaactcggtctgtgtgaagatatacttaagacttttgtgatcggtgtatacttcacatctgttcccgattaaatagtgcctccagatcttaagagcatgaaccacggctgccaactcgagatcatgggtgggataattgacttcatgaggcctgagctgcctggatgcataggccacaacctttcgttcttgcattaggacacatcctaagccttgtcttgatgcgtcacagaagatctcgaaatcttttcggatatctggcaaggtaagaactggggcagtggtcaaccttttcttcatttcttgaaagctgtcttcacaggctgcagaccattgaaatttcttttccttctttaacagctcagtcataggtctggctagcttagagaatcctttaatgaatcttcgataatatcccgctaagccaaggaagctgcgaatctctgacacattcttggggtatatcaggatgtcatcgatgaacaccacgacaaactggtccaggtattccataaagattttgtcattaagttcatgaagaacgctggagcattggtgagtccgaaggacattactgtgaactcgtatagaccataacgcgttgagaaagcggtcttcggaatatcttcagatctgattttcagttggtggtaacctgacctcaagtcaatttttgagaaaactcttgctcctttgagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtcttttaacttctgctaactcattagctgccattcggtagggtctctttgcaattggggcagtgcctagtgccagttctatggcgaactcgatctctcggtctggtggcattcttgttaattcttccggaaatacgtcggggtatgcacagactatgggcaccgactccaaggaggtgacttgtaaacaggttagaatagaccggcttgcggtaggggtgttaggggtaaagcggatttgctttcctccaggtccttgcaaggtgatggacttttcggcacattctatctgtcatttgtgcttagccaaccaatccatccctagaatgatgtccaagctttgcgagtctaggactatcggtttggctaggaagtcaacttcctcaattctaaggttaacttccgggcatatttgagttgcccttatattcctcccaggggaatgtactatcattggtacacgcaaattttgggttttccaaccatttcttttcacaaaagcttgtgatatgaaagaatgagaagctcctgaatcaaacagaactattgcgggtacggtgttgacagagaacatacccatcacaacgtctggagcatcctgagcggtttcagcttgaatgtgattcacacggcctcgaccaaagttgttggaagcacgtgaaccttgtccacttgcctgagagctaggacgagactgagctgccgctggagtaggagttctggcagtgctgccattagcatgtcctgagttggtgttggtaggattctgaggacactgtctagcatagtgacccatctggttgcaccggaaacactgaactgctgacggtccctgtggtgacttgaaagaggtaacactgtttggcgcagtgttgccactaggggcacgctgctgtggcgaaggtgccggtcggttcatctgaggcggaggggcgtagcctggctgccggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgcgcaagcaactggagtctcattccaactgcgatccctttcaagaatttcctaatcttcttcttgtctgtgtccacttcctcaggggcgtaccgagccaacttattgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcaaggtgtgcattgcagtaattctcccaccaatctgcggcaggtcctcttaactggtgagaggcgtagagcgtcttctcaaccggagtacactgcactaagttgagttttctatcaacatctttcaaccaatcgtcagcctcgacgggctcgacggtctgagagaactctggcggacgagacctcagaaagtctgtcagcttggatctgttgttgcccatgtgagggtggccatttccatgcgcattatgctgaaaactggctatggctgtggttagtccttgcaagatttgtgtctgaactgccattaagtgttgcatgttgttttccacatgaggtggggaagggaggcgttcttctccagaattgtgactggcagtgtggtgagagcggtgagactgttccatctctgcatcacgggaaactgtgcgatgcgagcggctgctgcggcggggttgctcaacctctgcgttgcgggaaacagtacggtgcgaacggttgctgtggtgagactgctcattagctgattcatgatttgcttctggttcgactctaccatcttcaaaaccaaagcgggctggcgcacgagctgtacggcgggggcggctagccatctaaactcccagaagagggcggggtaagagtcagataagcacttaggagggcaagaagcaaagaaaatagcaactcagatagcacacactaggcataaactggatttttcaaatcataaaaacacctgatacaacgggtatggacaagtcacagagctacgccgagcttgactgtgcgcacaccacctaggagaaccagactaccaaacaacacccacaacaaacacacgcacgcactacctcgccacgactccaaaagagttggcggcggaacaaaagggcctatcacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacggaccgctagcggtgggggagctgggtagtggaaacggaacacggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcggaagctgtgggagcacaggtggctggcgtggcagaggcggcctgagtcccaagagatagtgtcaactgaggtgacaccctcctcggccagacaggcctccaaggcgg

SEQ ID NO: 19155 - DNA, 704 bp, Oryza sativa
ggcagtggtcaacttttcttcatttcttgaaagctgtcttcacaggctgcagaccattgaattttcttttccttctttacaagctcagtcataggtctggctagcttagagaatcctttaatgaatcttcgataatatcccgctaagccaaggaagctgcgaatctctgacacattcttggggtatatcaggatgtcatcgatgaacaccacgacaaactggtccaggtattccataaagattttgtcattaagttcatgaagaacgctggagcattggtgagtccgaaggacattactgtgaactcgtatagaccataacgcgttgagaaagcggtcttcggaatatcttcagatctgattttcagttggtggtaacctgacctcaagtcaatttttgagaaaactcttgctcctttgagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactctccaattcttcgatttgtcttttaacttctgctaactcattagctgccattctcagcagttagtttttctgtttatccatctatctgcagtacttagacaaaaacaactgctaacta

SEQ ID NO: 19156 - DNA, 22159 bp, Oryza sativa
  unsure (1)..(22159): unsure at all n locations
accgacatgggcggtcaagcggcgagctggcactccggctagcgtccaaagcggcgacaggaggtgacgccggcgagaggggaaaaatgtagaaaaggggaaaaggagggagagaaagggggctcgcccctttgccgaatcgggaaaaggaggagggagcgggggcgacgcggcagggggaaaggagggctcggcctccgtcccttggcggcttgcgcgcggagtggcgggggccgggcgatgacgacggcgatgacggcgggcggtatggagcggagcggcgacacgagcgacaggcgcggcaggcgctgacgacggcggcgaccaggcggtcggccaccacggcacgcgcgcacgggaggcaacgggcggcgtccgcgctggcgcgcacacgctggctcgcggggccgagcggctgcacggctgcaggcgcgacagagcgagggaaaagggagggggcgctcggcgcggcggctcacgcgcacgcgcgcgcgcgagggcgcgcgggcggggcggagaaggagggcgagggcgcccgggagagagggggccggggagagatgggccgagcggaattcggcccatcgaacccagggaggcaaactagacttttgcggaggaatttaatttggagggatttggattcggaattgaactcgacgatagatcggggattgagatcttgagatggcacggacactagacaacaagcaaagaaacaaatttcgcaattagggtttttaagagataattttcccgctaggtgccacgacggaacgggcgctatagatatattttatatttatctatcttgttgtttttttttaaaaaaaatctttttagttacattttggatgacatgtacaaatcactagggaagacaatagttcacctcagttatattactttcctgtcccgaaatataaaatctaggagttgatcagacataacctattacaataaggatatcttgatatattgtacaaggttatgtccaatatatcttttcttaagtcactactcctttcgtcccaatatactgcaatctaggatatgatgggattatattcatatatccatattcgtagtcctcctatcctaagactgtatattttaggacaagaagagtatgtgagaagagtgggtgccttgaatgagaattaaatgaagctaggatgcacttaattagtacttcctatgtattgtacggttatttgttaaggaagaaaagaattgatctagagtagacttgacatgcaacaagatctgtcgctcatgatcaccatgcagagcaaaattttaggaactatctatatatgtcgtcgtatttttataaaaaatagtcggcatatatttatattgtaaattcttaaaattatatatgtaagtgaatataagtagatgtaagtacaatctaacgaacatatattgtaaaaaacaagcacattcacaccttaaaacgggcctgcaaaaactccacatgatagtaacaaataacatcccaaccaaatcacatgtaaaaaaaataatacatatcttaaaacagcaagcgctgctatgaactatgcttgatattcccggagaaggttttaatgtaaagttaaaaggtataatatgccgccacggaaaaaaaaatcaggcagaccaaaataggcaaacaactaaagatctatacctatacgtgtggagcaagcggacacggacaggaaactgactgagattaacaaaatgtcgacatctttctagcaaaccagaaagtcttttactactgctaaaactgctgatcagatcatcatgtatctatatgatctgaaatgtgtccaaatctgtgtccccactaaagcaaggtgtgtggagatgtgtagactcccaggcccgtatatgtgtagcagtacaatggatttttcttcaaaaacaagcattgcatgcatacttttacagctggttgcctttgtgcatcatgtggacggcccgagaggagtccgttggctccgccgtgccaccttttttagagtgcaaggacaaagttacattcgttatagttggtaacatagtcaatttcgtccttgaaaaggtggtcttgacgtcactttgattccggatgtttctctgtccaaaccagcctgaagtcactttgattccggatgtttcttttatcttagaacgtgttcaaattgttgtcattttcaaatatacaattttttaagtaaaattgctaaaaaaatatctacatttagtttgttactaaatttggtaaatacataagaaatcctgccaaaattttagcaatattgccatcttgcccaaattttaggtaagatttattttggctataatctgaacaggcccttagtctatgagcctgccgaggggcggatccaaaggtgggtgttgggggccgccccatcctgttggttccgcatagagagaagggagacaggggagggggaagaagagaagatcatttttttatttttaaattttaaaaataaaccatttaaaaacttatttgtagaatctgaaccttttgatcacgccagcctgtttggtgtaataaaataatactgacacgccatacacaacgggcgtgacagttttgtcatgtcacgtcagcgagggtggcatagtcaaataacgctgccacaccagccaaatcgacgtaaacaaataacattttcacgctaatcagactagcctgatggtgttgttttaccacgctagtccgactgacgtggtcaaaaagatcagatcttagaaataagtttttgaaagggttcatgtttaaagataaaaatagaaaagttcagaaaaatcagaagaggaagaggaagaaggtaggggggctaggaagaggaagaaggtaggggggctggaggaggaaaaagatgaacccgtacaaagtactcatggatctgcccttgagcccatccgatatgtcatatgtagaaaacaactcttcgaagctttgttggcaaaccataatatctaattcacatgttattatgttattaaagtacacggatttttagaaattaatgctaaaaaattaaaaatgttggactcaaaacttagaatgacaataatttgaaatggaaaaagtagtaggctttatttatcttgaatgaagacacaaaaggatgaaaaataatctattcttaacattgagattgagatcaacattaaccttttcttgagttattttgttattagcatggcgtgtaaggtgagttcaacgaccacattcacctaaagacatgttagagatcaaggtcaccctaagcgatgttgaggaaccaaattgattgttctctcattatttattaataaatttaacccaaaggcaccaacaatgcaatttggtcagattagtttcctcattgataaaattagattgattactttctgtagtaatagaaaggcaaaatttattacaggacacctaaaaaatgtgtaattaaccgtgggacaccgtaaagacgcgaatttgctcgaggacactctaaaaaatggtaatttgctgcaggacactggacacattaaaatataatatctagtcaattgataagagagaaaccacgtaaaatgacagttttgcccttatcttcttctcccttctctcgttcttcttctgactatcctctcgcgtgcgtcccctgttgtgagtgcggtcgcaggccacgcccgccgccacggactcctcaccgctgttgtggatcgccgtgccggacatttccacttctttttataggccactagcatggaacgaccgctatccgtcggcgcgccagcaggagagggtagtggggacgggaagaacgactcgcacgcatggctggctcaactgcttatcgtagagctggaggttgtcggcgaaggactccggcgagaagcgtgcgagcaaggtgttggagcacccgtgagcttggcgacgtcgggcgggacggagccagggagggagaagaggtcacatgggacatcaccgaagaggtggttgcatcgaagggagagcacctagaggcgtagcatccgatgaggctgacgctaggtgggcggagaccaaggatggtggcgttggtggcgtcgcaggtgaagccgacccagtcgtaggcctgcgtggaggggttccaggcaatcggccgctggtgcatgtgcccatgcgcgccccacacgacaagctgaggaggctctactctatgttgggcaaggacgagaggaagaagaagataagggcaaaattaccattttatgtgctttctctctcatccattgactggatattatattttaatgcgtttagtgttctgcagcaaattaccacatttttgaagtgtcctcgggcaaattcacgtctttgcattgtcccacagctaattacactttttttgggtgtcctgtaacaaattttgcctaatagaaattagtacttatcttagggacaaatcgaggcacccctttaaaaggtttggtactatatatatcttcgttaatgaagcaagaataatcgatcgattccccttccaatgatctgtgccctagtctatgtctattcctcttttctagaaccctaatctccttcaagctatgtcatctggcctttctcaacaagatagttatcttgttgtgactaaattttctcacattagccctgggccacttttctctctctaggtgttcaagtggttacaaatgacaagcattcggacattaatggttaagatatctcaagcaaggtagacatttcaaggttcttgttagacacatatagagatggcaatggttgtgttttaagagagtgtcaatataaggtatatatgcagggggcggatccaaggcccgatgaccctaggcaacccgggctcaccgacagatcgcaccactaagacgacttgtatttctagtgttcaataacattgaaaattattcgcatatgtgtttgcctagctgaatgagggtgtaccaaacgatagtttaatgcttcatttgagggaatacagataggtctatatatccaaaagaaggaaaagaacacttttaagaggagaaaagacaccattattataatattctactcttttacaattcaactccaagaaattgatgaaaataaaatcatagcatggtgattgagatcaagggataaaattaaagaaattgtactagaccagggatgggcataaacttgtaagctaccgagggtagggataattgtccatgtttttttttttaaaaaaaaagctgaacactaaacaaacatgcataaccaaatttgacatacaccgagaaaaaagatactactccccctacttcatattataagtcattatgactttctttctagccaaacatttttatatttgactaagtttatgaaaaaaaattaacaagatctacaacaccagattagttttattaaatatttcattaaatatattttaataatctatttattttgtgttaaaaatgttactatatttttttataaacttggtcaaacttacaaaagttttactaaaaaaaatcaaagcgacttataatatgaaacggaggggataaaaaaatctgcttggattgtgcacgaactattcactgttagattttgtcattttgattctccaggtgtaaaaaaagttatataatcatattctatgattccagttagtctcgatctctcagaccaaatcgggctagaagcccagaatcctcccaccccgtgccacagcccacacacggcccatctgaagagatcgagtgtcgaagagaaaaatacagtggcagccgcgcatcgcggtggtttctctggaaaatgcctcaaattgggcccccgatgctggcgtggatgcatcgagcgcctgcactcctccgcggccccgcgcacgcgccgcccccgccacgtgtccccaccacgcacaccgttgtaacaaatcacctacatattatggaaaccctctattaaaggaattcgtttcatttttttatgcacaaaaaatgtttcactatatatggatcaaatgttacaatgaattggaatattcttttgcaacaaatcacccacgtattatggaaaccccctattaagggaatccgtttcattttctgttccattaaaaatgtttcacttagtgtactcgtaatgtttcactatatatggatcaaatgttgcagtgaattgaaatatcatttcgctatttgctaaaatattgtttttacgcagggtgaaacaaccccattttttgagaaaccgttgtttcatatattttagtaaaatgtttcatgaggtgatttggttttgtttcagtttttttttaaaaaaaatgaaacatttgcgatctacttagcgaaacaattctgatttacttgatttaacatgcaacatttaaaaataattcaataataagctaaatatttttttatcggattatatccatgtatggtactgttttaaagatttaattggaacggatttaatggtgtcatccgaccatgatttgaataaataatttaagaggaaaaatagttttaaagtttgtctaggaagttttgcatgtatgcatgcatgtatgatcacatttgatatcgtgggcatcttatttttctcagaaaaaatcgagcacctggtccgtaggcgcctcgggtttctctacaaactcggccacgcgcaagcctacgctcgccagcccgcgcgtgcgcgcgctcttccacccattcatgcctcccgcttcctcctccacccaatgccgccacagcgcctcgccaccgccaccgcgcaccaccccgccggcccgtcccgccgccggctccaccaccgccgcggcgcgatgttctccgtctcctgctggcgcatcggggccatcgcctccctcgtcgcggcggccgcggccaccaccgtgctcctcaacttctccctcccatcctcaccccacgtgcccgccacagacttcaccgggaaactgtccgccgggatctccccgccaccaccgccctcgtcacctcctccagcaccggggacgccgcctcctacctcctcccgcgccaccgccacctgttgcaaggccgcgacgaagagaggtacgcgatcgatcgagcagaggccgatccaaatctaattattatttattcgtgttagcatagtgatcgatcgagtttgttaattcctgcgtcgaactggtgatcagccgtcgtattggaggatggcgccggaggaggcactgcggtacgccaagaaggagataatggccgccgggccggtgatcgacgaccccgacctatacgcgcctctcttcaagaacgtctcccagttcaagaggtataatattattggtgcatgcgtcgcttcttcttccgttcctcgtttcacgcaccagctaccaaattaaagttcgtctcattctagcatgttttgataaacaggatgatcgagttgccggttttttttctatttctctggatttccggacatgtagaagcgtgtatttttttttactagatttcgatcgttttttactatgttgatggctatacatcttatatatgtgtgtaacaactaacattctatcccttatgctctttcaaggaggtaataatttttttatatcttaaattctcttatatagtgtgtattggaaaacatatagattaataattaaaacttacagtgtaattatattgtaagtttttaaatttatagtgtaattaaaatgaaaatatagatatattacagtataatactgatttgactacattttagtgaaaattaatgtatcataaatatatctagtgtcttatatttttaaacgaaattgtgatgtcagatcagacaagtcaatgggccgtggtttgtacccaagaggctcactatttcggaacgggaaactttcaggggaacaaatatttagaaatttccattgaactttagaaattttgatcatttttttagtaatgaaattcattccagccttttcttcaaagaaactatagataatttttacataaggttgtgggacgaatgactactattgctaaacctcaagctatggttagcgagaatttacataaccattgtaatttgaatgaaacattttgaaatttaaatatttttcatgaaattcgaataaatttggggggttatttttgcgtcgtaggaaaacattacccaccccaaaatcacaattcgaaattgtttttgaacaaaaagaaaatccggaattgtgaacatctccatacatgattgttagtgtctcccgatttgcgttccttgctgcgtatattacttcctctatcctaaaatatacaaagttgttaattttttacataacatttgatcatttatcttatttaaaaaatttatataactattatttattttgttgtgactctttttatcatcggagaaattataatcttaacttatatttttacatattttttttataaatttttaaataagacgaatgatcaaacgttaattgaaaaagtcaacggcatcgtacattatgttgaccactgataattatcaaaccataatatttctgcattttgtacagatttttgtaccactgataattcagtatggtgactaagcttgtcataattgtagcgaaaatgtgatcatccaggagctatgaactgatggaacggatactcaaagtttacatttaccaggacggccggaggcccatcttccacacgcctcccctcagcggcatctacgcgtccgagggctggttcatgaagctcctcaaggagagccggaggttcgccgtcaccgaccccgccaaggcgcacctcttctaccttccctacagctcccagcagctcaggatctcgctctacgttcccgactcccacaacctcaggccgctggccgcctacctccgcgacttcgtcaaaggcctcgccgccaagtacccgttctggaatcgcaccagaggcgccgaccatttcctcgtcgcctgccatgattgggtaaaccaacatcttgatgttttttttttcactctctttttgtgttgcagttttgatcgtgtttggttttggttcctggcaatggctgcagggatcttacacgacgacggcgcatggcgacctgcgccggaacaccgtcaaggcgctgtgcaacgcggacagctcggaggggatcttcaccccgggcagggacgtgtcactcccggagacgacgatccggacgccgaggcggccgctccggtacgtcggcgggctgccggtgtcgcggcggggcatcctcgccttcttcgccggcaacgtgcacggcagggtgaggccggtgctcctcaagcactggggcgacggccgcgacgacgacatgcgggtgtacgggccgctcccggcgcgggtgtcccggcggatgagctacatccagcacatgaagaacagccgcttctgcctctgccccatggggtacgaggtgaacagcccccggatcgtggaggcgctctactacgagtgcgttccggtgatcatcgccgacaacttcgtgctgccgctgagcgacgtgctggactggagcgccttcgcggtggtcgtcgccgagaaggacgtaccggacctgaagaagatactgcaggggatcacgctccggaagtacgtggccatgcacggctgcgtcaagcggctgcagaggcatttcctgtggcacgcgaggcccctccggtacgacctcttccacatgatcctgcactccatctggctgagcagagtgaaccaaatcgagctccacgagtagagaccgcgtcttgtgttcggtcagagaaatgtacgttcttggttcagcgcaagattctctgtaagttttggagaagactggccagaatcttaaacgatatgcaattatgaattatgcatgcatccattaaagaagtcgtaggttggacgaaatcaacagagaacagcacactatagtggtgtcagatagtagtgtcaccgtcgcttttgttcctgttgccggacggggaatagtatccaattccagcagctacagtctctcagatactgtgctatcctagatgttacatataatcaccacatctttacagataattaatttgtagcatctcaacagcgattgatttgcaacagtaatccctagcaatgctatgcaaagaaaggactttgagacacatcaagcttctttaatcatgaaacagtgtaacatattttaatcatgaaacagtgtaacatattttatcctatattttattagtcgtgtgtgtgcaaatgaattcctgatcatgaccctagacagagaacatatgtgtatatgtgccacaaaaatttacacgatggaaactaagtactccacatccccaaatcagcttgagagatggccgtacgtatcatatcatgctgaagagattggccgtggagatgagagagttggtggcgagtccgatgaacgcgatgaaggaaaaccacaccgcgctgttgatcttcttgttgaacggatccttgccgaagctcgacatccacagatcgttgcgggacgctgccgccgacgaggccgacatgaggagatacgccaacacctgcagcgagaccaggaagatcagatggtcagacaccggaaacacctctgctttccctgctttggaatggcgcatttcaggtgaaggatgagaggctggggctttgcctgatccaggaagaggctgaagtagtagctcgaggtgctccggaaaagaaacctcggcgaaaccaggcggcgaatctcgccgaacgcttgcgcgatcgagtagatgcagacgacgatgttcactccgacggcgtacctgcaagttttagtgttgttcaatggggagaagagaaagttattaaaccaccaaaagatgaagctatgttcctctgtttagtgtagagttgagctagtttagaaattcagagaaaaccgtttgattattgtcttaacctaaaactgaaattgtgttctacctctaagcgacctgaatcaaaacaagtatctctgcattcacgaggtgtttaaattttcttaatcttcactcgcaagttctatttgtacaacaatatttttttttcaaaaatcggtgcacaacatacgtaacatcaacggatcaaccacgataaaatctgaatttcaagcagagcacgtgaaatactactctgtactattgaacaagagtacagaatatagcttcccagaaccagtatccacgtttgtatacagcaaaatgacaaaaaccaatggggaacagtaacgaaaattctcgaacaatcaatttagtaagaacgactataatttcaattaacccccataattgcaagacagaaaaataaatccaactcccaagaagtcagatactaactactcctacaagtaccaactcccgtaaccgtcaaaacccggacaaatccgactaaaacgtgacaaacaaaagagaaaaaaaaaacgagcatctaggcaaaagtggtcgctaacctgtactgctcgtagcggccgtagtggtcgccggcccagccggacgtccgcgcgctgaccatgagcgcgaaggacaccaggctgagcaccgccgtggccactcgcagcgccaccgacgtcgtcctcctctccccgacggcggccacggccgccacctctggcggcacgtcccctccgttctccgccgcccctgccacgggcccgtgctggtggtcgagccgcgcggccttgccgttgccgatccgcagaggcgacgtcatggcctcctcggccgggttgaacggtatcgcgatcgccgtcgcgacgggcgtggccggcggcttcaacgcctccttgtgcttcggcgtgttctgcccgctcttgcttttggccgtgggcgtgggtgcgggcgcggtggtggcgggcgctggagtcagcggtgacggcggcgtaggcgacggcgagggcgacgacatggcgagggacccctgcgacggcgtccggaagaggcggcccgtcgcgaggtgaagttgcgggcgtcccggacggcggccttgcgccgtcccggcggcgccatcttcaccgttgacggcgggagagcccggcgcaggcgggagcaaccggtggggcgagggcgacacctggagccgcaccggcgagagctgcgggctcttggcggcggcctccgatcccccgttgacgtcgacgacgccctcctgatgaggcaccagcgcctcgtcacgcgcctcgtccagcgacggcggcggcgtgtggtactcctcgcgcggcgtcgaaggcgccgactccggaaacaacagcggcgtcggcggatcgggcgcgggaggcggcgacggcgacgcctgcggcgtctcgggctcgggctggggctctggcacgggaacgcgcaccggcacgggaggcggcggcctatccggcgccggggtacgcggggtctcgcccatggcgcaaacacgggagggaggcggatccgacgggagggatgggcgcccgtgttaagcacgggggtggagaggttacgtgttgctttccacgttgcaccgcacttcgcttttccttcccccatccaagattttgccgttggatttgagattatcacggttatttctctgtaacgtcacagatctttgggcgtgtacaacttcctgttcttcttcttttcttgtcagatttttttcctttttttcagtttgcgaggattcttgatagaattaggatacgcgtgtgatgcaagttaatcagatcatgattcatgatcggatctaggtggcgacagaacgcaagcttattctatactcttatttaagtttggatttgctagcatgatggaattattacccgtaaataattgccatgtcatcgtcgtggtaggcgaattggagccgtctttgacggctacaaattaagggtcaaaacgattgtatgatattaggagcgaaatggacagggagttatttctgtccaggaaaagaccagtatactccctagtagagacagacatcgtgaagacgtgcgattggcagtagtagttcgcacaagaggccgctaatccatccggtttgagatgattttgtgggccctgtagtgaacatgagttgctgtcagtttttatgttttgctgccttgacatgtacgtcatggacctcgtaaaccatatttgtccaaagaaatgatctctgaggatgtataatcgctgtaaaacaaatgcagcagatcgaacaggaccactctttaataattgcctccgctataaacaataacagatagtgttttagtgatggcatgtagaatgattcttttttagacagggagggattcctggagggcaagtactcctgctaggtgccttgagcagctgaaaccagaatttaatagaggatgtttcacaaggggggcccatgaaaaggttgtgcttttatttaacatggaagaaaagaattagttcaaagtggacttgacaacagcaaatgtcacaacccttgtcgccaaggctccccagcagatgtcggtcctgctaaaactggtgagcaggtgaggagatgaacacgtagtccgtatattaaagcttgtgtcaaatatcaagaatccagtgccgaaaatataattgaaagaagagccactcgcagaagagaacagacatggtgtgtttagttcacgctaaaattaaaagtttggttgaaattggaacgatgtgatgaaaaattgaaagtttatatgtatgtagaaaagttttaatgtgatggaaaaattagaagtttgaagaaaaaattggtaactaaactaggccatatacaaaatcagcaactgtcaaaatctatgcctctgctaaagcaacgagtagacgtgtagactgccagttcggcagcagattagtgctaaagacgcccaatatgtgcagcataatagagttgcttttggaaagaagtgacttttacaggtggggtttgcgctagattggcttttcctttccttccgtatggtggtcaggtcgtggcaatggcatgcacaccttaatggttaaggtatctcaagcaaggcacaatcttgtaaaaccttttggagatgcctgtcatacctgcactaaccaaagaattaactttgacgacttaggccgaatcaggaactatgcaaagtgcctaaatgccatgaacttgaaagttgcatgatttaggtttatctccttgtattgcacagtggaagcattaatgcagacatatattgctaaaatccaatggcaattcggatagggagagatgaagcgtcacacatccatggaaaatactggattttggtacttagcagattagcggcactatgcctaaatgttcttttacatgccataagccagctgaagacactgtcttgttgtagtaacaacaaaaattttccttaaagaaagtaacaaaaatattccgtcagtcgtcaggttggcccagagaatgacctctaagaaccgcatgaaagttacatgtcttttgtcaaagctattctacaatatctatgaggattgtagtaccgtacttactgtttagagtcacaaagcgacctggaatttctcaggtacacggagcaggggtagctggtagtccccaggctctcctagctgtccacaggcagccatctgatcatcccctctgctgagccgaacaaatacaacaaggccatcttgaattaaaatgttacgaaactcaataattttctcatcaggagtgggcttgaattgtgacccgctatggggattgaaagagatgaggttgatcttgcaagggatcccgcgaactaaatctactagtctcttcgcgtcatccacactgtaagcatagtaatccacagaaatattaatgatacaatcatacaagggccaaggggtaacttattttattgcaaggacaaaaaaggttatttccaagacatacaagtaattccctatgaacagatgattacaataagagtagcaattatagtctaaattattctggcctatatgtaaaatacctccaaataagaaaaaaaaacagttttacgcaagtattaagaaataatattcaagacaacttcataacataattgccacaagccaacaacaatcagggaaatttttgtataatccaaaggttcctcacctgtcgttcactccagcaagcatgacgtattcaaaaaacactttgtacttctttttcaaacgaatttcctcccttaatgtgccaagaagcaagctgagattgtattttctattaataggcattatccagtttctcacctaagaaaaagatagtatagacttatagaaacaacagaacaatgccaaaccacttttgcaacacaacaaccaaaactggatttcacctcatcagttgttgcattaagactcacagccagcgcacaattggattcctgtaggaagcgttttatctgtgggacaagaccgcttgtggagacagtgaccttgcgaggactaaactgaaggccctgctcatcaaccataatagctgaggcttttagtacattgtcaatgttgtgcaacggctcacccatgccctgtaaaagtttgatattaatgaaaggttgtagaagtatctgcaagcatcatatgaataaatgcaaggcagacaatcaattaactgttatatgccagtgaatattacaaacctaaacacccatgagttcatgataagactaatagttaaactaacacagttctccaaaacaatgtaacaagttaacaaaattgaattttaacaacagttaatattgataccattgagatgaaatacagacagaagcagggggatgttgtaagaaaacagagtgcataaaaacatatctatatgattatcttgacagttgtggcacaagatatcacattaaggatatgttcgacagttcaaaaatattggcatgttaaagatagatatatacagattcaagatgtaaactacaaagtgaattatgttaattaactatacagtcagctgctcagtcaacgaccataaaagctagagccattagttaccatgaggaggatgcttaccataaatacaacatttgtgatggatccaaattcatctgaaaacagtctacgagcaaacacagcctgctcaacaatctcagctgtagacaaatgctttctcaagcccatcctacagatatagcatgaaaatataagcaacgctgtaaaattatcaccaacacaatcattgaaaagttaagtgttattcaaaagaagtaaacgaaccttccagtgaagcaaaactgacaattcatggcacaacccacttgacttgaaacacagacagttgtcctgccactagtgcaaggaatgacaactgtttcaatcactgatccatcttcaagagagaacagtatctgtagcattctgtgttccataatcaatgatctgaagatagtacagaagatataagtaacacagaagaaactacctttcgggtcccatctgacgcgttaagaatgtctttcacagttaatgccttaagatcagcatgatctgttagcattttcctgaagtccttgtttaaacctggatgaaattagatgcaaacgatcagattcattcaaccaaaattacaaagggaaaaagaaacacaagataattgctaaatccacttgtaggttccaattggctggatcactggaatacacccttacacaaaaacaagaaagacaaaatggtgcaatataaatccatcacagctaatcttaaaacttgtaaagctttggtaaagttactggttttgcttgtcgaaaataaattctacttgatatttgatagcaaaatcaatctacatttatgtggggattcagaaaataacactaatggagcatgactttctgaaacgctaataccattgttaagttagatcaaatgccgctggttttcaatccgcccctaaaaatactactgttatgaattatgacgaatttttagattttgctgcttacataatgtagcaagagataaagtatatatgctgaactgatctgtaacgaaggtagtaaggttgcagaaaatgcacatctgaacataatgcaacaagtacatgcagactaaaaggagtagcatgtttttttactttcgaatagaaccactaacctacttctaatttagcagttttcatgtataaacaactttgctgacacatcaaaacttcagaaatcctatgagtagattttatctccttggcagttgacaatttggcattcatttccttcaggatagacaccattgtagatttgtagtatatatgtgctctcaaggttactaatagaggaattaacctgtagactgcaaaattatagcgaatatagtccgtggcataacaactaaacactgaaacctaccagccagctcgtcatagcaatgcgcccatacgttgttcccgtagaggcatttccacagcatcatggcctgccctggccggaagccctgcgaccgcacccaattctgcggaagagcgcgccagataagcttaacggaaacctccgaccaacaactcgcaaacggatccacggaactcgtacgccgagaggagtactcttacctcgagctcagggtagtccatccccttgagcatgaccctcgagccgggctcgcagcgggcggcggcgggaggtcggcggagcgcggagaagaggcggctcgaaggcggagcggaggagtggcctcctcggagggaggaagcgccccaccggaggagaggcagcgccgccatgggaagggaacagttcgtgagctctcccgctggggatttttctcgcgattaaattagtagtaacaggatagaattgaactgggctgctttatttcctgggcttgtatggctcgatgcggcccaagactgctgtctaggccttctgttcttcaggcgctgtaacgggccagaattgtcgccttcgtgggctctaattttacgtagaaagttgttacaggactagaaagggaataagttcacttcatgaccctcaaatgtgatcgaaatctaaaccatgaccctaaactacaaaaccagatatctcgacccccaaactcctaaaaccggtgcaatttgactccctgagcggttttgagaggcggttttcctgacgtggcgctacgtggcgcctacgtgcaatattgatcgagtctttgtaacacgtggcattgacttggcacctacgtggcaagagaaataaaaagtatgcgtgggacccattagtcattcacacaaaaagaaatatgggcccactgacatgtggggcccacatgtcagaccttcttcctcctccctctctcccttttctctctttctctcccctctttccccttcgccgctgctccctaccaccggcgagctccagcccctcccccgctcgcggacggcgggcgagcccctccccacgcgcggacggacggcgagttcttcccatgcgtgccgacgaccggagagttcctccaccgtgcgctatcgtagtcaccgccgccacgacgcctctgcgcatctcccactacctcgcgcaccatccgagagcgacagtgaaggcgctctccgcaggcttccccgatgccgatcatgtagacgccgtcctcttctcctcgcaaagcactgccacttttcctccccggagctcgtcgccaggaacgcgctcaccttcttctactgggccgcctcctcgtcgccgtcgtcgtcgaccccccactccctccgcgcctactgcctcctcgtccagctcctctcccgcaccgccgccgccgccgcccgatgccgacgccgctcgctctcgctgtccccgcgcgccaccagccgaaggggaagaaggggaaagaaagagagagaagggagagagggaggaggaagaaggtgggcccacatttctttttgtgtgaatgactaatgggtcccacgcatactttttatttctaccgccacgtaggtgccacatcaacaccacgtgtaacaaagactcggtcaatattgccacgtaggcgccacatggcgccacgtcagcaaaaccgtcccccaaaaccgctcagggagtccaattacaccggttttaggagtttgaagatcgagatatctggttttgtagtttagagttatggtttagatttcgatcaaatgggtaatgaagtgaacttattccgactagaaagcctgacgtttctctctttggaacgttttagaataaaactacggttctaggaccactttcaagcgattgttttaataaaaacaattcctcttttttttccaatttttctactgtcatttcagttctctgtagattttcgtgggaggcaatttttctacaggttttaacagtactaaaacagctacgtaacgataataatattgcaatttgcaaacattacacttgtacaggtatagtactacgtagtagtgcacccgctactagttcaacaaaatactcctatatattctatgtagactggaaaagatttgaagggagcaaaacattcggaaaaaacggccgcaccgttttgcgcgcaggcgcgagactcacgccatcacaactcacacgtgatactacttcacagttcacacggtatgcgaaatcagatgctaatgggccaatggcccggccgaaaaagatgccaaatgggcccaatgacacaaacgaaacctcctgagctctgactttccgactccctgacgaccccccctccagtcgggccccacccccgcgacacgagtctccttcggtcaccacttgtcaagttgtcatcatcactggcctactcctagtgcgcctagtacttcgccttccccccacaccccaatgcgctctcacatggagtcgtcgtcgtctccccaaacacgacgacctcgaaccgcctccgtccccgcctcgccaacccgtccccttcccctgtagccaccgggaccaccaccaccaccacgccggggatccacaacgccaccagagtacagagacgttccacccaccccgggccaccgaacccaacccccccagctcgctcgatcgatcgctagctccgacgacaggtttgagcgcgatgaggcatcccggcgcgggcggcgggagcggggacgccgggttcgtccgggcggaccagatcgacctcaagagcctcgacgagcagctggagcgccacctcggccgccccgcggagcgggccgcgtcgcagcacgggggcagcgggagccgccgcggcgagtccgccaggctcgggctcggggaggagccgccgcaggcgccgcaccatcagcggcgccgggaggactgggagatcgaccccgccaagctcgtcatcagaggcgtcatcgcccgcggtacgttcggcaccgtccaccgcggcgtctacgacggccaggacgtcgctggtatttttttttctttcgcccctctgctataaacagctgattgctttgcagatatattcgtccactcggcgctgaccaagttttttttgctgtccatgaccatgagctattcgatgaaatggcctgttgcttactagtactcgttagtggcttcttctgcctgcgttagcttctggttccgatcgattcctctccaagtttttaggaaagtttgatgcgtgatttaattattttcatcggtatgttcttcttcctggattaggatatggattatggagtagagccgatcgattgatagatggcaaacgtcatttaccataggtgcggttgtttcgggtgcttttggaagttgttttcgctcgtcgtgtcattagtgcttttccttgtcagcaaattgctaaaggtgatacctctgcttttcttgattccatggtgtattccgtgacttctgggtagataagcgtgcttttggcgtgcaacccttctcatgtgattgaaccaaccaacagttaaaagttttaataggcatgattcatgtgttttgtcttatgatgagcacctggaagttgaagattacatattaaagcagcggatatttcagatcaaaaagttgcaagttgcaactaggcacagtacttttcagggaccaggaaaattcaaaagcatctgaaccaaattcgggttgataaaaggtccggattagcaattttgcactgtatcaccagctataatcacatgacagaaggcaaaagcagatgcagtggttttttctgtccagaactttatcacctattgcatgccgtcctttcaatatattggttcaccaggaaattgagtacaatgtcttgaaatggaaagtatcagttagattcataagaggtcattagaatcctaaatcacttggtgatgctcatgtaacctggtagcacaaggtagcggtggttttagtcagggttcaagtccccatcagcttcctttaaatggcagtgttcctccagcatgttcttttttttatttttcaaagtatttgctaactcactggagttttttattggcttgcctttctctaccactttagtttgtatgacaaaaccagcttcctcactgcttttgcatgaataattcatcacttgtcacattatattcccccagatagattcaaacttggcaattaacagctaattgctaaatacacttttaggaaaacagagacatgcacagttcaccaagattttgttaccctcatcaagaatgtgctattgatttacattaaaaaaagaatgtgtattgatgtagtaatatgcagcattactacttcaatataactttgtcttcgaatcaattgctaaatgcaaaaaagactttttatttctacttgtagtttcattgtcgaagtaactgatatatcttctctatcatccagtcaaaatgcttgactggggggaggatggccatagatcagaacgagaaatttcttcactaagagcagcatttgcacaagaggtcgctgtctggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 19157 - DNA, 1438 bp, Oryza sativa
gtgctgagtggcctgagcctccgaaagctcaaccatgcgagtcagcactggctgagactcgctgtacggacaagggtacctggcgtctgagtggccagaaggaaggcgtggaagctgccggaaggcggagcctccgagacggtggctgtagtcgtgggccaggcgacgaagcgcagtccaggagaggtcctggtacgcgatctagagagtgggcctggccacagtgaagtggtgtgggcgaaggccagctccgtgtatacctccacgggggtaaaggtacacagagagctcacagtgagggggaacacggtccacggagtaccccgtgtactcgggacacgagaagccaaggaaacgggcgaggtcacgaagctgagcgacgtggtgaccctcaccaaaaccgtgggaactgaagctggcgttcactgccatctacaattttgaaagagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcctgtgctctgataccatctcttgtcacgccccgaactagccccgactggaactagcctgtgacgctccaaattaacctgttaatcgataccagtcccaggaaacagtgctggtatcacaggaagacagaatattacagcaacagaggtctctttattatagagttggaatacagttatgttgggctacggacagatcccgagctcacaactgcaatacaaaaggggaaacggaagccaggacttggaccaatcatcacaggcgcgacttgggaactaggccgaaaccctaaaactcatcgtagccggcttgctcctggaagaactcctcgtcagcaggatccgcttcatcttcttcagcaactggggggggattatttatctagagcaagggtgagtacgggagtactcagcaagccaggggaaataagtgtttaatgcaggcttcaaggaaaggctgttgtttttgcaattggttttatttgaactcttttctaaaacaactaggtgagtgcttctcaaacgacacggatgagacagtgcgtctcgtccggtcggagtatgtgcaatgtatcagctctttagaattgaaacaagattggcacccggccaacagctttttaaacggccacccgggccaacaacttttcaaacggccacccgggcctagctgatcccgtcagctgctgatttttcagacgtcgaacccattttcacgacagcaatttcacaatcagtagtcaaacaaaactacgctaggaatcacctcacatccgcccatgaccgtgggcacggctgttcgaacagtttgttaacctctgcagagggggtacactttacccacacgacatt

SEQ ID NO: 19158 - DNA, 588 bp, Oryza sativa
cgcgggcgggcgggaggtagattacaacgccggccggaacggacgccggacgacagcgccgagcggcgaagcgaaccacggtgatacgggcacagcgagcacaccgggcagttgcacgtgacaagggaagccgagccaacggcttggattcgccggaggttgctcgacggcggcggattgcggcgccggcaaccggcggcgggagaagagggaaacggcgacgaggtcacgagaggtcgattcccgccggtgagagcatctacgcggcttcgggaactcgacgctagcgtcggattgggcggaactacgccgagcgagaccggcgacgagcgggtgctacggagctcgggcggcgacggcggcgagcacacggcaagtgacggcaacggtcggggcggcgccggctaactacggggaggctactcaagctactaccgaaagctagggggaggagatggagcgaggaggaagaacggagagaggcactaccgaggtgaggaggggcgctgtgacgagaggccgacggcgcgggagtgatctctccggcctcgggccgaggaaaaggaagaagagggcgcggccgaagtc

SEQ ID NO: 19159 - DNA, 278 bp, Oryza sativa
ctccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagatgcccttcagaatgaagtggtgcaatgtctcgtcagttttgagttgatatttccaccttcatttttcaatataa

SEQ ID NO: 19160 - DNA, 934 bp, Oryza sativa
  unsure (1)..(934): unsure at all n locations
gcatccaggacgaacacgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcgcagagcatggacgccatgcaaacacaggacgaatcgacctgtcccgttgatgacatcactcagcggacaccatgtgagctgcatattcctttcaagaacttatcaataaaggtaagatttagccattccgctagttcctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacaagccatgccattattctatggcgcaggcggtacatcatcctccctgggcgacaagcggcgtctcgtgcaccatctcctccggctccggcatctcctcctcatgatcctgcaccgtctcctcctcatgctccgccagcaccgtctccacctcaggctccagcatcgactcctcctcaggatcctgcaccgactcctnctcgtgctcctacacctactcccccgcaagctcctcttccggcaccttcaaagtcaagggcccccccagctgaccgcctgccacacaagggca

SEQ ID NO: 19161 - DNA, 638 bp, Oryza sativa
tgctaattataattgactagaggatttttaaaagttttaaatcacgcaagtggcaattttatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggttttaaatcatgcatgtggcatttacatatgttaattagagtttttagcatttaatttaatataattcctacgctaagtatatatgatgattacaatttttattaattttaaatcatgcagtatgtacatacatatcttaattagagtttttaccaatataataatatcattcatatatatgctaagtatatatatatatattggaatttttattaattataagtcatatatttgcttattacgatttatccacttaatttattacagacaaaaataatttttcgaagtaattgtcattaatctttagtactttaaataatgttaatgcattaacttctattttataaacacatatgtaagcgaaaatcatatgcagtgctataatc

SEQ ID NO: 19162 - DNA, 1887 bp, Oryza sativa
acgtctctattatgagttgctggattttgtaagtatatcgctcggttagatttcttactatacgtctcctttaataaattaggtccttgtatataagtagactatagaaaataatatactcccttttatcgttgtagaatggagattcaaagggcccgacggcggagggttttcgatactggattcatcgaccctcggagagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattatgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcacggcggttcaagaacaactcatgggattcatcaacgaagaaatccttaatcccaagggtgaattctactacgacggaaacacaattcaccggtccttagcttctgagctagcagcgagtactactacgtcgaaatgatagctagctagctaggacatataatggattgtaattaatacatgactacatatgtttctatatgcatgtgtacacattttctataatgtaaatatattttggtcatatatatatatctatatacatatgcattaatttgcataacatatatatgtgtataaatacatatatattatgcatgtatatacatataatataatataatatatatatatatatatacatatatatatatgtatgcatatatatgtattgaaacatatatatgcatggtttatatatatatatatatatataaactatatatatatataaaccatgcagcaacagggccatgcaaaaaaaaaaatggtcagctcgatctttagtcccggttatttcacccgggactaaagatagcgatctttagtcccggattggtactcccggtttggaaaccgggactaaaggggggttacgaaccgggactacaaagggtttctccaccagtgatatatcatctgcacatcctttttccttctcttttctccttcttctcctctcttatctcgtttctctcttcccttctttgggccggcggcgggcggaatcggtgagcgcggatgagggcggcggtcgagcgttggggaggctccggtggacggtggcggtggcgacgagccgttctacgtgccgtggtgcaaacggctgtcggtggacggcaaggcatccaccacgctacggatatgcatctgggagtgagacggtgagggcaggg

SEQ ID NO: 19163 - DNA, 769 bp, Oryza sativa
ccaaaagtttattttttcatgtataggatacaatatttatttcattttttggaaaaaattgatcatctatataactcgtctaatgtttatttatctattcaagaccaagataatttttatatgtacaattaactactaaaagaacattttaattttcattttcatgttccgacactttcattgaaagtgtattttaatgattaggtatttttaattattttgtttttttttctaaatcttgaaagtatcatgcgaataatagtaataatatgtgtcagtataaaattttgatgtgtaacaacaattacaccagtagtatgtatcatattagatcaattttacttttgcggatcggtttggcctatgtttgcatgaactagccaagttattgtacccgaataagcaatttgtaagttattgtacctatttgcacccaccatacaagtttgtgtaccatgaacgtaatttactcatttttctttgttaatcaaaaagggttaaaagtgtaatcttacccatccatagaaatatcctgcaagaatcttactctgcgatatatctaaagcagtttgccccttattatttgatatatttaagtttacctccttattcatcagtagagaacagaagatagccttattcccatgcttcactgctatgtgcaatgcagtgtttccatcgttgtctagcatattcaaaatcctagccaacgattgagtatggcaagcatacacaactacattccatctttccctttcaacggcaacat

SEQ ID NO: 19164 - DNA, 2280 bp, Oryza sativa
ccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcgtactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtcaatttatgggcctccttttcactttcgcagtcctccctggcgtcctgcaacatttgaccaagatcatccgcaacgtcgttaccatcagcagctatttcctcctcgcccgtttgatttccttcaaatccaacaaattgagcaaagtccggaatattgtcgtcttccacttcatcttcttccatttcaacaccttgctctccgtgggatgtccaacaaatatagcttggcatgaaccccgactcaaacaagtggaaatgaatagtcctggatgcagaatactccttctgattcttacacttattgcatggacaacaaataaaacccctttttctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgttaagtaataaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactacattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttaccatctttagtcccggttggtgttatcaaccgggactaaagataccgggagggcctgacagaccctgacagcattcgaaccgggactaaagatcatctttagtcccggttggtaacacaaaccgggactaaagatcaaatatgcccgttacccttttgaaccgggactaaagaacatctttagccccggtttttattgcatccgggactactgtggaaatcggccgaccgacgaaagatggtttctccaccagtgtatgggtcccatgtattttttaaaatgttttttctgactaggatgccacgtcagtgaaaccacccatatatactgtataggtccttgtgtgcacggcttgtgtaaatttaggggcacacatttctggtttatggttaggggatttcaaaaaatctcgctgttaagttgagggacctccggtgaacttattcctttttttttagaaaaggatacagtgcgtgcacatacccctgtgtatgtatatacacacatcctacttctattaacacatttgaaactctttaccggcataacttgagattgatgaagtctcctcaggtgtctaattaactgtaagtgtgagcactcgtgttaaatctaataactgaatcatggtcaaaattaacaacccatctctttcagtgtcatattgcctattgggaatatcctctcccatcacaaggag

SEQ ID NO: 19165 - DNA, 6871 bp, Oryza sativa
  unsure (1)..(6871): unsure at all n locations
ccgcccgtgccgcgcgcgtgcgcgcgctgacgccgccgcctgaccgcgtggggccacgcgccaggccggtcgtccccttccaaccgcccggccccttcctctctctccctcccgggggaaccctagcgccattcctccttcaaatccgcgcgattcaagcatgggattcccaaattgattagggggaattaatcccttttccctcctctctctttcccacttaatttccccttgaatggtgcccccaatcgccagaaacggccgcgccattcccggccgccttccattgccgccggccggcttttccgccgccgttccccgctcctcccgtgcccggctccctcccccatcctataaaatagaaccccctctttgcgttctaccgttttagtctcctcccgggctctcccgtggtccctagccacctccccgccgtcgtcccctccctcccgtgccgccggccgcctccagccgcctctccctcctcgccggagcgccgtccggtcgcgccgtcgcctcctctagcatcgcagccgcctcctcttcgccggcctaccctctgtctcccgcggagacctccggaagtgcctccccgccggcaaccgtggtgttgccgccacgattccgcctccggtcgcctctgccgcgtccccggtgcgccggccgacgtcgccaccacctctcccggcatcggagtgccgtcctctttcccggcaaggccacggcgtcgcccgaatttcgccggaacgccgtcgcccgcgtcggcctctccttcctcctcgtcgacgtctcctccggcaggccccttccaccgggcccgtgcatcagccggcgctgccgtccctccctcggcatggtggcgtagccctccacctcgtccacccctcggtttcgcccggaagccgccgcacatcgncgcgaacctctccctccacgccgtgcaccgggcggncacacctncaccatcttcggcatcgcagccgcgacgtcgttctcggcctcgcctcccctccgaccgaacaccgccggtgtccgtcgtcgtcttcaccgttcatcctcgccggctcgtcgtctcgcggtgccgcctccgtcgtcggattcgcagcggtgcgttccacgtcgtccccgtctccgtgcagctgccgccggctgccctcatcgtctcctcgccggccccggtcgtcgtcgtcgtcgtcctctcgtcgttctcggtcgtcgtggcgttcgtccctccgtcgagccgttctcgttcgtcgtcagcgttcgtcaagcgagccgcggcagccccgtcctcgtcttcgtcctcggctccgcgtcgtcaagcctcgtgccggccgcgtctcgccttcgtccaaggatcgccgccgaagccgtcccctcgccgttcgtctccgttgtgcccgtctgtctccgccgcgcccgttcgtcgttgtcgttcccgcgcctcgtcacgtggtggtaaggatccctctccctcgctgccctgtcctcgtcctttcggtgtcgcccgtgctcgttgtgcggtcgtcgaccccggtacccgtgtaccggtgtcggtagtcgttcacgtgtgcggatggtgaccgtgtagtgtccgtgttagtgtgcccgctcggtagccgcgtggtttccacgtgtgcaacccgtgtggtgtctagtggagtccgtttgtcggccactcgcctcggttgacacacgggatccgcttccgtcgacccatggaccgactctgtgtactcggtctaccgcggtcctttaggttgacatgtggggtccgcatgtcaacggcgcagccttcctgtcttttccaggctagcgcttacacatgttttattgttgcaaagcttaattataataatccgcaaatctccatataacagcactaaacttcggatgatcatatcttggtcatacgaactccgaatcgacccgttcaagtctcttaatgtttgttataacctaaagaaccctgtgctttctttttatgtattgttattgcttctttataggcttgtagctttgcttgtgtgcttcgcgtagcttctgtcattccggaggttcccgaagcgtggtttgcggtcgtcgccgaaggttcggaaggccgttctctctgagcaaggcaagtcacatcatccttgaacatattgaatcccagtttataaaattattttgatttaaattattgcattaacgctttatttaaattcccgcgtgatcactgttttatttagccatgcctatttacctttgttatgaccttaatattattgttattgatattattaccttgttcaccctagattaaacaaaaccccaactagtggacactctattcatggttccacaagtatgaatttaggtagatgcttcgctgattaattaggcaatattaggtggttttataactttagactttgggaattctcatatcacctggacactatggaattgttggtttatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtacttccacatgtctagtgggtaaggcttagtttgtggctcagtctggtcataaacaaaagtacacggatggagatggatgaagtcgggggtcgatggacattctctaggacaaatgaaggctacacgagctgcggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacctagggtcgggttgccagttcggtctgaatcatcgtaggccttgggttaaggcaggttcgtgagggttcacggccttgattaataattttgtgtagctctaggatcgtctttataaaatggctttgggcaactaagtgacttttaaatgctgtttactgcaaaacttaacccctatattattatccccttgtacccccttgcattaattatgcatctccggtgtggcttgctgagtactgtggttgtactcattcttgctcaatctttccccccttcagtaagagaagctttggagaagatgtcttaggtggagtcctggcttataccccagttgagcgcctgtgaaggtggagccgtaggctcgctagtacgctgctgtttatttttgaatgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaaattatttgcgaaagttcctttttctccttcccctaatgctatttgcaaaaggtttacttttttcttccttcttcggattttcaactagtactagatggtcagctttgcgaagaagaagatgtcgtcaattgtttgccgaagctccggaagactgcaggatccgctagcgaagtgtaggaagcagtgaagccagctgtgaagaaggagtgaagatcttgggaaccagtcgcagaacctaagccgccctctagggtagagtcgttagttgtgtgtttccttgcttgtgtgtgtagcgcgtggtttgcatcagtggggtgtgatgtaaccatgctaggttgtttgcttaatcaacctgcagaataagcaaaacaaacaacacatcaacaaaaagagttagttcctttaaggtcttgtccctagttctggtcgattctttccttgtatgcttcccctctcaacctctaccttgtgacagatggataacactggtaacaaaggctatgggaatgatggatccgatgactcaagaacccaagccaatgggaatgagaaaagcataaacgaaacctcaccagagctaatccaaattgtggttaaccaaaccaacatgttggcaacagcctttcaactattacagaattggaacaacccagcaggggcaaccaacgttcaagtacctacagtccagcaacagtgcaagttatcagaatttctcaaaactgagcctccaacctttgccattgccgtcgatcctatggaagccagtgattggttgcgcacagtcgagaagaagctagggttgattcagtgcaccgaccaggagcgggttggcttcgcaactcatcagttggttggaccggcttcagagtggtgggatagctacgaagcatcacggccagaaggacataccatcacctggaacgagttttcatctgtattcaagagatcacatgttcccgcaggaatgatcgcactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagcttgcagtgcaactactcctagaggattatgaagattttgagaaacttgtggacaaagccatgcaacttgaaagtgagcataatcggatgacgaactgcaagagaaggattgtcaacatcccagtatttccaggtggtaaccaaagacagcgcactgagccacttcagatcaccggatcttctgttgtgcatcaagaattcctgcccgaagaagatggacgcaatgcagacaacaacactagcaatactaatgatgatgataccaccaacaaccatggttcttgccccattagtgaccacccgaataaagcgtgcaatgtcagtagcattcaccaagatgtcaacgatagtatcaatgttggaacccagaatgacaaccttagcaattttgacactgagaaagactccaatggtgatagcaactatggtaccactgatgccaatgttagcaaggatttccaaccaccaattccaactccaagtcaaaatgatcgtccccagatggacagctcagtaaagaagacgttgatttgttacaactgcaaagaaccaggtcatttctctagagattgtccacagccgaagcgtaacctgcgccatcactccggccattatgcaagaagaagacaagtcactcgccttgtggtcactggagcaaacgccgtacctgggaggcctcatgttaatcctaacccatagtagaaacaatgtaccgatgttaagcatcttcccttttttgtttaaggtagtgccttgtattcatgtaataagggagacatgtgtgataaaaacaagttctatgaggatattttggaagatgctgatatgggatcatgcgtataattgtttactgtcaaaggagacctagggtctcattccagaggaactatgttctaacctcgagttaataaccaacctgatgatggaaaagaaaatcaagcgattaaccaaagaaacatttgttggactaagagtttcagatgtgtctttttcggatcaaaggcaaagacagtcagtatagcttttggcgaaacacttcaaggtttcactggaaggcagcaagccaaaggacctcattgtcaccagaagcatccacaactctcggagtggagagtacttggttgacaaagtttaaaaggtgattgatagaagataccagcaaaggtgtttattaccgggcaaagaagtaggtcgaaaggtgattgataagagaaatcgggaaagaacacatcaaggttaaaggtgtaaaggaatacgttgaatgctaactgaggacaacctgaaggtaatagtgggaagtaaactgaatgtaacgaaagtaaatccgagctgcctgttcgtgggaactattcccagttatgaaccaagtgaaatgttcgaagatagtctatagaggtcagattaaaatcacacctaacaacgaagcttcagatttggcaggaaaatgatcagacaataacaagttcagcagtaaagtcatttgggaagacgtcaaagcatgtcaagtgggataatttggttaccttgggaaacataattcaaaggcaaaagttaccgaccctcacattgaatagaggaagtatctagcaccggagactaggaaagctaatatgaggcagttggtgcaagttagaagtaaatgacaagcatgatattcttatgatgacaaacatggtatcctagtaatgacaagctagtgttgacgcatgacatgaagtgggtaagttgtatgaggttgacgccaaagatatgaactatgcgaagttctggaactgaagcaccatcttcaagtgccgcaacccagtcgaagtcagctaaaggttcaaccagggacaagtcgggtgaagagaagattccatctgcaacaggagatcgagccaagcagtccagagtggagaagttttgttaggcaagtttgttatagaagacggagcggaaggagtcagacaagaagagaagaccgcccaacctatcctcttgctagcctcctcgaatctcggggacg

SEQ ID NO: 19166 - DNA, 2782 bp, Oryza sativa
gtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagaatacggatatgagatatcgtacgacaaggcttggagggcaaaacagaaagcattggagatgaggtttggaacttatgaggattcttatcacaatcttcacccactattggaggtgatgcaggcaagaaacccgggtacacacatggctattctcgatgaggtgaatgaatatggggagaatgttcttcgtcgggctttctggtcatttgggtccatgatagaggcctttagaaattgcattcctttgctctgtgttgatggcactttcatgacaggcaagtacagaggaacaattctaacagcgatcggagtcgacgcggatagccatgtcgttcctgttgcttttgcatttgttgaaagcgagaacacatcaagctggctatggtttttgcggcacattaaaatgtgtgttgttgaaaacagaccaaatgtgtgtgttctgtatgaccgacacgccggtttgctatcagcgatacagaagcttcaagaagatgtcacacaatccgtgccatggccagatttacatagctgatggtgcatgcgacattttggggctaatttttatagacaattcagtagtaagagattgatggacctgttcaagaagttatgcaagcagaatcaacaaagaaagtttgatgccatatgggatcaactggatcgtttgaccactacacacatggaagaggttaggaaaaaacctatagttgccagagaggaggagccggagggacttgaacccattcctaatgaagcaccaagtattactcggcgcaggaagcgtggaagggccacgaagtgcttcacggagttggtagatattgagccaagggagaaatggtcgttgttgtacgatacagacggatcgaggtatggtgtgatgacaacaaatcttgctgaagtgtataactgggttatgaagaatacacgacctctaccacttgttgctatcctggagggcatcacgaggggtacacaagaagtatctctgtgaaaggtattccatggctagtctgaacctcagcaaacccagtgttaagtatagccccgctattacacagtacatggatgagaaaagttagaagggaggaatccacagagtgtggcctgctgggaatagagagttgttatttgagatacgacttcgtgacaagagtggtgtcggcattgggactactgacatcacattggaatgcacgttatggccagagtatcacgcttacaaacgcatttgcaacaagccttacctgttacatcggccatgttcccatgttcttgctgcttccgcaaaagggggtgctgatggaaacatttttgcttctacctactttagaaaggaatcgtgggaggcaacttggcgtgaagaattgcgtggctggcgagccaggtgacaacaattagtgctcctccatggctggccaattgggttcctgactcaaatttattagttgatactaagggtcgtcgctagtcgcgcagtatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcactattatccttggtggactctctactttgaagatcgttatcgttcaatttatgtttagtgcgtctgtaattttaatttgaactttcttgcacttttattacccgaatctatttgtaatggccttgtaattttcattttgaactacactgcacttttaatatcgtcatgtatttgtattggaattgtaatttaaatttcgaactgcactacacttgtaatatcataatatatgtgtcctgggcttgtaattttaaattgaaatgtactgaactgttcttatctgtatctatgtgtgctggtactgtaattttaaattgaaatggcatgcaaatttgttacttgaattatgttgcatacatttactgtactgttccatacgtgcattgtactaatgtggttttcgatctgcaggtatggctgatcaatatgatgggcagctgatagacaaggagatcgataggaaccatcgatcgcgacgtcttagtacaggaactttctgcaatgtgctaaagatgcgaggaccggatcaatattggcgtattgatcctcgttgggttccaaggtgtgtgaaaatatattgtttttactaatataaggtgtttatattttcatatattaataacttgcgctctgtcatgttgtagactgagagcagctgggttgttgacgtttgcacggttggtcgagccttcacgtgcaaggtccgaacggatccacattgacgcggcgcttctgagtgctcttgtggatagatggaggcctgagacccacactttccacctcacagttggagagatggtgcccactctgcaggatgtgtcttatttgttggggctgccaatagctgggccagcagttggcccaacaatggtgaatgctggatgggcggatgaccttctggccagttttggtggtgtgctg

SEQ ID NO: 19167 - DNA, 6272 bp, Oryza sativa
  unsure (1)..(6272): unsure at all n locations
aggaatatggagagatttaataaaagaaaaaagtcctcgtacctgcaaatctagatagacgaggcgccgtctgtggaagaaatcaaacctgggagcttctctgttctcaccacgagcaatcttgtgtccagcagcaatcttctgcaagaacaagctctcctcaaatcgagttggccttgctctccgatttactacgtggagactggaggctctactacatttatataagggcacgggattactgcagatgatgaggatgcctgagagttcagcaaggggaggaggatgattgcaaattgaccggatctataagccctatagttcagctctcccttgtgagccagccttttctcgctcctatgggctagctcgcccccacaggctaggatttttttctgatttcaaacgactggcctggccaggctaggcccctgctagccttggatccaaacgcacccttctgaccaccttctacactcgaaagcaatggcgattctagcaggtaggctccatcaggctctagcctaccctccaatttttaccgaaaatagttcaactacatagcaaaaccatggggagaaatgtcattgcggcttttgttggggacgaagatgaacagcggtaacgctcaacgtcgagaaagaaggccgggaagcttacttctcagctatgatattggcccacaactagatcagtggttaaatagactagtgccaatagggcccagcgattgggagatatgctcctgcaaggccgtgactcggcgagctcaggatgttaagcacactccgctgcgtgccttctagtcacgtatatatatgtctctctcatgaccaaatgaagaacgcggatccaaacttagacactcgtacctcaaaagaatttgtcagcatcgtcggtaccggcccacactagctgttacagtgcgcaatccgggccaccaaccatgggccacacccaagtcacaactgggcctgctctaccacatgcccaatcggagccacaactttaggtcttgggcctacacaactcaaaaactagtttgatgggtgagtactgcacccccatcatcaattaccgatgtgagactaaacccaataatctcccctatcacacatcgggcccaacaacctcccgcatcacatcaaaccattaaccatttgaccccgaagacttacctgggctccccaccatgtgacccatgaaaattgttccggattccaatcttgggctctgataccacttgttggtgggccacccatgtcacaactgggcctgctccaccacaggctcaaccggagccacaaatttagctcctgggaatacacaactcaaaagattagtctgatgggtaagtattgcccccaccttttaagtcgtgctcccccatcatcaattaacgatgtgggactaaatccaacaatggtcatgccccgtgcaaccatgggagagggaggaaagagagctcgtctcggcagccagggagaaagcccctagctctatgccgcaccactgccagactcgtggtcgagtagtttctgtcgagctcacgacccctcaatcgtcaccgggtctgaagctcgagaccgctgatgaggaggggagctcgagatcgtcagcacgaaccgtgaggacgtcgacccctcattcttcttcttcacctcgtcgtcctctctacttcctcgtcatcatgagagggagagatggctttgatttgtgcatgtcggagctcgccggtcgcgccacccccaggtttgcgtgtgtggatggggaaaggcaattggcttgtgaggaaaagaaggagctgcaaagggaaagatgcacgacactgggcacgaccatcgatgaggtagacgagtcgtgtttctcatcgggtgggtgactatgcggcataattggagtgggagaaagagagatcagttggctcggtggagtggtggagatggggaaagtacgaatgagttgttgataggtggggatgggggtgctattattaattgttctcagcattggggcagaaatgaataaaagcatgagttgaatcataaaatttattgtcagtaaaaaaactctatttaaagccaaatacactgtggagggtgtttcctacaacttttggtaggcctaattgccgacttaagcttatcaagtgtggtacttacactgcttgctccaatggcttcatcaaacaccggtcagtaaatattaccaaattcgacacataaacttaattaggtcacatgtatataacctaagttcgtgactaagaaaattagggaaaatcctccccatcgggcgcccgatgggggggtggggagaaaaaatcggactcccgcggctcccacgcctcacgcgccacccccaccacgcacgctttgcagcaaatcacctgcatattacggaaacgccctattaggagaatccgttttattttttttccaccaacaatgtttcagctagtgtactcatgatgtttcattatgtatgtaccaaaaattgctgtagatttttgatactgtcttaataattttatcttgattgacacgtggtttgttgatgcagatggtttaagagttgcaatggcttaaaatcattttgcatatgttaaaccaaattgtttcatctagcgatctaattgtatttcacttttttttttaagaattgaaacattatttctctatttgctaaaatattatttttatatatggtgaaacaacgcccgattttgtggaaaccgttgtttcatatgttgtagcaaaatgttttatgaggtgattttgttgtgtttcagctttttaaaagattgaaacattttcgatctatttagcgaaatattttcagtctacttagtgacacagcgtccaatttttgagaaaaaaatcggacgcctgatttgcaggcgactcaaaaaattagcgctccaataatactcctgtacagtgaaatgttcttaatatgtacagatgcttgtcggaagaacatatgcttgattttctcgccgagaagataagataagttcttctccacttgtctcgctagcttttagaaagcagctcctttttttctcctatggactcacgactcagtcacgcatgcaggcacatgtctttgccataaagcgtgtttgctgactagctaaagtatgcaaaattctaatataacaccaccagcaatgctgggtcttctcttttgaaacaaaaaacaatgtgaactcagcagctagcgaaactacttggagggaactcttccctactctagcatgtgcgaaatcacacaccaaaaacattagtttaattaattgtaggacaagatagcaaacgtgtggctacttaattacaacctatatatacatatagccaatccatggtagatatcgatctgaacatccagtagtgtagctagtacagtactgatctcctcctatacatggcaaaggagaaagctccttgctgcagtacaaacaacagcagcaaagcaccggcgacggcgaggccgacgaccaaggggtcaacaacagcgtccggcaatggcaggccaccgccgacgacgctgcacgacgtccccgacaagctcctggagctcatcctccaaaacctcgattcgtctctctcgctcgtccgcgccgcggcgacatgccagcggtggcgccgagtcatcacccaacagagcttcgtcctcgactacgacataccaccgcatcagatcgtgggccactaccaccaccgtctccatccaccatccttcactactcccaaacccagaggctgctgcagcagcgtcgcgttcgtccccacctcgccggagtttctcaccaccggccgccgccgccgccgcttctccctcgacttcctccccggtggcggctcgcggtgggagatcgtcgatagccgtggcagcctcctcctcctcgccaagaaaaagaaatccaactggatgcgccgctgcttccccgacctcgtcgtctgcgagccggtcacacggcggcacaaggtgatccctcgcatggaggtgatgaagtaccaccactgcgtcggcgtgttcctcctcgacttcgaccgcaacggcagcttctccatgtccaatttcaaggtgacatgcgtggtgtaccagccatacttcggtgtgtccggagatgttggcacgattactgtttgcgagtacatggaggacatgtgggattggacccggcacatgaagcccgacgaagatgatgaggtacccaagcttttcgagtggtacgtcgtcgtcacgcatctcagaaccagacccggtatccatctccatgatagggattcccttcgttttcttggccatgctgggggctcgatattctgggcgatcaaggaagacgaagggtcactgctaattctcgatgagaatgggattgatccccacattttacgcacgccagcgggtgtgcgagggtcagagctgcgagctatcgtcgacggcaatggcgaccgtcacaacgtgcgcgtcgtcgtcttagagggagagactctccgtgttgtgacatggttgtgcgacactgatgagttggttcttgagaagagcctccatttggtggaggctactcgtaggctacaaggctacaaggagagctgtttttgcggcggagtggacatcgtcacggtgagcacgtcgtgtgctgttgtgacgccggtggaggagaagacgacatggatggtctccatcgaccttgagaccatggaggtgacggaatgcaagtacgcaagtgttgcgtatccgtgtgagcttccgtggccacctaccttaagcgcttgcaccgtgaattgtagaagatttggatatatatggtcgttgccctaacatctgtgtctattgattggaataataccctttaatcttgtaagatgatataaacatggcccttgcttttcttgaatgtgtagattggatttagtgttgtatgttcatgaagagagctatatgatgatattatgacctctgcaacaaaattttgtttgaaaattttaaaatcatttgaaaatcatgcaagggatgcatgcatttatgttataaaatcgatgctcttttgaaccctttgacattagagaagaagctaggcagaactactactaaatatgtgcaatcacttatggccagaattgagcttacaacagtggccaaatcctcctccatctcctcttctcctccacctccatccctgtcccctcaccaactcatccggcctttctcttttccctcaggcggtgacaatgatagccacggcgacggtgcgtagatctatcgctggccgtgacgacgacggtggcgacagtgcatgaatccactgccgaccgtgacgacgacaaaaatctggatccgccaccaactagccttgggcgcatggatcggccgctggccgggacaacaatgacggccgcgacgacgatggcaacagcgcctggatccaccgtcggccgcgacgacgacaacggttggatccgccgctagctagcttggggcacatggatccaccacccagcagtctcaggtgagcgggtccatcaccgacgcctcaggccgttctcgaaagcggcttcgacttcaactagcagcggctttggtaggttgggtggtggctctcaggctgcgcccgcggatatgaccnggcgaagttttttttgctttgtgtgatatttgatgaatttgatgaataaatttgttgaatggatcgggggcatttgaatatgctcgaatatggaatttttgaatttgttaggttttttttttgcgctttgtaaatactttcttaggcgacctacgaaaatacactattttcgcggggattagcctcgtgttataactgatttgtccgacggcaaaaatgattgttttaaagtagtgcccaaattttctaagccaatccgtctagctagacacacaatcagtttcaagaagaaaagattcagttaatcaaattcgagcttaattagtggcatgcgaagcatattcgacaatgacccacgtacgctttcctcgtcacccgcacgttcaaccatgcaatacatgtgcagcccattttccagatattctagcggacgaagcagctatccacgcgcatatggagtcagctttttacgcgacgtacttgccgcgcgccccacgcttacactacacacgctcttaataaggaaaaaacgcgtcgtcagtcaaacaagctgaccgagatcgtggccgtgggcttagtactaatctctctcgcgcgtgaccctaacacacagtcacgtcacgtcttcacacacctg

SEQ ID NO: 19168 - DNA, 5243 bp, Oryza sativa
  unsure (1)..(5243): unsure at all n locations
ggtgccaccagggtatcctctgtcctcccgacctcagcggttaccagtgcctcggcgtcttcctcctcgacggcgacggcgacggcggccggcatcggcatgtccaacttcaaggtcatctgcgcactctacgatcgttacctgctgaactatattctccctctcagcgagacattggcctgcacgttcacctccggcagcggcggcggcggctggcgcctaccgcacagcacagccgccggtggcgacgtcacactagagcatgtaaggctcgacgccacgagcttcgtggggcgtgcaaatggccgcgtctactgggaaatcgagggcgacgaaggcggcgacatgctcgtcctcgacgagaccaccgcgggattctccctcgtgacgttcccggagaacgtccgcgagagctacgacaagcggacgttccggatcatcgccggcggcgacggcgtcgccatgcgcgtggtccgtgtgataaacaacgacctcaaggtgttcgcgcagctcgacggcgacggcgagtgggtgctcgagaagcgggtttggttgccggcggcggcacggggcctgccagggtacgacgaggggtacttccaggagcagaacggagaagccatcgttgtcgcggcgagcgcggcgtatgtgctgctgacgccgccggtggaggacacttggctcttctccgtcgagctggagacgatggcggtggagcggtggcatgagaggaacaagtatgccggggtggcttacccctgcgagttgccatggccgcgggctttgcaggctacggatgctgatcagattagtgggaggagacgatgctgatgagatgtggattgattctggctggtccaaaactgtttcgacagttgcatgcattcactttgcgttgcatgatgtttcaagcgcaataatattgctggcggaatattgatgccttaggtcgaaaagtgttcttggcccgtcaagcgaccggtcaggtttatcgttcacattagccataccattttgcaaaaacattctataatctggaagcaatgtaatcaaagagtgacatgcctcggtcttcatcttcaaaatcttcgaatattcgcgtcggaactaatctccgtacgtcaatgtttgagtacgcacgaaaaagagagaaccaaaataacttaaaaataaaatactactccctccgttttatattataagtcactttaatttttttctcaaacttttaaaatttaatcaagtttatagaaaaatatatgtccatttttaaaacaaaacaaacatattattaaaatatattaaatgttagttttataaaactatttaggtattatagatattactaattttttttataaatttagtcaatcttaaagaagtcaaaacaacttataatatgatacggatgtagtattattaataactaatagtattagatagagttagtgttacaggtaagacatacctctcatatatggattctcgtgatatacggaaatgtatattcaagtatggtaataaggtgagtcaggaaagaaactgttttcgtgggaataaaagacattggagttcaacccaaagaatacaaggttttgttcagcccatattctacttggagaagacatccgtacaaatacaaggcccgttgtggggaggagaaacatcgaatcacaagccatagtcaaagccacattgagagataatctggaagagtcagagccttagttgtcgataccaactcatcgagacgtactcggcatatccaaatcggcaggttagattatctaacttgctcccctttgtaatccgtatggtacggtgttttttttcaagatacacatataaacttgagtagagttgttactcatcctgagaacccaaatcaatataaatcattgttcttccattggtctccttattataatcttgtgtatatctaggtacaaacgaccccatactctataaataccattgtcgagtatagctcgtcgatagatagatctcaatttcaagaaaaattgagacttgaattggattaatcggagctacagatggaaagatatggagcttagaaatcaaaaacatttttgggattatagaaaattaagactttcgaaaaataatttggatttgatttagaggatgacaggtacggtcaggtcggaggtgggtaaaatggacatcggaggaatgaaaaaggagaaaaggcccgtgggctgcccggccaggaaggcccgtgggctgcccggcctagcctaagcgcgtcccatagtggtagtctgcccttgcggtggcggcgagctcagggttgaagcacggcgctgtgggctgaggttggagaagaagaggggatgaccacggatttatatgtggtgggtagcgaaagaggacaacagagagaggtggtagcaagagaagtgagggagcggccggttgccctagcgtcattatactgctggcccaaattttggaagaactttggagtaatttcgaattgagaaattcaaatcctatgattgaaattttgatagggatttttggacggggaattttaatggtcgcaaggaaggattcaactaaaatcttttggtgcttatgtccttaataacatttaaacaaccaaaatgtttgaaaatagatttttttattaaaatagtttttaacggtccgaacatcggggtgttatatgaaatcaaggaagaagtagtttgcatcgaggccaatcatttctagcggtgaggtaaaacggacaaaaggtgcggctatggtagttgttaggacatgactatcggaggcagtgatggtagtacttgccaaccttccacggacggggtgatcaaagcaacataggaagttggcgttggtgactatgcggcgccatcacttgcatgtcaccatttgggaaggacgagctagagtggtgatgcagcgaggtggaggaagtcgcccagtgtcatcaggaatgactttgttgtctgcactgttgccttttttcatcaaggaataacctacattaatttttcacctcattatttacctcaaggggtgggagtttcggttatcccggaccaactctgagttctactctcctagaggacagaactcagataagcttttcacccctaccgctacccagtgtggcctcttccttgatttttgccaggatgctcattggtgtgtttgcaagctccatgaacactttggagtttttttttccttccaaagctcccaagagatgtggatgattagggattttatgggctacattggcgcgttcagtaaggtgaggaggaggttccaccaatcttgtactgagttgctgcgactgagtcccaaattcttcttgtcaatctgcaatggatcagaaggtgaactacatattctggtgtagctcagcatagtgggcagaaccattggttgggccattggcgcgcttgtaatctgtcagccatccaaacaatattttgtatgattagctaggcgaagaatttgcacttcgatggtgcccatgtgtcccatatgatgttcttaaaaaactatttttattgctcctttgaactgtatcatgtaggctgatttggacgagtattggccgtgctcagtgaacctccacttgatgcagtcttcggtgtttggcagcaggtcgattgtttggatttgcatccggagcttgacaaattgttgaaaatgctgggccgtggcatagtgcatagacaggaggtcacctacccaattgttgtttgaaatagcctagttaactgatatgttcttccttcttgagacgcgtagatattcggtgcaatggaccacgggatttggccattcaaccatttgtcgttcaagaagatcgtcttgttgtcgtgctgaccctgatttccattgccgcattaaacatagccttgtagtatttctcattgcaatttgcaaggcaccggcatgctgcaccaaaggtttgtctagcgccaccaattcaaaccaaagccagcgcagagcttagtgctcgagcaaaacgttgaaggtccagtgcgccgagaccacttaggtctttcggtctgtattccagttaattttgcatccccccggggggcaccggagaggtttacactaccggcccaaaggagttttcgttttatcttgtccaatgcttggaacatggccttaggtaacttgattgaagttaagtggtagatcgcctgggccatgagaaccgttttgaccagttgttcttcccgcatggttgaggagttttccctgctaaggaggaagcgtgtatgctgccttgcctatcagcggttgatgatgcgctttcccaagtttcgtcaacgagaggggtaggcctagataggtgatcaggaaatcaccttgtgtggcaaggaagttcgtcatgatgttgtttaggttaatctaaaagcagtgaattggtgccacttgactcttccgcaggtgaattagctctcaacactactagaaaaagcatttttgcaggcggccaaaagtagtttttctaggcgggggaaggaccgcctgtagataaacgcctgcgaaaatcatcacccaatggcccgcctgcgaaaatcctctggacgaacaaaaaaatgcgccccgaccacaggctccgcaccaccacagtcgccgtccacgccaccgcctccgtgtccgtgccgccgccgctgcgtccgcgccaccgccgtcgctccccctcggcggggagggagggaggggagggggatgatgggcccggacggtggggagaggagaagtgttaatggatgaagagagagagagttgagagganaatgagtgatggggagggggtaagaggagaagataaggagttaagttttttttttggggtaggtacgatttttgcatgcggaccgcttaaatggtccgcttgcgaaaattattttcgcaggcgccgcttaagtggtctgacagcgaatttcaccccgatttatatttttgtaggcggtcatttggctccaagggtcatatctgcctgcgaaaaaaagaccccacatcgggtaaaatgctttttctaagtagtgcaagcccgtggattcaccaaagacctctagggtttgagctaaggatgaaaacatcccgttaggttggtgcgacgaagattgcgatatcatctgcgtaaagggatgttcgcatcctagcttgccggccacttagacatgataaggtgccatcctccgttgctttgtctagtacttgaagaattgggtcgatcg

SEQ ID NO: 19169 - DNA, 4199 bp, Oryza sativa
ggatcccccagcccaagtccctaaacataccttaagttccagttggtaacaccaactggtactaaaaatgcatctttagtattggttggtaacatcaacccggattaaagatatttttagtaccggttggcaacacgttttataccggttggtaacatcaacccagactaaagatgtctctagggttagtttaaaaagaaagtatctttatcgaagtcagatgtgtgtagtaggtgggatggtaacgcgcgtgagggctgaggtgagagatcttgagttcgagtcccacaatcccacatatatatatatatatatatatatatatatatatatatatatatatatatatatatatatatctttacaacagtttccttcaacacgtactaaagatcatgactcctcgtcgctgactgaagcatctaggccccggttgttaattttgataattaatgacaagagctaattgtggactaactgttctcttgagttatatattttgagttaggaccacgtgatatgtgttcatggatgattaccctggactaaattcgatggcgcaaagcaaaaggaacgaagatggtaaaactagaggtttttattttaattgatcgaggagttaggcgatcaaaatttgctagttgtatttatagctttgccgtactatcaagaggggtaatgacctaaacaaagagatgattaaaatgcgcacattatgtcatttgtatttagactggttctcaatctatattcatttctctctgtctggggctggtctgactggcgggtagatgctggtctgaccgatggctcaatgccggtctgaccgaccccttggaaggtggctgtgggcctaggtggtgtgctctggggtggaaaacccgagccgccagagccacagtcggtcagacagagctagtggcggtctgaccgagccatggtcggtctgaccgagccgtggccagtctgaccggccaccgtatggcggtctgaccggttgggctgagtgggatcaataattgcacttgtaatggctagttttctagccggttacaaagtagttcggtcttgacctgccagacaatggcgatctgatcggcagtgcacatagttgagggatttctcctctaatggctaggttttgttggtgggggtataaacactcccccaccagcagcaaggggactctcttggcacttgcttctcttgcatacaccctttgcacactctctcacactctctcacactctctagtgcttgtgttcatctattaggtgtgattgagggttgattagtcaagagtcaagtgcatttgcttgattgcaaagatagtgtggcgcttgatcatctgcgagccgggtcatcgcttgttactcttggaggttgccgtctcctagacggcttgtggaggtgttgcctggtgacctctccaaggagattgtggagaaggcccagcgccggttgtgagtggtttagaattaccacctttggattgaagaagaactacccctagtgatcgaggcttgggtatttcacttcgagggcctactcccaccttgcccactgcttgattgtaacgccttgacattcgttagccataaacacagctaactcacaccagggtgttatgcattacttgtgagatggtaccagtcccaggatacactagctggtacacacaaaataaatgtggaatctaagtaactactttattacatcactgggtagtagtccttacaaagttgccatcatggataggtccatagatgaaaacacaacatcatagaaaaacataaagcgatggtacataagcgaacaacgcggacagactaagcgactaagcaactatgcactaggcaaagaacctaggcaactaacttattccacaggcgaggcttggggctaggcacgaaacatctagaagtcttcatactcggcttgctcgtagagatactcctcaacggtcgggtcgacgtcttcgtcttcgaactctatagcttattataaggggcaagggtgagtatttaacgtactcagcaagccaggggaaagaatgatatgttcggtttaaacaaggaggctaaggttttatttgcgaaagctgcccttttggcaaagtgatttatttcacaaaaactccttgtgagtcaagttttagttgtcgggaggaggctcacgtgtcacgtcctgataaattcatcccgagaataaaaatcattcgctaaaaggaataatagaattaattaaaaattcgaaaagaaattggcaaacactaaaatacgtgccagaaaaattcaaatgtggcccggggaatttttgttaaattctccttggtctaaaaagagccctcaaattttacttgaattttcagagcaccggaaataattattaagcaacaaaaacaattatcaaagtttattaaaaagaaaaacctaaaaataatcctcttcctcctttgggccaagcccagcccaaagtctccctttcctccctctctttctctccctctccttctctccctctttctcttgggcctcctcccctctcggcccagctcccttcccccccctctctctcccgggctctttcccccccccctccttcctcccggcctggctcggcccagccgcccggcccaaaccgcctcccccttccccccccctgggccggccgcccggcccaactcgagcggcgccctcccgcccgagcgcgcacgtgcgcgcgctgaccgcgcgccccgcgcggggcccacgcgtcagcccgccgtcgctttcttcctcctcccagccggcctcctctctctctccccgaaaacctagcttcgttcctccctcgaatccacgcgatttaagccttggattccaaaattgattggggggaattaatccccattgattcctctttgatttcccccgtttttccccttgaatggcgccccccatcgccgggaacgcccgcgttttctcgggccacaaaccattgccgcgggccggctttcccgccggcgttccgaccttccccgtggccggctccctcccccattctataaaatgggatccccgcactccgttctaccgttttaaccccatcccgagcctccccgtggtctctagccccatccccgccgtcgccctctctctcccacgccgccggcgacctcaagccgcctgtgccgcctcgcccgtgcgccggccggccgcgccgtcgcctcctctagcatcgcagccgcctcctcttcgccggcctaccctccgtttcgcgcggtgaccgccggaggcgcactcccgccgtcgcccttctcattcctccttgccggccacctccagccgcctctccctcctcaccgaagcatcgtccggccgtgccgtcgcccccctcggctctgcaacaccgtccccttcaccggcctcaccgtctcctcgccggaaactcgccggaacggtgccccccgccggccaacccagtgacattggtgccactgtactccctccagccggctgctgttcatcgccagtgcgccgatcgacgccgccgtctcctcccttcgaccaccagcggcatcgccttcttccccggcatcacctcctcctcgcccgaatttcgccggaacgccgtcgtctccgcgccggcctctccttcctcctcgtcggctcgtcgccccgctgcaccaccaccttcaccaacatcgcagcggcgtgttccacgccgtcccctcctccgctcagccgctgtgcctgccatcattgtttcatcgtcgtctccgatcgttctcgtcgtcgacgtcccatcggtcgcccggctcgtcgtctcgcggcgccgcctccgtcgtcggcatcgtagcggcgtgttccacgtcgtcctcgtccccgtgcagctgctgctggctgcccctcgtcgccccctcgccggtcccggtcgtcgtcgtcgtcgtcgtcctctcgtcgttcccggtcgtcgtggcgttcgtccctccgtcaagccgttcccgttcgtcgtcctcgcttcgtcaaggtcgctgcagcccccgtcatcgtcttcgtcctcgcctccgcgtcgtcaagcctcgtgccggccgcgtctcgccttcgtccaaggatcgccgccgaagccgtcccctcgccgttcgtcttcgttgtgcccgtctgtctccgccgcgcccgttcgtcgttgtcggtcccgcgcctcgtcgcgtggtggta

SEQ ID NO: 19170 - DNA, 1430 bp, Oryza sativa
ttttatagttgcaaagcttaattataataatccgcaaatctccatataacagcattaaacctcggatgatcatattttggtcatacgaactccgaatcgacccgttcaagtctcttaatgtttgttataacctaaagaaccctgtgctttgtttttatgtattggtattgcttcttcataggcttgtagctttgcttgtgtgcttcgcgtagctttcgtcgttccggaggttcccgaagcgtggttcgcggtcgtcgccgaaggttcggaaggccgttctctctgagcaaggcaagtcacatcacccttgagcatattgaatcccagtttataaaattattttgatttaaattatcgtattatcgctttgcttaaattcccgcgttatcactgttttatttagccatgcctacttacctttggtatgacattattattgctattgttattattaccttgttcaccctaggaaaataagaaccccaactagtgggtactctattcatggttccactagtataaatttaggtagatgcttcgctgaataattaggcaacattaggtggttttataactttagactttgggaattctcatatcatttggacaccatggaatggttggcttatgttggaattggacacacacctctcttcctctttcaaaacccctaaaacctgttttcggtggggtttgggtgcatgccagttgtgggaagtagcacccccggccactataaggactaaagctcgggcctctgttgcaaagcactaccgtacttccacatgtctaatgggtaaggcttagtttgtggctcagtctagtcataaacaaaagtacacggattggagatggatgaagtcgggcgtcgatggacattctccagggcaaatgaaggctacacgagctgcggcccggtagtcgagatgtcatacggcagagggttggtgcccaatgctaggggctcagttctgcctgcctgtcccgggtatcccggccgtaggtaggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcaacaactaaaatatggaatggttggcctgggttggcttgggacgagctggaacccaggtcgggttgccagttcggtccgaatcatcgtaggccttgggttaaggcaggttcgtgagggttcacggccttgtttaataatactgtgtagctctaggatcgtctttacaaaatggctttgggcaactaagtgacttttaaatgctg

SEQ ID NO: 19171 - DNA, 813 bp, Oryza sativa
ttcggttggcagcttaggttgtctgttagatattgaagtgtcacataaaagtgacgaacaggcctcaagtattcattgacagtacgtaccatgatggtttaataaaaggaaattaacagggtctgaatgttaaaaatagaaataacaaaaagaaattacaatatctgagctgagcacagcatgtagctacatattttttcgaatcaaatattaattctggagagatatcacgtgaataatgattggcaactacaaatatagattaaatttcaaacttactacatacttttggtcatctctctgtctctctggtcgggtgcatctaatgacgactcatccatgtcttgtgtgcccatcttttgttgaaatcgctgcccagccaaagattatcacacagggccaatatgtaattagcgttcgaataagtagaatctgtgcaataactagcaatacccgattgcccctcctaacatatagtgctattgcaaaacgaacgccatttaaaggctccgtatataagcacagtgatgcaatcatcatcattgcacagattgcaattgcagtgcatcgagtcactggggccagcactaaatacatacctagtgcaaaggcagtacccaaacttgtcactgaactgaaggccaggagtagagatatgttaaagtgccgacggcgaagtggtagactaaccataggcattccagagtacatgaggttgatgatagccaagctcgagcaaatgaatgctattgtgttagccatgatgaatgcatcaaatatataacttccagcaagtgttggtgtgccaccatt

SEQ ID NO: 19172 - DNA, 2508 bp, Oryza sativa
agttggtacacaccaaattgatactatgtatcaagcagatcgtgataatctgcaacctagcccagttgtgcataatgctgagactaggaattcagaagaccatagacacattgttttgggaaatcacaatgagtctataagggttgatgaaattgccatcaactactcggaaactggagaatcttttgatagaagagctacaattgttgacattaatttttctgaataaattgctgattgcctgcaagttgatccagaacctaggtctataaaagagtgccaaaagcgctctgactggaacaaatggaaggacgcaactgacgcagaattagcctcgctttacaaaagagatgtattctcggctgtaatgcctactcctcgtggtatctttcctgtgggatacaaatgggttttcgtctggaaacggaatgaaaacaatgaggtggtgagatataaagcaaggcttgtagcacaaagttttacgcaaaaacatggcgttgatttcaactaaacttactctccagttatgggtggtataactttccgatatttaatatcattgatagtacaaaatcgtctatttatgcagttgatggacgtagtgacagcatacctttatggatcacttgattctaatatttacatgaaggttcctgacggaatcgacatgccgaatcagaaggtaaatcgtaacatgtattgtgttaagttgcagaagtcactttgtggcttaaaacaatcgggcaggatgtggtacaaccgattaagtaaattcctttcactaaagagatacactaaaaatgatgatggcccatgtgtccttatcaaaaagtcccccacaggaattttgtattatctcggtatatgtcgatgatcttaacatcattgggaatacacaagatattaataaagcacgtcatcatttaaagacggaatttgagatgaagaatttgggtcaaaccaaattttgcttaggtatacaacttgagcatttaccttctggaatccttgtgcaccaaagtgcatatacctagaaaattttggagaaattcaatatatggacaagtcatatctttccaaaacccttatggtggttcgatctctagacgtggagaaagtcccatttagaccaaaggaagatggtgaggatgtgcttggacctgattttccatatcttagtgctattggcgcacttatgtatcttgcaaatagtacgaggccaaatattgctttctcggtaaatctattagcaagatatatcgctgctcctaccaaacgccattcgactagagttaagaatgtctttcgatatcttaatagcacaagagatcttagacttttctttaaaaagaaccaagattcgaccttaattgggtatactgatgctggctatctatctgatccctacaatgccaaatcacaaacaggattcgtacttttacaaggtggaactgctatttcatggaagtcttctaaacagacactggtagccacttccacaaatcattttgaaataattgcattatatgaggcatcacgtgaatgtttatggcttcacagaatgattaaccacatattaacatcttgtggtattggttcattagaatcacctaccattatctatgaagataatgccgcttgtgttgtttagatggaaactggttatattaagagcaacatcactaagaatattgctcctaaattattttatcctcatgagcttcagcaacatggagagataaacatcttgcaaactaagtcatgtgataatctcgctgatttattcataaaatctctgccatactccatattttttaaatgtgtcgaaggaattggtatgagatgacttaaaaatttgcaggattgagggggagtaactctctctgggaaataacctattttcgtcatattatactatttttcctttgtatgagttttaccctttatattttctcatccaaagtttttaacgaggtaatatcaacataagttatatgtcttatcattttgcttttccccactagggtttttactaaatgataactatagacattatactaattttggaccatactatgagctttactcataaagtctaaaaatagttaactatatatcacggttcttctccttattttcccaatgggtttttgaggagtttacctgatgtatctaatacaataaattataattatttctaagattatgtttacaaatattctggaacaatgaaagagcaatgatcaaagctggattcgatcaagggagagtattatgaaacaatagggtgatctcatccatataaaaggattgatcgcaaccgaaggcaaccacgcctcttccctacggaattgctactaggcgattgctcgctcagggcgatcagatccgatccccctccccctcctccacgtgggttccttttttggcaccgcattactttcctattttagtaaatttatgcacctaaagtttgtacacctcaagtttacacatctaaagtttata

SEQ ID NO: 19173 - DNA, 846 bp, Oryza sativa
  unsure (1)..(846): unsure at all n locations
tatttttattagaaagctacaaatatttcccactatatatgtgcgtatgacttgcattgtgggccccaacttgcaaaagcatgagttttgcatttgtgtatgacatattgacctataaacttataaaacaaattaagttgtcgctttatgataaaagcaaatatatgattcaaaataagtatggaatatagctagaatgaaattcaaaacagcaaatataaattgcacacgtaccttggtcttgtagaacggctgcgtgcaatgcattttgtctatttgggccagagtacgaaagattcccgtctgtcatttgatgcaataactttgcaatgtcgacctgttgatgcaagacagctaggtacaacggtgaagtacctgttgcatccataaggaagccggccaattctgaataatatttaagaaggttggtgattatatccttatttccaatgcagacggcatcatgaaaggccgtctccttacggcagttttcctttctcaggagttcctccagtctcgcgctgctaggggagttgtccttagtttcaaccagatcaattagatgatcaaccattttggaatggccagcccggacagcgcagtgcagaggtgtgtcaccgttgttgttctgcactaacatgagatgttgggacctgctgtagatgacgcctgcactcctcaagtagcccgggccatcaccgcaggtggccacaacatggagtgcagtgttcccttcagtggtgaccccgtccagatccatgcccgactctgcatctgcaccagnnnnnnnnnnnnnnnnnnnnnnnnnnnnnnnnnnnnnnnnnnnnnnnnnnnnnnnnnnggctg

SEQ ID NO: 19174 - DNA, 3970 bp, Oryza sativa
ttggactattgtccttgaaaaataaccaacacttctcttacttacaaaggccctcactttgaaaactgaaacttcaccgattcatcaaaatagagcaatgacgacgcactttcatcccagcaagatttggaacttaatcctcagttgctgatgggagattcctcataaagaaattctcatttagctcctgatcttactaactcttgactacttccccaaccagttctaactgctggtacaactttcttgcttctgacttgatttttggtgtcatatgcctaaacagattgcatagttaacattccttgaaacaagcactgatcacccaacagatccaactcaagaggtcctttccatggcatgacatttcacttcttcgaccatcctttgctaactcttcctgggttgacggactatagatcctgcaacagctttccggaaaatactgcaatctgaacaactatcggaaactgactttgatgctgccgagagtttctgctctttgatcataaccacttcgcatccatatcttcggtaaagatgatttgttgaaaagagattctatgccatataccttgttgactacacatttctatttctggaccaaactctcgtatcttccagactcatgtatggaacaatttcttttttttttcaacttctgagaaacattgagatgattcctggaacttatattggttgccttgaactaagcaaacaccttctaaattcatggtcacaacactaaggcgtaattgccgattaccatcctgtaacagcttccaaggttagagatttcccaagagtctctatatgatgtcactttcaaatattccatccctgttttcatttgagtaccactgatgttgcctttagagagatctcatcatgtcgagtgttgagggtctaaccattttcactccgttggttaaccattcctctattggctcgcaaacaggttttggagctcaatagaattgcgatgagttaggagagaaacccttggtttcttgagacactgacagatacccattttgatttgcttttgcatgctgaagatgaatcataaaaggagaggaactggctgactcatattttattcaatatttccttttcattacatggctgccataaacatatatgtataatgagaagtactacaaaatcaaacaattgtagactgttgctgattagaactgcccttttcacgactgaacttgaaaagtagaagtcttgtctagaactgctattgcttccattattcaaacctgactgacttgtttctttagttcctactaccagaagtctcaccgggaacgttgctctgcttgttgatcttcgatggtggaggggcaactgtcttgtcagctgtaacgggtaggatcttcttgcccgtggggttaccgagcggtgatttgtcgatgggcctccagattggagcaatacgaggtgcattgctagaactgacaacagttgggcgacctggtgctgacaacacttgccgcgggtgctgacgaaggagcgtacttgctctttgtagctgtagcgagctggttgtctcctggcattgcttaccctgctggcgttggtgctgtaggcttgaaacgattgccggtggaacaatgcgacctttgacggtgcccttgacgataatccgttggggcggaggttgcacattcaggtgtcgattggtgtcatgggcagtgctggtaacttgtgaatcacgactaactgccattgctgctcttggcagaggacacatcactgaaacgatgtactggcttactacagttgcgacagaatccacctgtttggtcccgcggtgcaggcttatgattatgcactttggcaactgaaactggaacaagcaaatactcatgaacattcttggtgacatgggttgttccatggctgagcttcactggagctggcgttggaggaagagcagaaggattgttaccgctgttgccgatcgtcattggttgacgaaccggctgcacgattgtcccttgttctttattggtcttagctatgaccgcgtgcaactgacagttcttaggcacatgatctgttccttcacacaagaaacatgtgaccttccttaaagggcatgcatccaagtaatgggtaaatctcaccacaccggcatgtggggaggcataaactaccagtgtgtcctactatcccacatctagcacatgctttgaacttcaactctctttccctgaaactgtcaagggtcgcatcatcattgtcatcattatcatcatcgttgtcgttatcgtcatcagcagaaaaccgttctcctgattcatcatcttcgggtctgggcggaccgtactttatgagatgacgggttagctgacgcgctcctcggaaggtatttcttcctctctgacgcttgggtatccttgctgcgtcttcaggagtaaattctgaaccggtgatgatcatggtcctgccattatccatcttccatatcactgtcctgttcgctccagagttgggctgcaaagtaccatccttcttgtcggtagactgacttggagcttggttactccctgggcactacttctcgtctttttcaggtgacctggcgaacaccttccatggacagttccttacataatgaccttgctcaccacagtcataacaggtagcacttactttcctttggtctgacgttgacttggctgtcgttatcttcggggatctggacagcattttgacaggggtcttcggtgccgatattgggaactcctgactctgactctgattcgggttccgggctggcatctgatctcgcacctgcggtgggtgacattgacgtgactcctgacattgtcggtgcatttgttgcatctggtatatttggtaccgacgtcgcatctggtggaacaactcttccactgtctgagtttgattagccatgacttggggttgaggctgatcttcaagaggctgacgtgggatactattagaattgcactgaggtgccccatgaaactaacggggtcttgatccgatgaaattgtccctcatgcagaccatctgctgcaggcaccagagagagggggaaatgggaggggttactagagatgaggtactaaaccacttgcctattgatctcttgtgaatggattttatgattcaagttgtttaagcaaacagcctagtatggtcgcatccccaccagtgatgcaaaccatacccctacacacaagcaaacaacacacgatctagaagctaacgaaactaccctcctgggaaggattgggtttaggtcatctccgagaaaacttcacttgatcttcgcggaacgatgactttgaactgatcttctcgctccttgcatgaagcttgaggcttgacttgacttgacttccgaacagacatgaagttgacggctggtcctctaggtgtgacaactaaaagaattggagagactgggaggagaattttgaaaaaccgtttgacaaagaaatgccgaagggcgagaggagacaatttacaaatagggtttttagaaaacttgttcttagggtttgaccatttggctcaacctacagtcgagttggctctgataccactttgtcacgcccagaaatttaacccaaatttccagactattttgcgtattaaatccctgtccaggaccagccagggtacacaaaacgacaagtaatatatagttccaaacgtaaataaagcgtaaaatacttacggaagaggcacttagtcctcacaccgaaacagaacgacagcagcggaaaagggcgattctagcggggcttcagctccactccacaggcaaaactcaactggggtctgagccttggtcctctaactccatcttcagcttagaagcactacacttctgaaaagagggaataaaagcaagactgagtacaaccaccgtactcagcaagccacaccaacgatgcagatgtgcaaggggatacaaggatgg

SEQ ID NO: 19175 - DNA, 7666 bp, Oryza sativa
  unsure (1)..(7666): unsure at all n locations
acaggcgaaccgtagagtagtccaatggcaaagccgaaatataatttacaaaaaaaatatcagaacgaaaaatatggaactttcaaaagaaaatttcatctagaatacaataatgacaaatgacgataaagagggaagatgcaggaggcttttaacaaaggagtataatggtggcgatcgatgggacatatagaaactattaacaaaatcctgaatataatcccaataacaattaaaaagatggacgatggcaggccattaagcgacacggtcacggcggttggcaggacttctcaatgacaagagggaaggcaacgggcgagccgtagatgaatacaatggcaaaactgttgacggtttggcgggacttctataaagaaaaaaatgaaccgaaccgataattatgttcaattataataaagagaggagacgacggaaagatcgtagaggagtataatggaagcgtttgacgggacttctagaaattataaaaacgaaacccaacatgacaataaactcaacaaattacaaggtccaatttgtaaaggttccaaagaaaataaatagaaatagtgatagatcgagcaagaaagggtgagaaagaagcaagggacaacaactgatataacttttaaaaactataaaattagaaatacggagataataaggtttgatttttcaaacttttaagacaatgagataactgtttaagaaattttaagtaaaattatattaaaaaatagataattttgtatggctgctagccgcgcaattgcgcgggccaccaagctagttaaattaacgacttcatgcgtctgtaaatttataaattttcagccagctagaattgtatagctttgtaatatgcagttttagcacattttgaccctaattctttttcttacctatgtttgaatacttttgcatgtaattttatattttttatgaactataagttcaattgatgtttatgtttaaataacttattgttcaaatttctatttaggcaagtgatcggagatcacacctgaaatctagacactttcagattgaaaattgtgtatatttgtacatctgaacttgaccatttggtgcccacgcgcaggcagctatagacttggcgggcgcgccacgctcagagatgggccgaccaagtcaatagccagcagtgatcgtggttggcagcttcaaatcgcgcgctcaccaacctcacaatcaaaatttcacatcaccgttaatttcacacaccggctgattcgattctttcccatggcgcgccgcggcggccggcgcgcggacaaggctagtaactgcggcagcgcgccgaggaaggctaaggccgtccccgccgcggcgacgtccgtggacgacgttcccgaccacctcctcgaggacatcctcctccgcctcggcccctcctccgcctgctcgtccgcgcggcgtacgcgtgcaagcggtggcgccgcgtcgtcactgccgcgggcttcctcgacgccttccgcgcgctccacggggcgcaccaccaccgcgtngccgggtactaccacaccgtcgacgcctactacgcgccggcgctggccggcggcgaaagctccgtcttcgtcccgtcctcgtcatcgctcgccggcgtcgacgggcggctgtggttctcgctagattttctcccggcgagcgacgacttctcctgggagctcgccgacagccgcagcggcctactgctcctcttcaagaagaggaggacacacacacgcagcggctatgcatcagaaggcgatttcttctttactgacctcatcgtctgcgagcccctgacgcggcgctaccagggtatcctttgtccggccgacttcactggatatcgatgcatcggcgtcttcttgctcgacggcggcgatgacggcggcggtgacatcagcctgtccaacttcagggtcctctgcgcgctctacgatctctactggttaaacaatcggcacattggcgtgcaatccgcctgcgtgttctcgtcaggcagacatggcggcgggtggcggctaccgaagagcgccgtcgcggatgacatccagctcacagcaaggttcaacgccatgagcttcgtggggcgcgccggtggctgcttctactggggaatcgacgacgacgacgacgaagacgacggcgccatgctcgtcctcgacgagaccaccacggagttctcgctggtgacgttcccggacatcatccgggagaactaccacatgacgacgttccggatcatcgccggcggcgacggcgccatgcgtgttctccgcgtgataggcaacgacctcaaggtgttcacgcagcttgcgggtagcggcgttgagtgggtgctggagaagcctgtgcggtttgccgaggcgacangcgggangccggngcacgaggagaggtacttcgagcagaacgaaagcatgatcgtcgcgcgggacgcggcgtacgtgctcctgacgccgtcggtggagaagacgtggcttcttcttcgtcgagctgaagacgatgacggtggagcgccaccatgagaggaacaagtacgcgggggtggcttacccgtacgagttgcctttgctgcgggctttgcacgcgggcggcagatatcgatgagaacaacgacttggcaacttggcgttggacgatgatatggaatgacattgtttggtttgatatcaactgttcgtgcacgatcgattcatcggctgcactccgtgtggaggtgacgtatatttaatatttgtacagctgacctcaggcggagtgacatcttgaacgtgtcaggacatttgctcactggcttagaacaaacttgcagcagctagcgggtcggcttgacctagccgcctaggaaaatcaactttcaatagcggttgaatgaaagcccagttgtgaaaattgtgtattttcgctggcctacggttgatggcagctagcttagccacctatagaaacttaagggtttgtttggttccattgcccacctagcctagctgggtaagggcaagccaactcgttgccagcttgccaggggcttgccatgcatataccctttgtttggttggtttgctttctatggcaagaattagtggctagccgtttggttcttcagagtattttgcgccgcttcttttcatattgagcaaaataatattgcacacagatcaaattttgttaactgatggctttgtcacaagaacactacagattcttccacagttaacttggccacaaaaatattacggatagaagtagtaaaaagggcaaagctatatgctaaaagaattccttgaaacaatcaaatatgtttttgaactattttatttcaagttcaaaccaaagcatatcaattatttaaataatatctaaactgcacgtgtcattcttaaactatttagcttgaatacatagtaatattcaagcatcttagcaaagaaattacatagcagccggatagttttgtattatcgattggaccacatattccttaatagaatccagtggcctacccttcaatatggcagctatattctcatggtcgcgagataagtctgcagctcaagtcgaaccatgacagagtattccgtcatctcatcaattatcttgaatagggattcatttggatgtgtcatatgtgtgaaacgcatggtttcagacatattatccatagcccctgttatctcataaaccacattatcatcagctctgactcttttacctttatcagtttttctaccttttacaagcctagaagatgagctacttccagtattgttctcttgatctggaagataatctgagtcataatttcatgaagagtcaacatcaccaggactgccatttttatcaccaataaaatcatcatcttcagtcattgaatggtcatatggtgtttacagaacattaaattcccccgttgcatgcttgtcttaaaaaataaactccatttcatcataccaacgtatggggacgttaatgaatttagccattttatctttggcctacacatgacaagaaaaatgtcagaaacatagacatccatatagtgtaaacacgatagttatttgcaaggaaagaatagttagaacactaacattagtcattcgaacaacttcagtctcatcatataggatttttttctcaacatcatcaaagttgcacggcccgctcaaattctttgcctccataatcaccttccactgagccttcaacttgtgaaacatgtgataaacttgtcgacttgtgaagtttgtgtgatacttgccattaatttgctttgcacattcctcatgatagacttcttgaaatacaagttgtcttccatcagccagtatcctctccttgtagtatcgtgtcacgcccagaaatttaacccaaatttccagactattttgcgtattaaatccctgtccaggaccagccagggtacacaaaacgacaagtaatatacagttccaaacgtaaataaagcgtaaaatacttacggaagaggcatttagtcctcacaccgaaacagaacgacagcagcggaaaagggcgattctagcggggcttcagctccactccacaggcaaaactcaactggggtctgagccttggtcctctaactccatcttcagcttagaagcactacacttctgaaaagagggaataaaagcaagactgagtacaaccattgtactcagcaagccacaccaacgatgcagatgtgcaaggggatacaaggatggtttgtggctatatgcataaaggcggttgtaaaacattttattgagcaaaacagtaaaactgttgagtaattaaaggaacattaaatctccactgatcaacgctacaccacgttgaacaggcccaaccaacccacctgaactacagtgtattgggtcgatttattaagatgggactaatcacggtgaatctggtcgaccgcccataaccgcgggctcggctattcgaatagttttactctgatcagaggtgtacaactgtacccacaagacacagccccacgacacgtttccgtgcgccgacatgccaccacgacataccggaaagaggccgtgacaggacccttcgcataaccccctctagccaagcacaccacacctcaggtttcacccccgtccccagcgggcaacgggcagtcccctctcgtgcctaggtgaatctgaaagcgacagaggccgtcgcagggcccgccccgctccatcacgcccacccttgcctggatgcgtcgactagaggaaagctacactacaagcccagccgttgcccacgctggcttgtggtaagtacgataagttctttcagggcatcccgcgaaccggtccttaactgccatgggtgcgaccagcaaaaccatgcacccacagcccaccattcagtcacattttagttggataattacgaccatgaagcatggccagatgtctcgagcacgcagcttattctgatactaaaaggtctaatacggtaattatcccatcaactgagctagtggtaattaagcatggctaagcatatagttctagctaggtcacataagtaacctaagctagtcgatttattacccaatgttgacaaaggacatatatcaagtaaatatggcacaagcgagcagataggtaaaaccctgaccccatgtaattagcaaaatatgcatatttatttgcaaatagtaaaacatttgtaaattgggatcaacatgcttaaggggaatgtgtgacttgccttgcttcttcactttgatcttccgaactcttttcctcgcgaccgcggacttccgaaacgacgggaactacacgctggcacgcaaaacaaggaaaaactctaataaaaaccaagggaatagtacataaaaattaaacaaacatgtagagatcaattttagatgaattttgcaaattgaatggcccaatttggagttcgtatgaattagatatgaattttagaagttttgagccatttaaatgaattttaagaattaaactcgatttattgtgcaattattatttatttttacaaaggaaatggacctcgctgacgtcagcaaggggcggccggcgccgacacgcgggccccacacgtcagcgagtcaaagcgggagggcgcacggtggacatggtccacacgtggcgtcgggtgcgcgtccaccacgtggacggcccagatcagcctgagccgatcgggcggccgaggggagcggcagccaggggcacaggcgtggcacgaagccggtccggccgagccaaggcgcggcggcggcatgcggccaccggcggcagcagccggcgacgtggaatggcggcgggcggtcggaggacaaccccgcgcacggggacggcgacgcaccccaagaggcggcggtcggcaagaaagggggacgggaaaaaaaagggaagggaggagaggtcctcaccggaagcggcggccggcgcggaggaagatgacggcgacgacgattgcccgatggcggcttgtgtaacatcctgaaaattctcaacaataaaaattactaaaattttgaactttttaacactttttgcatcatgctggatgttatggttgcttttacttgccaaactataaattgtcacaatggaaaattaaactaaagttatacagctaagtaataattataataataaaatatttattatgaaccccataaatatttacgcacgagaaaacaaagccagacaaagggaaggttaattaccaatttaatttatggatcaaatattgaatacttgaaccatgtgatgcgtgccatgaaatataaacacttaggaaatgataatcattcaaataaatgaaactctatctatagaatagttttactgggaaaattaattagatattatatagattgaattgaatcacaaatgctaaattatagaaatccatgtagtggtaaaaccaatccaaaaagataaaccaatatgtgtcaaaacagataaataccaaaatccccaaatataggaaattataaaaatctaggatatatattaaatattggaccatattaaattttgggaaaattcacatttgagcacttaatatagtcactcaactgcttaggagtaaatacaaatttaatttgcaacttttctcaatttataaataaaccaaagccctaaaaataggaatacttagaaaaatatataataaaaataaaaatatgttcaatattaaatttgaatacaaatttcgatggattaacttaggcttggtgtattttacattgtgacaaaattagtggcaatagtatatttttcctaattgcaaaataccctataaaatcaaaaacagttggctagcactgttcattagccctctaggtgtttgatttggttccctaaccaccacccctcctctgccgtgctccccctcgctccccgcgccgcccctgcgcgcgccacgccgctgccgccctctgctgcgccgctgccttgcgccccgcgccgccgtgcgccgtcttgtcaccgcagtcgccctgccgcgccaccgcgtcatgtcaccgtcgccgcgccgtctccataccgccgcgcgccatcgctgtcgtcggtcacatccgtcctccgcgcgtgccgtcgtcgtcgccgtcgcatcgacatcatcgccgcgccgcgcgccgtcgccatcgccgttgcgtcgg

SEQ ID NO: 19176 - DNA, 4661 bp, Oryza sativa
  unsure (1)..(4661): unsure at all n locations
tggcaaagtgatttatttcacaaaactcctagtgagtgagtcaagtgtttagttgtcaggaggaggctcacgcctcgacccattccacaagttgctttgcaacaacttatcacgattaacgaacaacaattaatttgtttcctctattagtttcttctcacaacaacacatagtccacacagttatctcagcacaacaacgccatcatggccctaacaacacctcggtgtcggacgacaccccaggtcacacagacctgttcctaaccacataggttagccgtctgccacacaggcggactctggtaacgttacccttcccaaataaccacttcacaaacatttgtcaaacaaatctacgctatgagaaacaccttacactcgcccttgaccgtgggcacggctgttcggacagttcattaatctctgcaaaggttgcacgttttacccacacgacacgaaactgacatcgtttacccgtcggcaacgaaagttcgcacgccaggaaataccgaggatgtctcctactgatttcgtacaccacaatagaggcaaaataacacccatgatgggcaaaaaggtaaaaacttcgtctcctcatcctcggcattccacaaccattggcacaccaactcccatgtgatagcaatttacttagccagaggcatcccataaatacccgtgtggtcgcactgtaatgtgtttggatggatttcccaaaggaatcgttccttaacgacaatacgtagccaaaccacaaaggcatgactccgcatcatcaccactttcacaacacattttatttcacaacacctcggtacaacgtaccggacttttaaacatgtatttggcaaacaacataagcatggctaagcgaaactatctcggtattcgtacaacaataccggcgcaaatatttgtggagctatcaaaggtatggaaacatcaacctatgaaatataagtgcgactcctaggttggtccgtcagttgtataaacaatccgaggcctaaacatgttaatcgtgtatactaagcaatgcatttttgcaaacaacatattattgaaaatataggggcaatgtgatcaaagaggcttgccttgcacagggttggggtcttttccctcgaaagcggcgtccggagcttcctcgtactcgggctctaaacgcgaaaacaaatctaaataagaaaaggcaataaaactatcttaaatcagagaaataacagtgccactgtgtagatctcaattttagaaaaatttagaaacttgaatggggtcaatcggaattatggttgattttctacggattttcaaaagataaaatattttctgggattttatttattggacggcaagggaatattccgctagggttgacagcaaaagaagggtcccacctgtcggcaactgttggaggggaaaaggtgtgggccccggctgtcagcggctcttggagggaacgaggcgcggggccggcctggcagtggctcggctcggtttcttcgtcttcctcgcgctctgctcggctcggcctgagggcgcgtcgcggcggcgaggcccggctcggcgaccggcggccggggaaggggcggcggcctccggcggagctcctccggcgacggcggcgctagaagacggagcgcggcggctctaggcggcggcacagagagtgaaatcgagagaaagagagaggagagagagatgggttgggatggtgatggtgtggggaagaatgggggagcttggggcccttttataggcggtgagggtttggcgggatgcagcggcgagctggcggctagcctccgcgaattcacgtgtagctggctagcttcttcagcgggattccggggtggatgggatagcgacacgacgacgctgtggtggcgaggcgtcagcgaggtcacggtcgacgggacgcggcgatgcgatggcgacggcgatggtgcgacgcgacgcgagatgacgcgcgcggagagcgggaatagcgacgggacggcgatgacgcgcggctgtcggcggctatggccgtgattcaagaggcatcacacgcatggcaaaagttgacaaaacagaaaataatcaagttgaacagcattcacacgcttcattgtagcactccgttgactcaattgttaagatactggagatctatagcagaagagatatgctctggtccagtaaaaaatacctcgagataccggtatctcatggtattaaattgtttccgatcgttgaatttagctagacaggatgggcgttgctagatccacttatcgaaaacgatttgggtatcgtgagataacggtacctcaaggtattttntgttagaccggagcaattctcaaagcagaagaccaaggttctcctccaccatatttagtttgacacacatcgggcatgctatcgggctttgggttgcggcactggcccgttctcaatatattgctgcgaggatagtcgtggtgccaatgaggagcgcaaccgatgacttaggaacccttgctccaagaaaccttagaacactgccacccaggagaggagagaggaagaaagagatatatgtgcaccggtgagaagtgagaactagccactggagtggacaagggtaaggcgctgagtcgccattgccatcccttcccaatcttgcggtctcccatcgcccctcggtcgcatcgccgccgccaccgagtcacctcccatgcactgcgcatcgtctcgaggatttttttccacacctcttgggtcgatgatttcttcccggaccggggtgacgcggaaaggccgggatgggttgtgatataatccaaactgggcttaactgaacgcacactttcttgcaagccgggatttaatccgcaccgggttgatccatggggattgtagcccaatcccggccgttcccgggacaaccgaacaaggcctaagaggaaaagattgaaggggattgaggaagattaatttcacacctcaataagtgtggaatattcctctctgaattaccttcaatccccttaaggagaaattaaccaaaaatggtctaattttcgtactgtagaagtggattatgtagaaatatatttatgttcaattcctcttcttagctactgcaaagtttgtatgccacaacctagtttgacttgaacaccacatatgcagagatgactgaaatgttactgaattggaacaaggacctcacagaacaagttgacaaaaatcgaagcacgccacttcacttcgctgcatcactttgtaaagacttcgctgcatcacttagtgaatatactgtaataacgtggatgtcacgcactccgctcattccagtactgctagccaacccagttcagttgtaccagcaagattctgaaggattgtatccgatacacgttgctgcatcctcaggtgccattcggactatcaaatatttaattgaggagcaacctgatgagatcgctggtcttgtagattttaaggggaggactttccttcatgtcgctgttgaaaggggcagaaggaatatagttgagtatgctcaccgtactcgatcattggctaggattttcaatatgcaagacaatgatggcaacaccgcaatgcatatagcagtgcggaatggaaataagtacattttttgtattttactaaggaacaggaaagtaaacttaaatatactaaataatcaggggcagactcctttagaaatagcagacagtaagattcatgaagggttttactatgtatgggtaatacacttctcactctttttgtgtttccactttccagtacaaacaaagcaaaataattaagtagttttgaattacagatccatatgttttctttgcagaacccagaaaaattgatattgctggcattaacacattgcaatgcaagtggtggttgccgtcgggcagatcactttcagaaaaaacaggcagacgaagcgaaggaatcagagaaactgacaacttcaacacaaactctaggcatcggatcagtactaattgttactgtcacatttggcgcaattttagccatacctggaggatataaagccgacgaccattacaatggcggtacaccaacacttgctggaaggtatatattcgatgcattcaccatggccaacacaatagcattcatttgctcaactttagccatcatccacctcatgtactccggaatggctatggttagttggcccctccgtcgccggcacttcaacatatctttattcctggccttcagttcggtgataagtttgggtgctgcttttatgctaggtatgtatttggtactggctccagtggctcgatggactgcaattgcaatctgtgtaatgatgatgattgcatctctatgcttattcacggagccattgcatgcaccccgtgttgcaatagcgatgtatgttaggaagggaaatcaggtattggcagctattgcacgtgttctccttattcgaacgctaattacatattgggcctgcgttgtaatctttggctgggcagcgatttcaactaaatatggggcacacaagacatggatgaatcatgagaggcaccggacaacagatgtgatcgagtagtactgtgtggtgaaattaacacatgcatatctctatatttgtaatcccctatcgttatacacatgatataactc

SEQ ID NO: 19177 - DNA, 592 bp, Oryza sativa
tacccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgttagtacaaaagtaccggacacccacccagatcccaatag

SEQ ID NO: 19178 - DNA, 537 bp, Oryza sativa
gcacgagcaccaacgaagatgatgaaggctcgtgtgcagatcatccatgctcttgttctcactccaactgctgcgctcggtggtctttcatgggtgccttgtcactagtccttccttgcttgctttgctaccttccagctactggctgtgtcaaactctcccagaaatgctatgaccaagccagcaggcccgggtgccggtgcaaaaacacaaacagtgtcatgtgcaaagcgccagatgccgtcaacagaccagagaagccattctgattggccgaccataaggttgcgaactgtgttacaaggatgcatccaacactctgcaggaaattcatgcaaaaaataaaataaatgactgtaggcggataccatcacctaaggctttaatatagcattccttacttaattagggggatccagcaagacctggtgtcacactgaaggaaagaagtaaatgccttatgtgtgtagtagctgtgaactgtttctaacttctgtattttaagtgtcagagaagagtcatgttttagcacagtgg

SEQ ID NO: 19179 - DNA, 201 bp, Oryza sativa
catcaaccaatattgagtgacttcggggctgcccacctccgtaccatacctttgaagaaccagccttcgttcaaattcagccatcaaataattaaatcgagaaaagagggaatcgaacccccatactctgatttcaagtcagttgcatcaccactgtgccattttcttactagtaaactattaaaaaaaaaaaaaaaaaaa

SEQ ID NO: 19180 - DNA, 1933 bp, Oryza sativa
catattgtagaacatgataaagtcagtagcaaatcgtagacgtgtgataaagtcagtggtaaataatggattctctctagaaagatagtagagatgaaaagtgtaaaatatgtaagttaactaatttaaagtgaaatgtttaaaaaaaactaatttaaagtgaaagattagtcaaagggtggtacaaagtgaaacttcagcactaaaagacacgttaacgtatcaattatgaaaagaaagctgaatgaaaaaacaaaatataagtttaaaagttaatataagagaatgtcagcctttacgtgacgtgttgaatcgtccagattgtagagaaaggaggtaactcacatgctgtcgacgatttagatcacaactatggtatttgtatgatatgagaatcgttgatatcaggacatatacgagattgaaataaaagagacagagacaaggatttttatacaggttcggaccccttattcatcagaatcaggtaatagccctactcttgttggacgaaactggtgttgctcttattcattaaaatcacacaaatacaataattgagataacctatctagtcgtcgtcgacttggcggcatggaaaaccaatacgtagtcgatgacggggtagttttcctcctcaaatacatactcggcgagatcagagatagcgctagatcccacttgacggcctccgatggcaccagattgggtatgtcgacgctaatctccgatgtcgatgtttagcggtgtgtattgatgtctattctgactgttctgtgtcctctcttcctctttctcttaggaggtcttatatttatacccatagatgtccacttgtctaagtagaattagggacacaaatatgaatacaatctgagtagtctttatagtttcaatatagaactctacttgtccttccttattcggaactccttttccatatgaggtatgattccatataagacttggtatatggtggaccccgccgtgcttagtcgactactgttgggtatgtattatccataaccctgacacatgctatgatctcttagcgttggtagacacaacgatgagctcttattctcgagtgacagcgaaatggcggtggtgagttagagtttcgtttttaggtggggtcaaggtgggataggagtaggaaagaggggaagagggggatttcctcgagcttagagggatgattgttggtgatgacggataggtgacaacacagaggggaggggttgccttagtttggaggacacacggagagggagaagcctagttggctgggctcaccgcattgacaagctcgagggacttaggagatgacgggagagggaagccgcatgtcatggagtggggaaggagaagagattaggggagagagtaagggtctacacgaatcttgatgcagttctagcattcaaaaagttgaataaaactttaaaataactgaaaagtagaccatcctaatttcttaaattcaaaaaatgttttggattttaatacaacgaagagccaaaggactttaattaagggagctattagccatcctataaataataaatatgttatgtcaatctatgtctacgtaaaatagagaaaaaaaagagcgaaatatagattacacccttccttttaccaatgttcagtaaaaggggtccaaaataaaggaaaaggtacgataaaacttctgtaaaatcttctctaagatagttaagacaactgatacgacaaggatcaatttgatcacatccaagcaagacacttatttttgtttctctatttcttaattgtgctctatatctgtcggagatatggacccgggggtatgtgaagtagaggggaattactttccctccggccacgtgactttgcaagttagccccattcacgcgtcacgcgagtcgttgaagcgggggggggggggagg

SEQ ID NO: 19181 - DNA, 3649 bp, Oryza sativa
atccccttgagctataaaaggaggaccctgcccactgagacagggggataacgcccagaaaacctgaactccagaagagaggaagtgagcgcgctttctagagtgaagaaacctttgtaaaactcatccataatcccaaacacaggagtagggtgttacgctccatagcggcccgaacctgtataatccaactgcgtgcaagcttgccggtaatcttagggacgagcaagtgatttccgagagacgagcctccgcccccggccgaactcacaaatggggggtctcacgattccccgctattgaggatcttccctcgacaatatcaccatataaaattcatgtaacaccacaataattatatatggaagtaattttgttgattccatgattattaatctataagcaaaaagggaaaataaaatgaaagaaaaagtgtggaactttgcttgaaccaaacatggcattgccaccaccaacctattattgtcaaatgcgttcgccgcggcggtcaactccacacccccgcactttcctcactccacactccccgcaccatgcaaaccaaccatgcaatcccccactccccctccccctctttaaagcaagctcccaccaccccatgcaccccacagcccattgacccccacctctcgccatgccatcgtcatcgtcatcctcggtcgccgctgccccttctggcagcaatggcacccgccgcgacggtgggagcgggagcgtcacgggctgcctcccggctgaccaggcatgcttcgcgctttcgtcgtcggccagctcgccaggctacctgcacgcctcggccacaacgacgcgtcgcgatgcttctgccaccgtggcgcgcgcgtgctgcaccaccgcgtcgtacgtcgtcgtcctcgggatcagcttcggctccctcctcgccatcctgctcatcctctgcatcatccggtggtacctcgtgtggaggtcggcgcgaccacggcgggacgacggcgccgcggatgaggcggttgggtcagccaagaagcggtcggctgggctggatgacgacgccatcgcggcgctgccggtgttcgcgtacaagcaaagggaggagggcggcggcggcgcggtgggggcagcagaggaggagaaagaggaacgggagtgcgcggtgtgcctccccgtgatggccgacgggaaggcggcgcggcggctgcccagatgcatgcatgtcttccaccggggctgcgtcgatgtgtggctcagggagcactcgacgtgccccgtctgccgcgccaaggtggttgttaggccggccggtgcggcgcgcgttgagaagttgccgaagagcagcgcgtcgcgggcattgacatcgccggtgccggcaccggcgccgaggccgacggggacagtggtggacgacggcagggagagggacctcgaggcgcagcagtagattattctgtagtagtatatgacatgagtgtagatttattagaaattaattattgttgtgtttttttcatgaattgcttactctctcttttttattattgtttttcttcaattatttatgggggtaagttgtagctttagggatgtgagaaatatgagtctagatcaagacgcttacgcaactatttatagggttgtactatgtgacaataaatagaacgcagataatgtctgacaatatcgcggtatcttaatggtgagatctctgaactttcaatcgcttaaagatttgtgttgtggtgggacatcatatttcatagtcagctgcatgtcttcaatggtggcaacacgcttggtctttcctctagataattttttcgtcttctctccgtgattgtgaatcttatatatagtgctttcctgactatctttcctcggtggtttctctcataagtatgtgattgtgttatgcgctttgtgtccatggcgttgttgcatgagtggaaaaatgacattctttggatggcgcccgtccagctctctctttctttttgcttcacgggtggtccatccgacagtggtggagggcttgtcagggttgtgtgcatgtcaatgaatggcggtgcaaaagtagatctagtttaggattggggcatggcctagctgatgttttttcagcggttttatggattccatcattggagcggtcgagctattgcggtctttaaaactactgtgcaattagcgctatctagattttgcttggttttcttgtttgtcctcacttccactaatgattggatgaatggggatatgaaccaacataaagtgatcatagttacgactgaatgcggtggaggggaaagctttatcaaatttaattataatttttatggttttttctatactgattcttgtttttcataatataaatcagatataaggtgtccctaggacgtcgttgttaaaaatgaaaacatgttaggtctttgccaggctataaccaaaagcagtgagagtgggcattctaccttaactattatctcttcatttaagaaacaccctgccttatttataagaaaataataagctattgaaaaaaaatcttgatatagtaaaactaagctttatgcaacattttgatcccataagcatggtattatattgcttcaaattctatctcgtacctataaaaccgggtaccattggtctctatatacatcaagtatgcatttgtactgctacacgtactaattattttttacaaaattcttacaaacaatgatctcaactgtttgatttaagtagatggaagttataagaaacctaaatgtacttataatgtgacacatagtaagaatttagtaatataaatacttgtcgttttgtacaagcctattatcaaacttttaaagatttgattataaataacatctacaatatttatcttagaaatatgatgaccatatatatatatatagattggtcttaaaaagtatttgataaattaatatccaccgttgatttctaaaggataatttagaaatctatacctaattaaaaatacataaggattccggtggattttcgtccatcttcacctaatattttcgtccgcaacgtccgatatgcgagtccaagacaaaaaaaaatcatccagagtccgcatcaacaaccaaatgcccgagcgatccagcgaaaattcatcacaagcataaatacaaaatccaataggacaatccagcgaaagagaaaaaaattaataaaaacatcaccggaagcctctgacgccgtcattgccaccggatctacatgcgggtagccactggatccaccgcaggaagccgccgctgtcgtcgccgtcggatccgctgccatatcggcccacgagccggatctgcacgcaggtagccgctggcgccgtcggtgctgctggatccaccccgggaagcagccgccgctgttgttgccgtcagatccaccgcaggaagccgccgtcggtggcggatcagcccgcgagctgggtctgcacgcgggtagccgttggcaccgtcggtgccgccgaatctgccgtgggaagccgtcgctgtcggatccaccgtgggaagagatcgggccgcgggaagccgtcgcgctccacccctatctctccttatccactcgcgaatggagtcgtgccctcgtcgtcttcgtgctttgccagtgagacagg

SEQ ID NO: 19182 - DNA, 2840 bp, Oryza sativa
caatactcaaatagtaatatgctcatgtcgcacggccgcagggcagtacaggtggcgactaggcgagcactgtccccacccctttcccctcctcccctctaccccgccactgagcggccaccggaggggctcttttcctcctctcatggtcatgtcggcctaaggctctgccactattgaagaaataatctttgctgggtcgactaattttcacaatagtctcggttctaataagaaccgggaataaagattgtttttagtctcggataaaaaatttgtcagaggcttgtcaggggccgagaatctttagtcctggttaataactaccaaccgggactaaagatcaccacttttttcctggttgatagtaccaacccgaagtaaagattatttagatctttaatcccgattggtaacaccaactgggagtaaatatttctctcccatatctgatcggttaagtatcagacaagactttcctcctcaccgagatatttagataagatcggatcattcccctctcctcctacccctcaggtccccttactcctcctcctcctcctccccttcctccccttcatcctcctcccctcccctctcctccccctcctcccctcccatccggcagccgacggggtcgcgcgcggtggcaggcagtggggcaacacccggcggggccgtgcacggggccgcaggcggcaggcgctggccgtggcaagcggtggccgtggcgggtggcaacgcgccagcctttctttttttttgataatttatgattcaccgagatgtataatctctttgtttagaatttgtgatttattgcatggatctgagatgtataatctgtgatgtatttgatttttgtgtaattttttaggatttgtgatgtatttgatttgtgtgtaaaagtaacttaggatttgtgatgtgaattatttaggatgttacaatgatttgaggatttggggtttgatttggggatatacatgacactcgatttgggagaaaatacagggattaactctggcaagtagcaaagaaacaatcaaaaaaaaaagaaaagtggaccaaccggaactgccgctaccctctcgttattcccggttggtaacatcaactgggactaaagatacaactttactcccgattatttcacccggaactaaagatgggcatctttagtcccagattcgtagccccggttggaaaaccgggactacaggggttcccaaccgggattacaaacggtttctccagtggtggctaagaccgaaggaagacctttaagtttcagtcatcggtggctagatttggcatcattggggctagacctagtcccctcactgccagatcgttctggtgccccagccgacaagtttaagcggcggtgaggaggagagtagaaaccagggctgcactgcgataaggggtggcgtggcaacatgaaagacaacatgatggcggtggcgcagcgtgcgagggcgtggcctgggctgcgacgcctatgggtggccagcgcaacaagcaagcaaggagtaggctaatggtgtgcgaggtggaggccggcggtgcgtgatgctagtggcacgcacaccgacggcgcgcgaggccatgactaggaggctacagagtgaggcggtcgctgatgccacgaggagctggacggtggggctagcagggcacaaccgaaggtgccgaaggtggttgaccgacgcaagatagctgacgcagcaagactgcgtgctatcggagaccgcttgggtggctttgtgttaggttgttgatgatatgttgaatagagtgaactgtaggcgaacgccttgcttggagttctctaggctggcagtgtcggcatctagcagcgtttcacccctttggggcgctgtcaagctgacaccctcttcctccttggaagattctccggaagaaaacctagtcctttgacggatgacggtggtgtcttgagcatcatacctcctggacggatgacggtggcgtcttgagcatcatgctccttgaaggcatcgtctttgagatctcatcttcccgccgtcacaggcttctctcaatttggtttttggcgttttgtcagttgtcgtcaccaggttggcgtgagggacaagtgggtgttcttctctcttgtcctctccctccccaagctttctccgtgaggatgaccgggagcccgttgacgatcttctgttttggagctagtgttcgccagggcgtttgcaagactagcggcattcagtcacggatagtggcggctggcttggtgctagttcttttgtctaggggtatgtttggaattgctaacatgtggtggtggtggtatgtttttcccctgattacaacctcttagggaggttgtggctgcggtggcggctggcgcgaatccacgaccacaactgtggactgcggtggcactctaaggtggtcctttggtggctggggagacgatgctcgtgggtggaactttggcagcctcctccgcggatgccatcctctctttcccggtggcggcaagcaacagattggtgagggagagaggagagttccacgagagagagatgaatgataagctttttatttcatatggccaggccttaatcataaggatagctcatccaaaagactcctataaggaccactagcttgtacaatgtataaagactacttgggaggtttaagaccctctgtatttccatattgtggacgccataagagacaaaaaattccatattgtggacgccataagagacaaaaaaaaactagcggtgcatccttgatctcactataaacacacctgtgtgcataatattcgtgggcaccaataaaat

SEQ ID NO: 19183 - DNA, 1730 bp, Oryza sativa
agatataccttgtgcacactggcgcagctagggggtgaaggtgccaacacccccctatccaaacaccaccaccactacatattctgtttttactttatattaaggctaactaagataagtatttatttagtttatttgggtagtttgaaagtattatcagattagttaattagcaagtctaaaaacattagcaacaaacatgatctacaaaattaatttttgatttctcatctttttcaaaggaaaatagataaaacttatttgtgagattattcaatagtttacattgaaagaatttagcaataaagactagttttaaactttcaatgatattattaaagaggtaaaatttaagttttttttaaatgactagtttatgtattgattgttattaacggtaactatttgaccctctttgctatcagtattagttattcggtctcatggcttatcctcacttcacaccccctaattttaaatcctggctctgcccctgcttgtgcatgggtgagatggtccatcagcccgttggaactaatgtgctctaggtcgttttgtgcaggataagttacttaatcctaaacggaaagatggaacaaacggtgatcaaaagtgaaactctgaccaacaacagtggcctaaattgcatttcataattattttagggtgaatagctaaagtggtccttcaaattttatagtttaatccttaatgttttaatctgttcatactagtttttcaagttttggttttagttcaaacttactcttgaacccacttagaaaccatatggctaaatataaccaacaactctcttgataaataacagttatatcccctcattcacatatataagagaaaaatttacgtgtaatgaatttttttaataaataatgcatagtaatttatataaaacgaaaataagttatgtacttgcaagtgtatatcatagctattaggcttaagttttatgtgcacacgttgaaattatgtgaagtatatatgtaatgttgtttattcatcctggttttctcttttctagtgtatagttgtatataaattaagggcaaaaatgacattttctaacataaatgctgactagaaatagtcttatggtatattaaatctgtccaaggatgattttatgtaaaaacaaataattagataatctatatggacaaaataaaatctgaaggaacaaattaagcctttgataaaatttgagagattaaattagctattcacccattattttactttttttaaaaaaatcaaacttcaatattcaaatttacagggtaaaatgtcaaaggaaaccgacatttctttagtttaacggagggtatatccgtggttgttttggttgttgcgcctaaaaatcctgtgggggaacctcgccggcgatccctccaaagcccagaagcgacgccgccgccgccgccgccagccgccacgttatccatgaggcctctcctcgcccgcctcttcgccccgacttacattgccatgggtttctcctcctccgcgtcaccaccgtcccggcggcttgcccacctcacacgccacctcctcctcagctccggcgagctctcctcctcggtgggcgcccccgccgccgccgcccggccggcctaccttgccgcccccaagggctacgccaccgtgctggtctgcctcttcgaggacccccacggcggcgacccccgcgtcatcctcaccaagcgcgccgc

SEQ ID NO: 19184 - DNA, 1875 bp, Oryza sativa
acattgcctgtgtgggatggaagtgaaacaatggtcgatacaaagaggatcggtagttagtcgatctagtgtaaatcatactgaattgcaggaagtggcagtatgctgtgctgccagagcagcagctatatagtgcatgttgcaggtcaaattctgttatagtattgagttgatatgagatatttgtaatattttagcttttgagccccagtcttaatatgctgaatggtttatgtgtactgcatctgcatgcctcagattgttcagagaaacagaaagtgtgaagcattagcgaatgagtcaatcacagaagtcatgtgattttttttaccttgttcttagcatgtgttagatagtgctaataaaagtagaaaccaatatgatgatcgatggattttgattcattcagagacaataattcaataaagagataatgaaaatatgcttgctagttcatttgatctctgtttgccattttatcgcttgtttgtgtattgctgatatgccaatgccatatcacatttctagtcccaaggcgttatataactgacttgtgagaatataagtttacgtgcatggccaactgcgaatgtcttggttttcaactaataacaaccaaaagttcttgcatactttggtgcttcatctggttattgctgttttcttgacaaataatactctaaataactactcaaacacatgtgtccatccaagttcatctaaattaccttttttagtcacctgagcttggtacaacttgtcatctcttccccaagaacaggtgctctttcactctagtaaagtcaggccacttacctgtttcttacactaaattattatggttgctatctgatataagctgtgtgagtttttggaaccctgcctttgtgcatcaaatttccctttgtaatatcaagtaatctataactgtagtcccatgctcagaccccaccgttttctgtccttagaggagagatttccaattaacatctcactcttatattaaaatactgataaaactatttgctctatatggctttaattgagtaattattgatttccaagataacacattctttgacacattcaatagaaatgcaaactatccagaactcatagtacagtcattttgtagaacggactccatgtaactcctgtaatcggcattctttcggataaagctttattcaagcctgtcttgaatgaatctgaagtggcagacatctttgatgcacctctagagatgttcctgaaggtattactgttatttatcgatgttactcttctccttttatattcatcatcaacttcttgttgtcgacaagggcattgttgcatctagctctcatttctaccatacctttaggatgatacccggaaaacacaagaatcgaattggatgggcatgaatattccagtccagtcttttgagtaccagtcagaggacaaaacgtttgtgatttggggcttaacggcacacattctgactcgtgctgcagcagtcgttttaccgagagaaccatcatttgttgaatttcgaccaagatatgtgaactcaccctctggagatacgaatgaaacaaaacgctgatgcaataccataatcatcaatatgtaattctagcatttatcccctccattcagaggcagctgcttgtgcctgtctatagaaaatcagcttactgtactttttgtatgtacacgatagtccatagaatgttgcatcatcagcatgttggaaaatttgtcaatttgatcatcggactcagatagtgaacactcttttgttgcactttccacagaatgttgtaaacttgtaatacttgaaacttgctcgatatttgaatgcactctctgaacaggaaacaaaagtag

SEQ ID NO: 19185 - DNA, 494 bp, Oryza sativa
ttcgatctcgaagaacaacatcacttaaaggtatagcagttgggcttgatgtaaaggctaacaataatctgtctgccaagtcctttgaaactttcaaaagacgctccggattagcccttttagatgtcattggtatcccagagtcacctcttgctttgtcaccaccactcaagtgataggcactaagaagccctcccaagacacggatagtagtttcaaatagattgacctgccctttctcacttaactttttcatgagattatcttcaatccattttgatgcttcggaaacaacatcatcagcacccattattattgcagtgtctaaagaatctacaacagtagcgcctagacctcctagtccatctatacctcggcgggttaaaggcataagctcatcataacccattgcataatttcgatagccagaccatgcatgttcaaatgcttctttaactttcttctgtctgagtgtccattcagattgaggagac

SEQ ID NO: 19186 - DNA, 7318 bp, Oryza sativa
  unsure (1)..(7318): unsure at all n locations
atgattgtcgcctaagaaagtaagaaacgtatggctgtcgtataatacacatacggtgttccaagagttcgacattaattaattaatttgtacgaaagtgcatggtaggcaactaggcataaaggacagatggccgtcgagatcatcccacatgcaggaaatgtcactgttgtattcatgatactcgtatgagtaacatcgcccttatatcacatatatatcggctataagttaaccaataaaaacatgctaagtaaagtaccgtcggtcactaaacttattcatttgtatcatttaagtctctaaactgatcactaaatgtattttttttccttgaacttgttaaaatactgtcactccggtcctaaattaccacgatccctctaggaacctacatgacactcacgtgacatgtggcgttgattgatttttttaatgttttttctcctctaattnttctattcttgatcctgttggtgtggaagagagtgagcgaaaaaaaagaaagaagtgcagaagggaagaaaaagaaaatacgggatcggaatgttcatgtggcataccactttagttttcatgtgacatgtcacgtaagcgctacataggatcctgtaggggtcgtggtaatttaggatctaaataatatactttaacaaatttgagaatctgaaaatgtattttgagagttcgagaacctatatgacacaaacaaaaagtctaaggaccaacaatgcattccactcgaaccagcagcaaaaatatgttttcacatgtatgcatcgatcctcagtgtgatttcttgagagagagagagagagatgcttcacgggcgatattattattcagacggcgcaagcaatttgccacatgttacacgtgatatcatattcataagtgacagttattccactgtgcgacgctactgaggttggcatgggcaaaaggaggaatagataacacataattttgacaggcagacaagttcaaaataaagaattagaaaacacatgaacatataagaatagttggttaaataaattagaggagaaccacgggaacacacaaatggtcggatgaagatattggagctcttgttgacttttcttcaatagcaagatcatccatttcatattaatttcaaagataataacataatttaataatctattacaaatgcttttctatttttttcaataggatcaaaatcctttaaaagttttcggaaatgccttatatttgaatatatacgaagtcaagttactccctccattccaaattgatcatcagatacatgggtgcattaagacaaaaaatataataactcacttatactatatttattatggcaacaaactcgatgtatgcatattccccactattttttagccaatagcaaatcaaaacactttgtgcatggatgcatgcatcaatgttcatttacttcaatgtataaataataaataaatttaatgaatgaacacaaatacgatgatcatttgaaatattctcaaaaagattatatgatcaatttgaaatggagggaggaatatagaagatttttattttatagtattattgatagagactgataagaaatgttgtaaaagtacccgtgtatgaaataaaagccagcggacgaagtgaacgatgttaactgggtaggtttcttttgacggaaccagttcactcgatgacacatgtactcacatttacggctaatttttttttactagtacgtacgtgacgtacgcacggttagttctgactttattaatttaaatatatactccatccgtcctaaaataagtgcagttttgcactattcacgttcaacgtttgatcgttcgtcttatttaaaaaatttttatgattagtatttttattgctattagataataaaacatgaatagtactttatgtgtgactaaatttttttatttttttataaatttttcaaataagacgaacggtcaaatgttgaacacggatatccacagctgcacttattttgggacggaggtagtatcaacctactttttcggagatgactcatagtggtcagtgtgtatgtggtacgcgcttactccagtacgcgcttgtactgtgcttcttgaataaaaaaccggcgggcccctctgtggtcgggtggctgatgattagcggccggccatgaatgattccactgattcggtccctttctgcaacaccgcacaccccatttctttacgatatcctcgctgccgcgcgcgccccctggtggctgctgctggtgcactgcagcactggcacgcccagacagccaccgccaccgcgcgcgtcgtccccccctcgccgcgtgtcgcccgctcctcccgccgtggccccgcccgcgcgcccatcccgtacgtacacccgcgccgcgcgcgcgccggaccaccaccaccaccaccacaccgttgccgccgaggccgacgtacgtacgcgacgcggtgggcaaagtttgctgcggctgcacgtcgactcgcgatcgcgcgcggggcaccatgaccaacgtaccgtctcgcggtcagtcccaggtgcgcgctcggttggccgggggcccccgcggtgaccgcgtcgcgtggtgcgtgggtggggtgattggattgcgaggctttccgttcccggggggacgcgtgggggggaagggaccgacacgtgcggagctgcatgcatatgcgtatgctgcgcgggtgcccgggcgggggctccagcggcagccgcgcgtccagctagcgcaccacccagcgacgcgatgggatgggtgtttctgattctgtgtgcgcactgacgtaactccagtacgggtggtcgggcagggctgggtcgtactactagtgctgcggtttgacacaccgccgtcagatctgtatagagatgcacggctgagatcatcgtattaggatctgttagttggcttatagatctgttgagagatgcacggctgaattagagcaagtttaatagtgtagccaactactagctttaattcatctataactaatttaatagcttattcatataatagttagttataaatatatactacactattaatatatagttctatatttcatacacacacaatgtattgaagtctgtgctgcagctggttataaatttgtagcgtgtttgttttctcactcttctcttctcttctccacatatgcttatagcttatttatagcttcctactgtactcgctcttatttgtctccggcagccaccgcacctcgtgctgatcttttttctctttgaggttaagataagtgttgtgcttgtttcatgtggctcggcaggcaatggatgctttcatggacagattcaaagatgaataatatgatctcgatacgaccctgtcgttttgaacacatgtggttgaggcaatatctccataaaaaaagtgtgctaagtcacataacatataatgcagaaaaggagaaaaacatacgaacaacggcaatgggcgagaaatatcaaatcaatgtaatttaagaggggtatttacaatgaattatttggggaaatatcaaactcaagatgatatttgggatggtttttatgattttcccttatgtcatcttcttcttttgtgagactgatgctctatacatgtgccgagttgtctataccacaaattatctagtgctaaattttgatttcgtcaaatttgatttgaaaattcatggagaaagtccgtaattcctttctcatttgtagctatggacgaaaacggctcagaagtagacggagaccaattctatcctttttgtttttataactttttttttagaattggaattgaaatcgaaaaacttagatatgaaaaggaaatcaaatattattaaatacagatacgaagcgaatgcaaatcggcgtgaatatggtaatgaatattcatcagaatatgaaaacaaatctaactacactcaaatcatcgaagagatgtagctcattatttttctaaaacaataaatagacactttaattgtttatctactttaattttcaggagaactacaattagcaagagctacaatcatttaactctaattcgtcggcaaattttactacaaaacaccaagacctgtgtaatttgtttatacacatcgaaaaagcgtgtcatgtctaaaagacatcctagaaaacctggtaatttgctagacgacactttcgactcaattggatagttagatttttaagaaatacaagatgcccctgtgaccacgagtttcaaacatgacattagagtaaaaatttagaaattatacaactctaaatttgcaatcaccccaagtacattattagcatacatcatattccttcttcactctagcctcagatcaaaaacttttgaccctagggatacttttttataagaatttatctttccaattgaaccgaaagtattctccagcaaattaccagtatttttagtgtcttttagtcgtgacactttttattatgtctatcaataaattacatgaactttgagagtgttgtagtaattttttcctaattcgtatggcatggcctaataaaaaaagctcattaagcacataaagctcaacatgcaagcatatagtatttatatctataatttatttcattctaaaaccaaacatacacatgctaaataatcattctcaaatcattttcataatatttcgatccaaatcatttcatcgtttctccaatatataacaaatatcccacaacaaagtgtggggcatcatcttttgtgagacatagcagaccatacatggctttggtctggacaactgtcggtgaacaactttgaagagctgcaatgccgaccaatggaccaaagagaggccacaccgacacatagtagtgtacaacgagggatttgcatactttgtcgctccacgaaatagattttgattatttatcatacttatccacatctttgacgcgcttcaacatggggccactgctacaaaatcctaatgggtgtcagttggaaacccacataagtgtcgaattcttcaaccagcatctcgcaagcagcactgatgatgaggaaccaaatgtgtggtttaaaaacgacacctttatggttccactaataaaaaaccaactcgatacgtcggctcaattagctcctcatcacccctgagatccatcaacaaccaagaacacagaatcaacattcaagaacaaaatcaatgtccacatatcaacaataaaaatccaagaacatagagaggaggctatctaaggagagaaggccactgtcgccgctgctcaccatgggctaagtccgatgttgagcgtcccgtgaggagagggcatcatcgcttgtcgagggacccacctccgtcatctagcaggtcaccctcgatccgtcgtgccaaggttagttggcaagctagatggcggtagctcgccatcgcgccagctacatcggagataagaagcgatagggacagtggagaccagggatggctgctgctgaggaggtgaggagtgatggagaggaggaaggaggacgagtacagcggagttgaggggtggtggcagcagcagagatgaggggccgcgatggtgagcaagagagggagcgcggagaagctgatagaggtgagcaagagagataggctggactttagacgcgaggtcatccatatataaaaattaaccgggccggctcgatcgattgtcaactgactaactgaagagagtgtcggtttttttgtagaactgacatctattaccctctcataagtgctagtttattaaaaagaatagcacatattattgtggtgtcaatatttttaataaaccaacacatataaggggttatatatgttggtttttatttgtagacccatatcagatgttggaaaggtgagaaaaatcttatatatgcccattttttatgtacatatgagggcgtcagtttcggtcttccaacacctctatgtgcttttctcgccatatgaggcttgctcattcacgtcttactctttcattcgcggatagtggggaaccgatctggtagtgtctctcatcttgtctcacagcaacagtggacgtgttcgtccgacggctagcgtgttcatccgatgcatgctaggtgtttcccgctaggttgccgttggttgttccttgcgttctgcggctatatttgggcgagtgactgatttacaattcagtttttctcttgcgctttgagaagcggctacatttggacgagtgactgatttacaattcagtttttctcttgcgctttgagaaacgtctaggggtttttcggctagcttcataacatggtgagctagccggcttgagtttaaggtttcacccctttaatttatttgttatcaggtctcccctagtgttcgcgttttgcattcgcgaaaaagcgttctctgacgctttcttccgttttggctcaaagtcagttgccaacggttatgtgcgtaagttttgattagcaaaaagatcgtccattagtttcggggagtctgtttttggtttgaggacaaagactacatgcaacatgtaggcagctgctcaaaatcaatggttatgcagatttttttgccaaacatgaataagatatagtctcgatctaaagttctaaactcctactaattaccattacctttactaatattagcatcaattcccttatataaactcccaatcattttttcctcaagttaccaaacaaaccatatggatttccattaatacggtcacatttgccaagctcctaaatattatattttttttaaaaaaaattctcttaacatgctataagaactttttaatccacttaataactctctaatatttaatttgggggtttgtcttaaatactccctccgtttcacaatataagactttctagcattacctatattcatatagatgctaatgaatctagacattattatatatatagattcattagcatctatatgaatgtggacaatgctaaaaagttttacattgtgaaacagaggaaataattactatattttcatccatcatctattgaaaatgcagagtgacacatcgattatttttggtaccacatatcccctccacagctgtacccagagcccaaagacgctttcaacgcctctgcttttgtccagatgtaggacgcattagggcatttacaatgggtcaccacattttgccgttgttcccatgccacatagactaggaacagtgtaagccatatgctccacaatgcaagttacagctacacaatacaagctacacgtagtagtgggtgccagcactctatatctcccttttactt
